United States Patent 11,549,145 (METHODS AND COMPOSITIONS FOR INHIBITING AND TREATING NEUROLOGICAL CONDITIONS) - sequence listing, part 42

SEQ ID NO: 863 - DNA, 85838 bp, Homo sapiens
ccattttttgcatctatcttaccttgaactctatcatagcacatattgtccctcaaagcattgctttatttttattttattattattattattattatttgagatggagtcttgctctgtcacccaggctggagtgcagtaccacattctcggctcactgcaacctccacctcctgggttcaagtgattctcctgcctcagcctctgggattacaggtacatgccagcatgcctgactaatttttgtatttttagtagagacggggttttgccatattggccaggctagtctcgaactcctgacctctggtgatccacccacctcagcctcccaaagtactggtgctgctttatttatatatccatttttctcactgccctgaggggtccttaacccatttatgctggaggttgcaaattttttttgtgaaaaatcaggccttggcgatgaccttgagaagtaggatataaataactcccactagcttagcgctccaataatggagcactaggcataaatgcattaagatcagatccctatgttactcatccttcctgccatatatatctttgtatccagggcctttaccatagcagatattaatacatgttggctatgctgaatgatttttatgtttgttatcattatttcctccattctcctagcagacactcctgtgaaatttttcaacttttaataaaggaaaatggagtttttacgcacaactggattaggttagagaataatgtatgcaaaagggccagacgtagtgagagcaagacagcagtgaactgtggggcaggaaagaatagagtagaaaggacatttaaaattcatatctgacagttggggtcagatatgaattttgcaagccgggaaggagtaggcaaacaaagcgacaacctaatcttcattcacaaaaaaaaaaatatgacaagcaaggaatcaggcaactgtattttcaacatctccctttctatggtgtttctaactcacagcatacagacatgttgtttctctctcaaaaaataaaatctgaagcagtgatatgatttcactatgtatttgacttttttttaagattccacatgtgagataatacaatatttttctttctgcatttggcttacttcacttagcataatgtcccctaggtttacctatcttatggcaaaaagcagaatctatttcttttttaaggctgaataatattccattctatatatgtactgcagtttgattttctgttgtcttttgttggacagttaggttgtttccatatattcacacccatcaagatggctactaccaaataaaacaagagataagtgttggcgagggtgggagaaaagagaacccttgtatactattggtacaaccattatggaaaaagtagggaggttcctaaagaaattaaaaatagaactaccattacttctattttgtaccaattagccatccctcttctgtgtgcatgtatatatatatatatatacatacccaaagaaaatgaaaccgcaaccttgtaaagatatcagtcggaatttttaaaagctctctaggggattctaatatgtgtgcatacagagatggagaataaaacagtgatcccaggggagggggaaggaaattgagatgtaggtcaaaggacacaaagtagcagccatgtataatgaaagagtttgggaactcatgtacagcatcagtactatataatactgtattgtattcctgacttttgctaaatgagtagattttagctactcttgtcatacacacaaaaatggataactatgtaagatgatggatgttactatgtctcactacagtaaccattttactatttacatgtattccataacatgttattttccttaaatatacacaataaaatgtattaagtaaataccctgactgaagaacaattatctcctaagagggacccaagcatatctactctctattctcatgtccagcccccttcagcctcatctcctattcagtcctttacccacagcacgatagctttacctccaccactacaatgaaaccagtgacttctaacagtcattgatgattgtaactttacaatcatcatcatacttaatggccactctccttcagcatctttacatctttctcttttatggtttctcctttaaatttttacattctctaagactaatttttagcccttttctcttctctttctatacaattcctctatgtacttttatccgtatctatggatacttcagttactctccatatggtaagaacacacaaatctgtttctccagcctttgcaatctcttgtgatgttccaggatcctatatccaactgccttctagacatctcacacttgccaatgatatgccctgcgagcatgttaaacacaggtccaaagttgaactcattctcttctccctcataccttcttcctcttctcttttcccactcacaacccagaaacctaggaagcattctaacattctccctctcccatatcttttacattcaaacagtcacaaagaccagcaaattctccctcatcttacttttcctaaacattctcacttctctattcccactacttccacctttatctaagctttcaacctctcttatccctactgatgtactgtccttgaaagcttccagtcttgccatgaccccacacccaaccccactctaccctcaatctacccagcacactgctttcagtgatcttccatgacactcacaattcttcagtggctcactactacacatggtataagaagtgtaccctgaactggctatccagtttcatctaggaagtgtaccctgaactggctaaccagtttcatctcctttcactcctgaccttgtccttcacactctaatataactgacctacatatagttcccagtatacactatgttctcgtaatgccacacaactactcatgctgttagctttacctagaaatgctttctattgcttgtcaacatgcccactcctactcagttttcaagtctcagctcaaacacaaccactactaaaacccttacctggtattgcaggcagagatcaagagctcttgctagatttcatttgtacttgtacctacctctgttatagcaaatagcatacagtatttgaactattggtcaagatatctgtagtcctacagactataagatccttggtcaaagatgacttttcatctttatatcctcctaactagttcaattcacacagtcactagttccatgtacattactagctcaatgcagatagatatactaaaaaaaggaggggcgaggttaatgaataaggtacgagtcaatgaaagaacaagaaaatcaactggactttgagtatagaaaaaaaaacaccagatcttaagaacgtacagacatctttagtacagacatctgttactgtagtacagatatccattactaagtcctaaccattaaaaaaaatagaaaaatatggttattcaggtagtatgaagatgacaaagaaaaaaacttattattggactaagtagacattaagaaggtaagagtttccagcggaacagttgacaaagatcaacagagaagccagagaaaaagatggttctttctaggaaacaagtaattcattgatctaaattcatggactgagcaaaagactgccacctttctctcagttcacaacccctctcctttgtcattattctgcatgaccccttctgagtcctcactaccaaatccccaataccatgggtagttcccctccaatggagccacaggtccaggccagtgacttaatctggatgcaagggcaagggatagaagggtatctttgttcttgtgtctaggactttgaggaaaaatgaaacaactatttactgagaatttattttacggcagattctgtgccacattacactcactcactgaatttcacagtaatcataagtaattatcccatttatagatgaggaatttgtgtccaaggtcaacagttaagcaataacaggccctgcctgaaaacctaagaatgacaacctccagagctttttctatacccctcactacctcaaaatggagggagacgtggtccagccattctaggttggcactcaggagacacttacctccaaaacactattatatatgttgattagagtctacagtaccactaatatataataagcacacaatgagtttaaaaagctttccttagtacctttaggaaagtaagtactagatttcctggggttctgatctggaaatctaaatgctatttattcctataagtacattgttaactttacaaacaacagacttgaaaatgaacttgtggaatacaatgggttcttaagtaaggcttttctttaagaatattttcttgcttccacaaaaaatacaaaagccaccaaagatagaatgattttgccttgttaacttgtaagaacaatgacactagaagaaacctatgggaaatgtgcttatctgaccaggtgctcattttcggtgggctgtcatttgactaaaacatcatactaaaccctacagaccacagcttatgagagaaatgccacaaactatagcagtacagttaatatgcctataatctactgacaaaacatactcctcagtaaagtgaaaccagatgtctggtgtgaaatcagatgtctgtgaacttgtctttctcagtttccagagcagtatcagatatactaaatacacagctaagctgtatattaaatccacaacttggcaaaatcatgacagtttggacatgaagcatcagcatttttattgtaatccttataaaccaaagacatttccaaaatggaaatcctaagtttaagtactcagctaaatacagtaatatgtctttctcactttaagaatagtgtcagggctttttaaacacattatagaaattctttcccttcatttttcaagctgacactctttatccaaggctgtggaatgatctgataaggccacatcaggtgtcagtcctcgtcccagaaattctaggatcagatacaccaggtgaacccctgtgaaaagcaaatcccagggaggcttaacagctataggaaagttaggcactacatggctttccacaatcaaaaggaagatcataggaaagtaatgggtgaccacatagaaaaacagggagggaaatttaaaagtaagtacttctatgccaggcactgttttttcacacattcttttatatatactctttgttctgttttgatggataagaaatcaagcagcagagaaattttaatggcccaaagtgacacagctaataaaataagagccagaaatcaagctcatgtccaaaagactgtaaaagtcatgctacttctacatgaagttgtggggtggagtgaggaggggtggtaaatagccaagaagaaggagaaaaagaaagaaatttacaattttatcaaataacagtgaaatatatatatataaaacatgtattatgttccacatatgttccatatataatacgcagttaagatgtatacatgtttaacatatacttaagctgcatatttagtatgtgtatatatggaacaaaaagttgaagaaacaagtatcaaattgttaagtggtcatctgaaagtggactcataggaaactcacttattgccttttataccctcccagatttaattctaaataacttttttttgactttttattactcttataaccagaaaaagacaaagaactattctagcttagatcttttaaatgaggctaaatgcacagaaacccatgcaagttaaaaatggtctactttcgaatttatttttctaagtacatcatcctttacactctccatgattcctaatattaggtccttcttatggaacaactacaaaagttatcctcatctaattattatactcgtacactggaaaatgactataacattattcattataggaaacaaatcatcaaggtcagccatccttgtaagtttattactgaaagtactagaaaggcggaataataattctgttctcccacaacactgtatagacctgcaaaccactatgatcagtagtacagggaaagtcttgtaaattaacatgtaactattgagaaaatccacaaaactggtgaaaggcctaccccaaaacagccatctccaatacaatctcatcattctcaccatcctacttttatcaaagtgctgataaaagtgcgtagcacatggtaagagagaattagctattgaatcaatgaaggaacccattatcaataaacaatcacttcctgttttccataaattatgtggtcacctatcacttgagcacaaacaaataggcacgttcaggacacaggcagccagtatcagaataggcagcctatcacagagggcaattctacttttcctgtgtaagaatccaagaatgcagttttactacattcctgcttgtagctaatctgaatttcaactaatttaaaacggttatttatatgtgacatataggatgcataatgagctcccaaccttgtgagaggagctgtgtttcatttcaccatacaggggagagggaagcagtgtattaaagaagtgatagaaaagtcccacagaagaaccaatgaaatagaccacactgaaaatcacagtaagcctcagagaacttcagtgtcctttttggcaacttttcaaaagtgaatggaatgcttgccaggaggtaccaagagtgaaagcccagagaaaaaggcccagcctggtcatctctctcccctcaaaacatcttcttctgtaagcttgagagatcccaaagaacttcaacacttgtaatcttgttactaactttatgctttggggtcctaaaggattttttcaggagtacccttttaaaatgtaaacatccctaggggggttactgttcattatcaaacaggacctggattctttagtgctatggtctcagggattagtcaaagctggctaataagataggggccggagacagacaactagagaggaccaatgttccaaggtaaaaacaggtaaaggggaagtgcagttttctgtcgggtcaaggggctaaaagggatccacatgcccaagctgttaaactctatagactgtgtgaggctgaaaacagtccggggcctggagcctgtgactttgaaggtgggtcctccagttcccgatgaaaaggtagaatctgggcccaagttccccacgagcagttctggacatctagcccttctctctctcgctcgctctcaggataaagtcctaggtccttccacccctgaccattccttacttaccctttctcccgctcttcctcggtgagaaggggtaagtggttattttgtgccctcgcccaatttggccaaaaccctaaaagtaaaaaacgacagacagacacgtgctttaaaatcatgttgttcaagcctgacgctctcccaccacctgcccaacacttccaggcagaaggcagcgcgcccccacagcgctccctcacggccagagccgggggccggactaggcccctttgtgaggactgggagagggcgcgttgttggggcgccggctcggcggggaggagcgggccagctccgggccaggtgtgccgcctgtggcgccggtttctcaacctagttagccagtggcaccaagaagaggactaggctggggtggccgccgcacgcgcctcagataaacacgcgcacgcacacatgctcgcgatcacgcaggactcgcggccgcgcacccctccgcctcccggcaacgcccgccccgccggggccggggccgactcccagggaagggtccccagcccaagagaccaccaagggtcggcggctacgcgcccgccgacccctgccagcctcacagccccccacccgccgccggacgccgggcgcccgccctccgcacccgctgcgcagctcagcccgggggaagtccccgcgcagaccccgccctccgccggcggcaagctccgccccgctgccccgtcgcgcgctggccgcccgaagctccgcccccggcggaaaactggtctctggaccgcccgcccaggtcgggctcaaaatgcggcgtggatctgaaaggatcaaacacaacactaattcagcaagctattattgagcacttgccctaagctcagcaacgtactaatgggggagactacaataaagagccgaaaagtctatgaaactgtgtcttcagctcttcctcttgttttagaagccaggaaacagagaaccctcacagttacttaagtacagggcagtagtggcaaagcacctcactagcgatctctgggcaactcttcatttcattttttcctactcatgagcactcaggaaaactattcagttttgctgcctccaggtaaaacaaagtgagtaacacaggacaggcggtttacttgagagaaacgggaatttcatactgaagcttttgccctcaaatggtacaaactctttttttttttttcctgagacggagtctcgctctgtcgccagagcgacactgcaatctccgcctcccgggttcacgccattctcctgcctcagcctccctagtagccgggactacaggcccccgccaccatgcccggctaatcttcttgtatttttagtagagatgggatttcaccgtgttagcaaagatggtctccatctcctgacctcgtgatccgctcacctaggcctcccaaagtgctaggattacaggcgtgagccactgcgcccggccgaatggtacaaactcttaactgggttattacaacctacaaagaaaccttcttatccatgttattaattatcctaattcaatgtggtttaaaatgttgatgaaagtacccaaatcatggtgctccaacaagctggatgccaaccaggtactcgtaagtacttgcaattacaggtgcgatattttcattccatatcatcccaagatgcccttccttcacgtgaagcagccagaaagatcaactaccagattccgcatgattgaggaattgataaatagaaagggaagaccgaaaccggccaaattttcccttcgaagtgaaacttgagaaacttgcgtgcattttacctgagttcctttctcagcagataaactgtcagacctcccagatagtgtcaaggaaatgcaactttccagaacactacatctggacaatgaggtgcatctgctgcctgttcacaaactcctcttccttacccctccataattccctgctatagaaagccctaactttagtctccctaagacatgtttgagactggtctccctgccagcatcacctgcattaaagcctgtcttccctggcaatactcgttgtctcagggactggttttctttgctaggagcaacccaacctaggctgaagcccaggcatttagcagcagtggcacctagaaatactgaacagacataaaatactttttttctccttttcttactcctccagttgtatcttcattatttctgtctctattctccctctagatactgccaaactactctgtgcactttcagatcacttaatactaatgtaaataacagacattctggcactcttggttcaaaatttattctaaaggtttaagaatctactcagggtcttaaatagcctgataactaaaattccaagagtttcctaaagagagcaaaattgctctcctgtgaaggggatatgtcccagtttttcttacttgtcactgaaataattactgcaaagtaagctcttttcggccagtgcttaaggacttaatttcaagagcacttaggtgacaggaccaccctcatcaaatagcagtcaagaactatttggtaccatgaccccaaattgaatggagctcctggtcactaggaactgacagtctgggatggaatgtaggtgaataaacaacaaagacaggtgtttatggcctttattgtattgggaagtcaataaacatacaaaaagagttgctaggtctggcctgattttatcactaagattcatcaagtgtacttaaaaagaagctaatatctggaaagggcagaactatggtatattagtcagggtttcctagagggacagaaccaataggatagacatataaatataaagaggagtttattaagtattaacttacatgatgacaaagtcccacaataggctgtctgcaagcttgaggagcaagagagccagtccgagtctcaaaattgaagaactttgaatccgatgtttgagggcagtaagcgtccagcacaggagaaagctgtaggctgagagactaggccagtctctccttttcatgtttttctgcctgctttatattcactggcagcttattagatggtgcccacccaattaaaggtgggtctgcctttcccagcccactgactcaaatgttaatctccttggcaacaccctcatagacacacccaggatcaatactttctatccttcaatacattcaagctgacactcagtattaaccatcacatatggagacagtaaaaagatcagtgattgccagaggtcacagaggagggggatatgaagcacagatttttagggcagtgaaactattctgtatgatatgataatggtgatgcatgtcattatacatttgtccaaacccataaaatatacaacccaaagagggagccttaatataaaatctcaactttgggtgataatgatgtcaatgtaagttcatcaattgtaacaaatatactgctctggtacaggatattcatagtcagggaggctgtgcagatgtggggtacaggaatatataggaaccctatacttcctgctcaattttgctctgaacctgaaactgatctttgggagaaaaaagtttatgagaaaaagaagcagcagttagagcatcctattttattctaatttatcaattaaattctaagctgaatatttggctttatgtatctagttcaaatatatttgccttgtctccttatatattaaagcagacctctatttgttgttaataccatcaggggaaaatgaatcataaagtcctaactaaggtacaaatttaaactatagttaggcatcaaatctaatggtcaaagagatatttaaacaaagttaaaataattaagtttacagattccacaaatatagatattaaaatatattcctatctatacatacttaccattggtaagcaaataatagaaggtatcatagagtagcagttctcaaactactttttgatctcaagttctctttacattcttaaaaatgattgagaactttaaagagctgttgtttatgtgggttatatatgtccatatttactgtattaaaatttaagatagaaaaatgttagacatgtgtttgcttaatttaaacccattacatgttactgtaaaagttatttttataaataatgactactttttttccaaaaaattagagaaaagtggcatttttaacattttataaatctcttattatctggcttaaggagagcactggattctcatattctgcctctgcattcaggctgttgtgatatgttgttatacctaagatatgaagaaaattaactgtcatacgaattcatagttgaaaaagagaggaccttacaaagctccgggaagggtttcagtaacccctaggtgttctcaaacctcacttggagaattactgccaaatggccttttgcatttcatttgtttgaatgtcatatatttccacacaggcttctgttaacacctgaaattatagccctttacttatttcaagctaaaactcatatttgtcagctcatatcaaaccatgacatttcaataaagtttttaaaagcttttactatagcaactctgatgaaattgatattattatttgaattgatatgaaaacacttgagatttcatttatatccttcatctcaaacgttttggaaaattttgaatataaattgtaccatctggaaaaaatgtaagattggtatatagttattaatccaattttaggtatgcttataacaaggtatatccccttttataaaaataatttaaaagcgagcttaaaacaaaaacaaaacaagcaattacagttttatttatgaactaaatacttgattctaaacttactaccttggaataaaattttaaatatataacctttcatttttattacaaataaaaataatgtaaatcatccagtttggggttttttaatacaatttccaactaaaagaaactagagctgaccaaccaaatgtctgacttcagatctgggtcaggttatacacaagatgagcataggataacttgtcccacaaagccgggaatccattaacaacaaaatgtgtcaaagggacacagaaaccaatatcaaatagctcctttggccaaagatggacaatttaagcatcaaaaaaagtaatggatgcagttgttagaaacatactgaatatataaaaattcatgagttcttaatgatgttccaaaaaggggaggtcaataaaaggaaaaaaaaaatccactggacactattgcaagtagctagcattaagcccttattctaaaattgtccattaaaagaaaataattcaaattttctgatgtatctttcctgattaaactatatatcagaaaaccaaattggtgttgagggaaagttgttttttataataaatatgaaacaacagaattggaaacccaccatttagcaatcttgcatttaataaatgattcaggcaaccatcatcaatggatcaaaccaacagatgaaatgttcatgaggaacttcacaatggagatcagaccgtcactacctcagcctaataatctgtcattacaagtgggactccagacattgtgtgcttcctgatctaatgccatctgaagcactcagcacaactatgaaatgttatcacccaaaaaacatgaatgggatctaatcaagccttaaaactgacttctcacttacaggcttacaaaaaacatgagggttacaggaataagttaaatgacaccacaaagaggctgggcgcagtggctcgcacctataatcccagcactttgggaggtcgaggaaggtggatcacttggggccaggagttcaagaccaccctgggtaacatggtgaaaccctgtctctactaaaaataaacaatgagccaggcatggtggtgcgtgcctataatcccagctactcaggaggctgaggcaggagaatcgcttgaacccgggaagcggaggttacagtgagccaagatggcaccactgcactccagcctggatgacagggtgagaccctgtctcaaaaaaaaagaaaaaaagatgccacaaagaaggaaacaggtaaatctagaatggagtagaatggaggacactctctaggacaattgatgtagtctctacaacaagttaataactggacacacaggagagggaatgggtcaggagaagcctaggttaaaaaaaatacagccatgaaatgtaagatgtgaacctttatttggatcctgattgaaacatcacaactataaagacttgtaagacaatcacggacatttaactatggactggtgttagatgataccaaagaaatattattttattaggtgtaataatggcattgtgattatgtaagaaaatgtccataatttttggagaggcattctgaagtatgttgaagttaaatgacatactctctggaatttactttatacttcaacataaaaaaaaagaaggaagaaaaagagatagcataaataagaaaataaaatggataattattgaatctagatgatgaggggagttctttgtacttttccatggttttcgtatatgtatgaaattttgtataatgaatatttaaaaatataagtgacggccgtagctcagattttctagaaaacagtgcctgagacaagctcacatgttaaaattttcttgggggttgcagtactagaaaagcaataatgaaggaaaagggagaacagaggcagggacagagggaggaagatccatggtggtatgtttccaagctgattatagcatcccagtacatgcagttggttgcttagtcacacaggacatctcaagaaggctgtgtgaaaccactgggtaacaatcctccctcaggaggggaaaggttaaggcactttttttaactggatccttcctgccttctgtctctcattcatcaatgtttgttccataaagcagggcaagcatgtgggggaaaaaaggttgggggcagggaagtgaaaatgggttttatgaagtgactgagatttgtttaatctcacaatgtagaatttaaacaaatcagtgacttttgggtttagtgaagacttacctataattttagcctttttgaactagaataatcattctgcttgactttcttattacatcagtaaataatttattcaggtcaaagccattatttttgattaacagaaatcacagtcacataaatggctacagaaactaaatataggagaagggttctaccacagtgacctgaacatttgcatgcgcccttgcacatctccacaaaggccacatcagcaagacttgactgcagctgatctaagtcatggtggaattctgttgattctcctacaacatgagatcatgagaggcttgttaagagctgacccaaggccatttctcattcacctcccagtttctcattgcctcctgtgttttgaggaggtatgacactttctgcctcattctccctagaatacagcctcaggctgtaaaactgcttagctgaagcatgacattggttcctcaggaacagggtgccctatcatccaggttgtggtcatctggcctcctttgtatcagtgtcaccctgtgcaagggataccagagctggcatctttggctactcttgcttttgctttccaagtaagtaataaactgtctgaatctaaaaatggcaactcattgttttcttactagctgaatctatcacccttgccttaccttgacaaattctaggcaagaaatttttactttccttaatgctaaagaggtcctttactctttcctctttgtattttgctcagcctacaaagttagtagccagtaaacaaactgatatgaaaatatgaaagacttagattcacatttttagaaagagtaactgttctctaagtattttaggataatttttggccaacagttaaaggagccttccttctcctggccttgccttcaaattaattaataggctattcttacaaggcaggtcaagattcagtcctcttaaaaaataaagaccaatcagaaggattttcaacaaagtccctttattttctactcacacttaaacactatagttggtagggttcaaaaagtctgggaaagagggagacgaagcaagatggtgaaatacaaagctccacgaatcgttcccactaacccacaccaagttaacaactatctacatggaaaaaaacaccttcataagaacaagaaatcaggtgagcactcatagtaccttgctttaacttcatagtgctgaaagaggcaacaaagagagaaaaaatagtactgaattgccgatgccaccccctattcctccccgaccccaggagcagcatggtgtggagagtgtccttgggtgctgggggagtgagaacacagcaattgtgcggcgttgaactcggtgctgtcttgttagagcagaaaggaaaccccaaactcagctggtgtccacccacagagagaacatttaaactagccctagccagagggggacttgagtgcctgcaaacctcgccacccagggctacagctgtctgtctccaagtaaacttgaaaggcagtctaggccataaggactacaactcttaggcatatcctagtgctgaagtaggcccaggacagtggactggtggggcatgtgacatactgagacactggataggtagtcaaggaagtgctggcctcacccctctcctaacctcaggctgcacagtttgcagctccaaaagagacaccttcttccacttgaagagaagagagggaagaacaaggagaactttgtcctgcatctacggtacaagctcagccacaacaggatggggcaccagatagacttgcaaggctgcaaggcccctgttccaggccctagttcccagagaacatttctagacacaccctggaccagaagagaatggcttcaggtaacagcccagccacagtgggtagaaaatcaagcaagctctcgaggtccctgattctaggattttactcttgaacagcatttccggacctgtcctgggccagaggggtgtccactaccctgaagggtgagtcccaggccaggcagcattcatgacaagctgacttaagagctgttgggcattaagggaacatcagtggtagtctggcagtactcttcatggcccaggatggcagtggctatagggtaaggctcctctgcctttggaaaggggagggaagagtgggaaggacagcatcttgtggtttgtttaacagctcagccacaatacaatagaacaccaggtagacttctaaggtttttcactctagtctctgactcctagacaatggcacttctgtacccactggtgggctgggggaccttccctccctgaagggaaggacacaggcctggctggctttgccatctggtgatagtagagccccagggtcttcagcaaacataggcagtagccagggggtggttataggaggccttggtcaagtaccagtgctctgctggcttcaggtctaacccggcacggtcttagtggtggtggccacaggggtgtttgtgttactccatccctagctttaggtggcttggaacaaagacagaggctgtttgggagaaagtaagaagaaaggaacaagagtctctgccttgtaatctagagaattctcccagattttgtccaaggccatcaaagcagtactctgtgagtctgcaagaatcatagcattactgggtttggggtgctccctgaagtacatcacaacactcacgtccttgtagatcacaacacccaagtcctttcaaatatctggaaagccttcccaaagatggctataaataagcccagacagtgaagactatagtaaatatccactcttcaatgcccagacaccaaagatcatctactaggatcaacactattcaggaaaacatgacttcatcaaatgaactgaataatgcaccagggatcaatcctagagaaacagagataggttgaagaaactcaaaaacattcaagataacacagagaaggaattcagaataatatcagataaatttaagaaaaagattgaaataactaagaagaatcaagcagaaattctggaactaaaaaatgcaattggcagactaaagaatccatcagagtactttaatagcagaatttgtcggggaatttgccctgatattcacgtaggttcttttctatttttccgaagtgtcagccagtttgagaaataaagggacagagtacaaaagagagaaattgtaaagctgggcatccgggggagacatcacatgtcggtaggttctgtgatgccccacaagccacaaaaaccagcaagtattttttaaggattttcaaaaggggagggagtgtgcgaataggtatgggtgacagacatcaagtacttaacagggtaatagaatgtcccaaggcaagtggaggcagggcgagagcacaggaccacaggaccgaggtgaaattaaaattgctaatgaagtttcaggcaccattgtcattgatagcatcttatcaggagacagggttttgagatcaaccggtctgaccaaaatttattaggtgggaatttcatcttcctaataagcctgggagcgctatgggagactggagcttatttcatctctgcagtttcgaccataagagacaggcacaccttgcgggggctgtttataagcctaaaactccaggcgtgtattctctttctcagggatgttccatgctgagaaaaagaattcagcgatatttctcccatttgcttttgaaagaagagaaatatggctctgttctgcccggctcaccagcggtcagaatttaaggttatctctcttttttcctaaacattgctgttatcttgttcttttttcaaggtgcccagatttcatattgctcaaacacacatgctctacaatttgtgcagttaatgcaattattacatggtcctgaggtgacatacgtcctcctcagctgacaggatcaggggattaaagtaaagacaggcataggaaatcacaagggtattgattggggaagtgataagtgtccatgaaatctttgcaatttatttttagagattgcagtaaagacaggcataagaaattataaaagtattaatttggggaactaataaatgtccataaaatcttcacaatccacattcttctgccatggcttcagccggtccctccttttggggtccctgacttcccgcaacaagaattgatcaagcagaagaaagatttagggagcttgaagacaggctatttgaaaatacagccaaaggagaccaaagaaaaaagaaaaaccaatgaaacatgcctacaggatctagaaaatagcttcaaaagggcaactctaagagttgttgttcttaaagaggaggtagagaagggaatacaggtagaaagcttattcaaagggacaataacagagcccaaacctagataaagataacaacatccatgtacaagaaggtaatagaacactaagcagatttaacccaaagaagactacctcaaggaatttaataatcaaactcccaaaggtcaaggataaagaacaaatcctaaaagactggtggctttgcatggtggctcacatctctaatcccagcactttgggaggccaaggcaggcatatcacttgaggtcaggagttcgagatcagcctggccaatatggtgaaaccctgtgtctactaaaaaaaaaaaaaaattagccaggcgttgtggtgggcacctgtaatcccaggtacttgggaggctaaggcaagaagaatcacttaaaccgaggaagtggaggttgcagtgagccaagatcatgccactgctctccagcctgggtgacagagtaagactctatctcaaaacaaaacaaacacacacacacacacacacaaagcaagagaaaagaaacaaataacatatgacggagctccaatacatctggcagcagacttttcaatggaaaccttgcaggccaggagagagtggcatgacatatttagagtgctgaaggaaaaaaactttaaacctagaataatatattcagtgaaaatatccttcaaacatgaaggagaaataaagacttttctacacaaagaaaagctgagggatttcagcaataccagccctgtcctacaagacaagatgaaatgctaaagagactatttcaatcagaaaggaaagaacattaatgaacaataaataatcacctgaaaatacaaaactcactggtaacaataagtacagacacaaaaaaaaatgttgtaaaactgtaactgtggtatatgaactactcttaccctaagtagttgaagactaaacaatgaaccaatcaaaaataataactataacaacttttcaagacatagtaagtacaataagatataaatagaaacagcaaaaagttaataagtggggaaacaatgttaagtcatagagctttcattagttttctttttgtttgtttatgcaaatagtattaagttgttatcaggttaaacataatgggttataaaatagtattagcaagcctcatagtaacctcaagccaaaaagcatacaatgtatacacaaaagataaacagcaagaaatcatatcaccagagaaaatcaccttcaccagaatacaaataacacaagggcaggagtaagtctttacttatcaaaattaacattgtatgtaatagactaaactttccaatagaaaaacatagagtggccgaatggatgaaaaaacaagacgcattgatctgttgcctacaataaacacaactcagctacaaagacacacatagcctaaaaataaagagatggaaaaagatattctgtgacaatgaaaaccaagaaagaacaggagttgctgtactcatatcaggcaaaggatatttcaagacaaaacctagaagaaacaaaggtcagcatataatgataaaggggtcaattcagcaagaggacataacagttttaaatatatatgcacccaacagtggagcacccagattcataaaggaaatattattaccactaaagagagagatagaccccaaggcaataatagctggagacttttacaccccactttcagcagaaagacagatcttccagataaaaatcaacaaagaaacatcagattaatagacatttacagaccattccatccacgagctgcagatacacattcatttcctcagcacacggatcattctcaaagatagatcctatgttaggtcataaaacaaatattaaaacattcaaaaaattgaaataatatcaagcatcttctctgaccacaatggaataaaactagaaatcaataagaagaattttgaaaactatacaaatacatggaaattagaccatgtgctcctgaatgatgagcaggtcaatgaagaaattaagaagaaaattgaaaagtttcttgaaacaaatgataaaggaaatatgacataccaaaacccatgggacacagcaaaagcagtactaagagggaagtttatttatgttggtgcaaatgtaattgtggtttttgccattaaaagtaattaaaagtaatggcaaaaccacaattatgtttgcaccaacctaataactataagtgcttaaatcataaaacaggaaaacttcaaataagcaatctaaggatgcctcttaaagaactggaaaagcaaaagcaagccaaatccaaaattaggagaagaaaattagtagaagaaaagaaataataaagatcagagtagagataaataaaattgaaatgaaaaaaatacaaaagaccaatgaaataaaaagtaggttttttgaaaagattaacaaaatcgacaaacctttaaccaaactaagaaaaaaagagaaagaaatccaaataaataaaatcagaaatgaaaaaagagacattaaaactgatactacagaaattcaaaggcccattagtggctactatgagcaaccagatgccaatgaattggaaaatatagacaaaatgaacaaattgccagatacatacaacctaccaagactgaaccaggcagcaatccaaaacctgaacagaccaataacaagtaacaagattgaagccataataaaaagtctcccagtaaagaaaagactgagacgtgatggctacactactgaattctatcaaacttttaaataagaactaatgccaatcctactcaaactattctataaaatagaagaggagagaagacttccaacctcattctacaaggccaatattaccctgataccaaaagtagacaaagacacatttaaataaataaataaataagtaagtataagccaatatctgatgaatatcgatgaaaaaattctcaataaattccacgaccaagtggaatttattccagggttgcaaggatggttcaacatgtgcaaatcagccagtgtgatgcatcatatcaacagaatgaaggaaaaaaaccacatgatcatttcaattcatgttgagaaagcatctgataacattcaaaatccctttatgataaaaaccctcaaacaactggggatagaaggaacatgtctcatcataataatagctatatatgacagacccacagcaagcatcaaaatgaataaggaaaaactgaaagcctctcctctaaggtctggaacatgacaaaggtaccctctgtcaacagtgttattcaagttatactggaagtcctagatagaccaatcaaactagagaaagatgtaaaggacattcaaataggaaaggaggaagtcaaattatccttgtttacagatgatattatatttggaaaaacctaaagactccacaagaaaactattagaaatgatcaacaaattcagtgaagtttcaggatataaaatcaacatacaaaaatcagtagcatttctatatgccaacagtgaacaatgtgaaaaacaaatttaaaaagtaatcccatttacaataaccacacataaaattaaatacctgggaattaatttaaccaaagaagtgaaaaatctctataatgaaaatgataaaacaccaattgaagaaattgaagaggacaccaaaaaaatgaagaaatattccatatgcatggatttgaagaatcaatattgttaaaaggcccatactacccaaagaattacagattcaatgcaatccctgtcaaaatatcaatggcattcttcgcagaaatagaaaaaacaatcctaaaatttatatggaaccacaaaatacccaggttagccaaagctctcctgagcaaaaggaacaaaattggaggaatcacattacctgacttcaaattatgctacagagctatagtaaccaaaacagcatggtactggcataaaaacagacacagagaccaatggaacaaaatagagaacctagaaaaaaatccacacatctacagtgaactcgtttttgacaaaggtgccaagaacatacactgaggaaaagacagtctcttcaataaatagcactgggaaaactggatatttaaatacagaagaatgaaatttgacccctatctctcaccgtatacaaaaatcaaactgaaatggattaaagacttaaattgaagacctcaaactacgaaactactgcaagaagacagtggggaaaatcttcaggacattgggttgtgtaaaaatttcttgagccatactccacaagaacaggcagccaaagcaaacatgggcaaaagggatcacatcaagttaaaaagctcctgcacatcaaaggaaatcagcagagtgaagagacaacccacagaatgggaataaatatttgtgaactccccatttgacaagggattagtacccagaatatagaaggacctcaaacaactctataggagaaaaaaaaatctaataattcaatcaaaatatggaccaaagatgtgaatagacatttttctttattttttatttttttacttttttttaaaattatacttcaagttctagggtacatgtgcacaatgtgcaggtttgttacatatgtatacatgtgccatgttggtgtgctgcacccattaactcatcatttacattaggtatatctcttaatgctaaccctcccgactccccccacaccacgacaggccccagtgtgtgatgttccccttcctatgtccaagtgttctcattgttcaattcccacctatgagtgagaacaagcggtgtttggttttctgtccttgcgatagtttgctcagaatgatagtttccagcttcattcatgtccctacaaaggacatgaagtcatcattttttatggctgcatagtattccatggtgtatatgtgccacattttcttaatccagtctatcattgatggacatttgggttggttccaagtctttgctattgtgaatagtgccacaataaacatacgtgtgcatgtgtctttgtagcagtatgatttataatcctttgggtatatacccagtaatgggatggctgggtcaaatggtatttctagttctagatccttgaagaatcgccacactgtcttccacaatgattgaactggtttacagtcccatcaacagtgtaaaagtgttcctatttctccacatcctctccagcacctgttgtttcctgactttttaatgattgccattctaactggtgtgagatggtatatcattgtggttttgatttgcatttctctgatggccagtgatgatgagcattttttcatgtgtctgttggctgcataaatgtgaatagacatttttcaaaagaagacatacaaatagcaaacaggcatatgaaaaggtgctcaacataattaatcatcagagaaatggaaatcaaaactacaatgagatataatatcatcccagtcataatagcttacgtccaaaagacaggcaataagaaatgctggtgaggatatggagaaataggaatccttatacactgtttctaggaatgtaaattagtacaaccactgtggagaacaatttggaagttcctcaaaaaactaaaacttgagctactgtgtgattcagcaatcccactgctgggtatataccaaaaagaaagaaaagcaatacatcaaagagatctctgcactcctatgttggttgcagtactgtttataatagctaagatttggaagcaacttaagtgttcatcagcaagtaatggataaagaaaatgtggtacatataaacaatggaatactattcagtcataaaaaagaatggaatccagtcatttgcaacaatatggatggaagtggagatcatttgtgaagtgaaataagctaggcactgaaagacaaacatcacatgttctcacttatttgtagaatctaaaaatcaaaataattgatctcatggagatagggagtagaaggatggttaccagaggctgggaagtgtagtgggagggttgggggaggtggggatggttaatgggtaccaaaaacattagttagaaagaatgaataaggctgggtgtagtggctcacacctataatcccagcacttttggaggccaaggcgggcagatcacttgaggccaggagttcaagagcagcctggccatcatggcaaaaccctgtctctactaaaaatacaaaaattagccagggtggtggtgcacagctgtaatcccaggtactcaggaggctgaggcatgagaatcacttgaacccaggaggtggaggttgcagtgaactgagattgcatcactcactgtattccagcctggtgacagagggagactctgtctcaaaaaaaaataaaagaaaaagaaaaagagaaagtaccctaaaacttaaaatataataataataaaataaaaaataaaaataaaaaaagaaaaagagaaaagaaaaagaataagacctactatttgatagcacaacagagtgactcttaagtcaataataacaaacaattgtatattttaaagtaacttaaaaagtataattagattgtagctcaaaggataactacttgatgggatggatacaaaaagtttataggaataaataaagcaaattttgaactaacaaaaaaagataggaaaagctagaataaaaaagagaagcatcaaagatcaagctccatagacatgccctactcagattttcacaggtaggtgatctgcctctgtcttttatatacaagatgattgataatgatgttaaccaattacaactttgcctttcttatttggtacactgagaggcagggttcctctcttcttttataagcttataataaagtagaaaacagaaaaataagtgagggcaaaacataaaagctagtgaatatctcatctttttcatttctttatcacaacatatgtagattatctcttggtaatggaaatacataagccttgctaaatgactatcctagtaatagttgaccaaatccttagatccatgaatgaaggaagcagttatgtaggagacccgggcctgcctcacattttgtccagggatttcctggtactctacagtgggggtaaaaaaacgggggggactggttttgattgactttttattgataatcctgagatatctgaaagaattccttaaattatctaatgaattagccagataacaattacaaaccagcaatttatagtaactagtaatgggagaaacaattcaaaataaaaccacacatggtaaaaatttgttgaaataaaaaccaacccaagattcatatcttcatatcttcttaataactataaaaaccaaaaacactgagagagtagatttagctggaataataaacacaaaataatgaagcaatggctaagcctgcacatgatcaaaatatattattgactacagttaacaaattctattttcattcatctgagaatgtctttatttcccactgatttctgaagcaatatattttcatcagatagaattgacagttcttttctttcagtacttgaaaatgttttgttattaatacttccttttcgcctccagatgagaaatctgctctcactcaaattggtgtacccctctataagttatgtgctgtttccctctggatgctttcagtactttatttgtctttactattcaaaagtttaattgaaatgtcttggcatggatttctcctatttggggttcactccatctcctattgtgtccggaattggtgagttcttggtcttactgacttaaagaatgaagccgcggaccctcgcagtgagtgttacagctcttaaggtggcgcgtctggagtttgttccttctgatgttcggatgtgttcggagtttcttccttctggtgggttcatagtctcgctggctcagaagtgaagctgcagaccttcgcggtgagtgttacagctcttaaggcggcgcatctggagttgttccttcctcccggtgggctcctggtctcgctggcttcaggagagaagctgcagaccttcgcggtgagtgttacagctcataaaagcagtgtggacccaaagagtgagcagtagcaagatttattgcaaaaagcgaaagaacaaagtttccacagtgtggaaggggacctgagcgggttgccactgctggcttgggcagcctgcttttattctcttatctggccccacccacattctgctgattggtagagccgagtggtctgttttgacagggcactgattggtgcgtttacaatccctgagctagatacaaaggttctccacgtccccatcagattagttagatacagagtatccacacaaaagttctccaaggccccaccagagcagctagatacagagtgtcaattggtgcactcacaaaccctgagctagacacagagtgctgattggtgtgtttacaaaccttgagctagatacagaatgccaattgatgtatttacaatccctgagctagacataaaggttctccaaggccccaccagagcagctagatacggagtgtcgattggtgcactcacaaaccctgagctagacacagggtgctgattggtgtgtttacaaaccttgagctagatacagaatgccgattggtgtatttacaatccctgagctagacataaaggttctccaaggtcccaccagactcaggagcccagctggcttcacccagtggatctcccaccagggatgcaggtggagctgccagccagtcccgcgccatgcgcttgcactcttcggcccttgggtggtcgatgggactgtgtgctggggagcaggaggtggcgctcatcggggaggctggggctgcacaggagcccacggaggcaggggaaggctcaggcatggcgtgctgcagtcccgaggcctgccccgcgggaaggcagctaaggcccggcgagaaatcgagcgcagcgccggtgggctggcactgctgggggacccagtacaccctccgcagccgctggcccgggtgctaagtccctcattgccccgggccggcagggccggccggctgctccgagtgcgggacccgccaagcccacgcccacccgaaactccagctggcccgcaagtgccacatgcagccccggttcccgctcgtgcctctccctccacacctccctgcaagctgagggagtgggctccggccttggctagcccagaaaggggctcccacagtgcagcggtgggctgaagggctcctcaagtgccgccaaagtgggagcccaggcagaggaggcgcccagagcgagcaagggctgtgaggactgccagcaggctgtcacctctcattatatctataggtttatatcttttgccaaatttaggacatattaacaaattatttcttcaaataccttttcagtctcactctttctcctgtacttctgaaactccaataatgcaaatgctagctcttttgttattgtcccacaggttcctcagtctgttcaattttttgttctagtctattttctctattgttcaggttgggtaaattgttattatcattattattattgtagagacagggtctctgtgtgttgctcatgctggtataaaacttctgggctcaagggattctcctgcctgagcctcccaaagtgctgggattacagacataagccaccacacccagtcaggttggataaattctattgatgtgtcctgaagttcatcaattctatctttagtcatcttgactctactattgaacccatccagcaaattttttatttcattgctttatgttttagttctataatttctatttggttcttttttaacttatttatttgctgagatattttattttttatttgtgtcaagagaatttgtaattgctggttaaaacatttttataataactactttaaaatccatattagatcgttccaacatctgattcatcttgattttagcatctgttgattttcttttctcattcaaattgtgatcttcctggttcttggtatgaggaatgatgttcaattatattctggatattttggatattatagtataagactctggattctatttaatcttttttaatcaggtaggcctcctgttggggtgtagcaagaaggcaggtgattttgtatgtttggtctcccagtgggcccaccaacaccttccagacaaacatgcagtacttattcatcctgtccagatgtctatgggggggcggggtggggggcgggggggagggtattcattttctagtgctgccataacaaaatgcgacagattggatggcttaaaaaacagaaatttgaccaggcgcggtggctcacacctgtaatcccagcactttgggaggctgaggtgggcggatcacaagttcaggagtttgagaccagcctggccaacatagtgaaaccccgtctctactaaaaatataaaacttagcctggcatgatggtgtatgcttgtagtaccagctactcgggaggctgcggcaggagaattgcttgaacccgggaggcagaggttgtggtgagccaatattgcgccactgcactccagcctgggcaacagagtgagatccgtctcaaaaacaaacaaacaaacaaaccaaaaacagaaatttattttctcacagttatggaggctggaagtccaagatcaaggtgttgacagggttggcttcctctgaggcctctctccttggcttacagatggccacccactcaccgtatcctcacatagttgcccctctgggtacacatgccactggtgtctctatgtgtgtccttatctcctcttcttattaggaccccagtcagattggattaagggccaccctaataacctcattttaatttaatatttcttttaggaactatctgtaaatacattcacattctgaggtactggggattagagcttcaacatatgactttaggatgggaaacacaattcagcccacaacatgtgagttggaagttcagctaccccttgccctgttgacaccttcccagtcaaagtgagatattcgctcacacctctaagttcaggtgccactagaaaggtggaagcagatgattgattcacaccattttattacagcaggattggggtagaaattaggttctcaactctctgctgggcctccctgatgccagaggaggagagggagacaagcaaagtgccaactatccctgcctctaccgctttgttctgtctcattgatgccaggtggaagtgaagactcagcaacccactgggccctgcctacatggaggtgtgggggtaagtggagtactgaccagacttgagtcacacgacccagttcagttgttgatgctggatgggagtggagtctcagcttcctattggttaccactgacactagactgaagcataactgtgatgagccctgcatcccaccgtctctttgagtctcactgtgggtgcaagctcagctcattgctgcaccctgccaacacaaggtgagggatagaaaaccagatccctgctcagccaggcaaagccaccctgagtgggatcacagtgctgctgcctgcctccagtgagtggagtaaaaaatcagcctcctgtcctattctactcaaactttgagaaagggagggtgcagttgttacactggtatttgccctgagtagggcaggtatcgccaaaaagttctggctacggggaacgaacaggctcatcttggggctttttgtgtatgtttgttagtggctccaagttgaaagcttctgcaggaccctgtctggaatatatgagaggcaataaggaaatccagggaactcagtgccatgtcattccttgggtccccaggttcctaagtagttcaccttcttcttttcagtgttagagtcttcctgtgcttgtttgttgagttatggccagggtttttttagttgtaagaaagagggtctgggaggaatgaggctacttccatttgcccagaaccagaagtcctccttataaacactttaatagaagaaatgcaaagaagatagggatttttatggaatattccaacataaaatcagcaactgatctaaaacctgaattatcaaaaggaatatcaatttctaaaaccagggcaagctgacaaaataaagctgagctatataaaggtatgtgtgctgtaatactcaacttcaagatgcttttggatgagctcaattcaactaacatcaaaacaaaaggaaataaatttttctacattcggaatatttgtcacaaaacaaagaccaacactatcagatagggcaattcatgttttgtgtgttttaaatttttattttaagaataacttttaaatatttgtaacagctttcaattttttaattgattttatttggtgttagtgatacttttttagttttttctatcatcaggtatagatcatttttacatgttattaaaatacataatctcatcaaatgcagttaatattgtatttttatttttatagaaaacctctgaaacttttagcataattctatcatcaaaaatgacacaccactattattgtggtcacttatcaaaatttgaaaacacaggctcagcacagtgggtcacgtctgtcatcccagcactttgggagacagaggtggctggatcacttgacgtcagaagttcgagaccagcctggccaacatggtgaaaccccgtgtctactaaaaatacaaaaattagccaggcgcgttggtgcgtgtctgtaatcccagctactcaggaggctgaggctggagaatcacttgaacctgggaggtggaggttgcagtgaggcaagatcgtgccactgcactccagcctgggcaacagagcaagactctgtctttaaaaaaaataataaaaacatgtaaatatcacaaaaaaaaataggatgaattctgttttgagaattcccaggaatttgtattttttttaacctgaatcctgaagatatttgtcagggatttagaaacactataaaaggcaaatactgtcccaattaccttattaacaaagactttttctttttcaatgatcaagacttaatcaaaattgtttttatctcttcagtttatatgtccagacttacttggttattacaggcacagtgatgcagtgaaatcatgacctatacctaaacagcctgaaaatattcagcctataaaagaaaagacttaggtgagaatttaatagctgtcctcataaacttcgagagctctcctgaacaagagggattgcatttgttctgtatgacccaagaggaaagaattaggataaatgagatgaagttacaggaaagaaaattttgacttactatatatatccactttctagcaactagagaattctgaaatgagagcagactccctcaagcaatagtgatttcttgtcaaggtaaaaggctggacgaccatttatcggggatattatcaaaaagactcagtgtttgtgattttttttttttggtgtgtatcatctcattttgttctccaagtgacacacatagaaaatgtatttaaatggctatgtatgaatgaaaatagtaaagttcagagggtatattagttaggattctttgtaaattataaagcaatttgagctagcctgagcaaaaacaaaatacagtataagaataaatggtatttcacagaacctaaggccagtgtaatgcagctgtctctagggtcggactgaggccaaagctctctctctctctgtatcttcaccctgtttctctctaacaactgctttgttctctatttctgcagatgtattttctatgcttcccaaccacataatgggtaggagatatttatgccacagatccccaatttacatctctatcattcaagggaccagtccagaatgattgggtgcctaaattattctggactttatgcagccaattaatcacattattctcccttctgaatgctaagccaattaagaaatagccacagtaaaactggatgggataatgtggcttaaacttgaggccaaaatgtacttttctgcaactttcctttgcctttgaattgaattcagccagtccaggcagatatccagattgcatctcaggagatggcctgatctggcggcctgacctgacgagcttatcagatgggaaagacgtccaggaggtgagcacattgcacttgcacatatgcaaaaggagaataaaggatctggtcagacatgtgcaatgaccctttactgaaacctactaattaagtaagtcactccaccaactccctcagggttgagttgctgaaaaacggagataagggcagaaactttcctcataacattttcaaagatattttatacgatggactaaggtaggaatgtgcagatgggaagagaatagccttcccgcaattaccaattcttatttctggagatagggaagttaactcacccactttgaaccagttattcatctacgtccaatcaattatggttttaggagagtctctcgatgcataaacagcatggccaggggacaaccattacagataggacaggcgatttttggtaaaagatggctagacagatacatgaataagtacactcagaatgcatacacttcttcgtttacattataaagttattcttgactcataatatccagctacctcacgttcaaatgcaaatacacacaagtacacacacactcattcacacatgctctgcagtggaggactacccaagtaatgagtggataatccattacattaggaagtgatgttgccttgaggtcactgctcttcctgtgtaaaatttctggatgaggtccatttcctccccgaatccagttttaattttgttctcattttcttaaaatttagagattaaattacaaacgtaaccactctcaatatatctaatatacaacacttggggaaatggccatatagagaaatagcgacggaaagaaagctccacatagtggtcactggtctgtgatttattctgctggacagtggcagtttgaaaagcttgaaagaacaggtgacttatttgggcataattttgactcactcctttggcgtgtttcttgaccctatagtgaactttcagtttgtgttatttcttctttggattgtgtctgaaaatttcctaagaattgactcttctggtatgagtcaactatgggtccctttcaccagatttagtatttttcactgacattttcattcttgtaaaacatttctggttggctctcacatccattttggactccatttgctaaaatccagcaccacaaatcttgttaggtcatgctccaaattgaatagccaggacttgttcactctactcaggcgtatgttctgttttgttcgtttttgaagtaagtctgaaggtttcaccatccatatggtctttaatacatgaattaaaaactataaaattagctgggcgtggtagcaggggcctgtaatcccagccactcaggaggctgaggcaggagaatcctttgaacctgggaggcagaggttgcagtgagccaagatcacaccattgcactccagcctgggtgacaaggaaagattctgtctcaaaaaaaacaaacaaacaaacaaaaactatagcctggccgggtgcagtggatcatgcctgtaatcccagtactttaggaggccaaggtgggaggatcacttgagcccaggagttcaagaccatctgggcaacatagcaagaccccatctctaaaacaacaacaacaaaaaaaactatggcctgatacgaggtagctagcataacagaactccttcctttcttatcagctatggaaatattgtccctattctcctattttagctagtgagaaggactttggaaggatgggggtgggaggtagaagtatggtcagtctttctccactcttctgcttcttccaggatattcccattcctgtttccaggatcttgcgttttcttggtccagacatttatttatcctaactacaaaaaggagagtcaactcagaacttgactactgcaattcacatttccttgatttatttcttcatcagtacctcagcaattgattgattaattgattgagacagtcttgctgtgctcactggagtacagtggcatgatctttgctcactgcaacctccacctcccaggttcaagcaattctcccttccccagcctctcgagtagctggaattacaggtgcctgccaccatgcccagctaatttttgtatttttaagagagacaggctttcgccatgttggccagtttggtcttgaactcctgacctcaagtgatccgcccgccttggcctcccaaagtgctgggattacaggcgtgagccactgcacccggccagcaatctatttagaagctcagattttctctctgtgcttccagtcaagcaaatctaagttggtttttttcttctgcaccttatactgacagctacaaaaaatagatatatactaatattttctaccaaggccccccatggcttggtggagaatgatctgagatgtaagagacaatgagcaggttttcctacttacttcaatattgcagaaagactgtaagtttctatcctaagattggggtggtaggtgggagtgtgaggctcctcccaatctgacacctgccttaacttcactcattttatattttctgattaagaatctgttactccgaaccctatcacaggtagcactttgtatattaaataagattctctgttgccttaagctgtatgcaacagaaactgtatcgagccagcctaagcaagaaaagaatttaagaattcagaagggcactcaggcctaagaaagagatagaaaagttaccagatctttcttcatctctcatatcttcttctctctgcatgtttgctttatttatttattttctctgaagttaggctttctctgtttctctttccacataccaggtaagatcatggtcactcagcagcttccaacttcatatgtcttttctttgagaaaccaagggtagtatgccaaaaccattgttggttttttttcagatatgtccagggagaaaatctggttgaccagtttgtccttatagtgaaccttcatcagtggtgtgtgttcaatatcaaaacatctttctaattataaagaatcttcagttaggtgagcagatatttcatctccccaccttttggttcctaaaacaaagacatgtgacccaagtcccaccaatatgatgtttttgcctggaactttatcaagtgatacacacaatttggaatttttctatggctgtggcaccaatggcagtggcttctggttctggtggcagtagtggcttccagcatctgatgatacagtggtgactgctcggcaaagacagcagtcatgtcctaaccaggttctttctgcagcataattttaaatgtcctgagttatggcctcccttaattattgctcatttctttccaagcccaatcttcagttcttctcattgattctgtgagcgttcctaaactcttctaataatgttttttttcctcaaatataccagaatgattttatgttgtttacaactaagaacttgcctatattctaatgagctaaaccagtgggtaggggccttgtagagcaaacctgattgtcagaggtctacccctgtgaacaggaagaacagttcccagagaagacagaatcagtggacatcccaataagtgtctttttgcattaatattggaaaagttgtccaagaccatagaagagctgaatatcagaactttaagaagaatctgcacatctcactactcaatataggatttattcctttgtcccaaggattaattttaattcttgaattaataatggatggggatacctaaggttattatagaaaggccaacataagcccttcacaatctcaataatttgctatttcaccaaactgaaaaacctatttcaaaaaagaaaaggctgaattcaattaaacaacctggttctttcaaaataactggttacctaattaaaccttactattgccttaaactttgtaaacatatcttaaacactactatgctaagatggggcagaggaatgaattactgataaaattcatagttaattgaaaatgatatcaaaaacattttaatacttttcaccacataataaaataaaaactgtgtgatttgagtttttatctccttttatgggcctgtttaatttctgtaaaggagctttgaaattaagcaaaatagaaagggaaatagtaatttggataatcagtcccaaataaacaagaattgctaattgcatttcttgtacacaactaggagtaaattcaaaaactgaaagtaaattggacatgatgctcagagagtatccttgagcatgagtaactaaaattaaccagaattttaaataaactggggactcctagacttctgaagacatgaatgaggctattagaactctctttctcctactcatccattagcaatgtcgggaacagttcataaaagattaatgtttaaatgcttaagaatatatatttgaataccttgaaaacaccaagcaatgctttttaaattaattgataagtcattttatacttgtgatgtagacttagacttttttgtagtaacaagccagaaaacatctatccttctgagagataatatgtgaaagaattgtagaagaaatgagaaagatgattagtaatcctgtattgcttcttgagacagcaattctctcgtaagtggaaacttaggcaagcatcagtgatgagaaatagatacattttactctttacttcatggttgagaagtgcctgtaattcacctttcaaataagaggcaacatgtatagcataatcccacagtattatgaaattttggaggtgaaagggaccttgatgtatcggtaagctattgctctataacaagccattcccaaaactcagtggtttaaaacatttattattgttcaagcatctacagattagctaagggtaggctgagctcatctggggtgattctgctccatgtgtttctcattctccataaaccacaaacaaaataataataataataataatagtatttttttaagttctcacttgttgaaggcttactatgtgctaaaagcactttaaaatgttatctcctttacttctcacaaaaacattatgaggtaggtactactaatatcctaatttcacagatgaggaaacaaagaaggaatttccccaagctcaagaagctactgtatggtgaacctggagcacacagatgaaggtctacctgacactaaactttatgttcttaatcattctgttatattctgtttcatgaaatttactattccattttcagagagttctaaccactaagaagttattcttatattcagtgaaatgattttctctataacttttaatcactgatcttaatttggcccttgagtacatacaggataaagataataatcataaattaaatgatatagtaaaagtgcctgacaaacagaatgtgttccacaaaaattaatctaagtcagccccacaataggcataacagtcgttaataaaatgttcaaccgggcagggccagaattatttgcagttttacccagttggcacttatcctattatacagaaaactatccaacctaggataaatacaatgtttaagtccagatatactgtgtctataacatttcctttatctatcagcctagtaatcttgtcaaaaaggaaatgagccctagattgaataagcaacagacaattagaatttagagggtagagaggaggtaagggaacattaaataatgctttttaaaattaatcagcatatattttattaataagcaagcaggcaaaacctagtaaatgttgactttctttctatttggaaaaaatttaatttgttcaaaggtaaacttttgtttatattataggtttacctaagctgatgagagaactgagtacataatacctattgaggataataaacttgttaaaagatgattttcaaaatgacaaaatacaaatattaaaagagcatatgtgaaaatttttatttaactcattaattaatgaaggaccctgtaagatattacaagctattcaaaaaagaatagaaacagtcatatgtaggcaagcaggaatgttgaagtaaatgtgctaatatgtgcaaattaatagatcctataggtactaaattgtaatgtttggaatcatcttttctacagagaggaaatcaattatatctctatgataaaattcattagcatgtctatggaaaagaataatttgcattttactgtcagtcaattttttacaacttcctgagttgtaaaatagctcagtcaagggcagtccaaagcacaggttccaacagaatcagataaccttaccttggagagtaagccagacagtgtcagacgttccagaacacccagaattgtgcccattcaaaattcttcactagtcttcctgacaaagtttctagaagaacatcaaggagaaaaactgggggaagtgctgattacatgaaaatgtacactggttgaaacgttttacaattttttaaaaacatattatttgagactctttgagaaaaaagataatcccggaaaatcatgaaattatttttttttaatttttttgtcacatccttcaaataaactgttaatcatgatatacaaggtcagatggaaattgaaaaaaggaaaaattaacgttttttaatataccctcccatttgtctgccaaaattgtatttaaaagtagtgttatataattaatgatattttatattttcagatgattgctaacaagccaaagaaaaaaatttccctgatcgtatttggaattaaaaaaatcattgattgaatgaactagtaatattttatttagcatttccttgtatttagagtggtaagaatttctatgtcagctctgtcctctgcattgacaaatcagaaggtcctgaatcctctttactctgttatgagatcataaaaaagaaattaaaagtcaattgctctccactgaaaatcctagaattgagaatcaaggaataatcttctcttccaaccaaagtccctgtgtgactaaagatcagtgtaattttaaaatgtggcaacttgtatattaaaatgtcatatagaatttttaaaaatcttttattgagattcaaaaatagacaaagaaaatataataatggctaataagcacatagaaagatgttcaacatcactggttattagggaaatgcaaatcaaaatcacaataagacactactttacatccatcaaaatggctattgtttcttaaaaattgaacacactaggcattagtgagtgtcttacttcgttttgtgctgctgtaataaaataccacagactggataatttataaagaacagaaatttattctctcacagttctggaggctgagcagttcatgatcaagggactggcaagttaagaactggtctctctgcttccaagatagtgcctggaatgctgagttctctggagagaagaaacgtggtttcctcaactgacaaacaggcaggagagagagagaacctactcctgcaggcctgttttatagcagcattaatccattcataagggtggagcctcatgacttaaacacctcccatcatgccctatctcccaacactgttgccttggagattaagtttcaacatgagttttggagtggacgaaaacatttaaaccatagcaataaggatgtagaaaaattagaaccatcccatattgctggtaagaatgtaaaatggtgcagccactatggaaaatagtatggcagctcctcaaaaagttaaacatagaattaccacatgatctagcattctatttctaggtatatacctaaaataattaaaagtaggggctcaaacagatgcttgtacagcaatgttcacagcagcattattcacttgtagaatttaagacactctaccccaaaatacttatttaagctgaaagaatttgagaaaacagcagaatcaggaaggtcaccctcactttactccacccttcttttctgaagcaggtcataaaacttaggcaggattttctgaccttcccttgaagcaggtcatagcaccctcatgtgagaggtgccctctctaatacctggataaagcagccaaagacagagacacgaataatctgaacaggcaggccttgctaagtttccccaaattcattactggtagattacacccactatgtccaagtctacttctccacgtctatacatttattcatcaaacttggcataaaagtacacatgtttaatctgcttctttgggtcttcattgccttatgcaggctcccatgtcacataaaacttatattgaataaattcatatgcttttctcttgttgatctgcatttcagccatgaacctgggataagtgaggaaatacttctcttcccctatatcgcagtaggcaacaggtagaaacaacccaaatgtccatcaacaaatgaatggataaactaaatgtggcatatacatataatgaaatattattcagccttaaaaaggaatgaaattttgttacatgctacaacatggatgaaccttgaaaacattgtgttaagtgaaataagccagactcaaagggacaaatattgtgtaatttcacttatatgaagtacctaaaatagtcaaattcatagagacagaaagtagaatagaagttttcagggactgagaggaatagggatagggagttattgattaatggtcatagtgtttctgtctgggatgatgaaagagttttggaaatggagagtggtaatggttgcacaacaatgtaaatgtacataatgccactgaactgtacacttaaaaaaggttaaaatgataaattttatgttatgtatatgttatcgcaatgaggaaaaaaatcactagttggaagtcaagaatgttttaaagctttttcagagctccaagtgttacaggaaagggatcccgatccagatgccaagagagggttcttggatctcaggcaagaaataattcagggcgagtccatagagtaaagtgaaagcaagttttattaagaaagtagaggaataaaagaatggctactccatagacagagcagccccatggctgctggttgcccatttttatgattatttcttgatggtatgctaaacaaagagtggattattcatgcctcccttttttagaccatacagggtaactttcagatgttgccatggtatttgtaaattgtcatggtgctggtgggagtatagcagtgaggacaaccagaggtcactctcattgccatcttggttttggtgggtttttgtgggttttggtgggcttctttactgcaacctgttttatcagcaaggtttttatgacctcaatcctgtgccatcctcctatcttatcctgcgacttagaatgccgtagccatctgggaatgcagtgatgttgcgggaagtcagggaccccgaacagagggaccggctgaagccatggcagaagaacatggattgtgaagatttcatggacatttattagttccccaaattaatacttttataatttcttttgcctgtctttactgcagtcgctgaacataaattgtgaagatttcatggacacttatcacttccccagtcaataccctgtgatttcctatgcttgtctttacttcaatcacttaatcctgtcagctgaggcggatgtatgtagcctcaggaccctgtgataattgcgttaactgcacaaattgtagagcatgtgtgtttgaacaatatgaaatctgggcaccttgaaaaaagaacagggtaacagcaatgttcagagaataagagagataaccttaaattctcaccaccggtgagccaggcggaacagagccatatttctcttctttcaaaagcaaatgggagaaatatcgctgaattctttttctcagcaaggagcatccctgagaaagagaatgcgcccctgagggtgggcctctaaaatggcccccttgggtgtggccatcttctgtggtcgagctgtagggatgaaataagtcccagtctcccatagcgctcccaggcttattaggacgaggaaattcccacctaataaattttggtcagactggttgctctcaaaccatgtctcctgataagatgttatcaatgacaatggtgcccgaaacttcattagcaattttaatttcgccccagtcctgtggtcctgtgatctcgccctgcctccatttgccttgtgatattctattaccttgtgaagcatgtgatctctgtgacccacaccctattcatacactccctcccctttgaaaatcactaataaaacttgctggttttacagctcagggggcatcatggaacctaccgacatgtgatgtctcccctggatgcccagctttaaaatttctctcttttgtactctgtccctttatttctcaaaccggccgacacttagggaaaatagaaaagaacctacgtgaaatattgggggtgaattttgcccaatatctggctgaattttctgcgatacagcacagtatgtttcagccttattttacccagctcctattcaagatggagtttctctggttcacatgcctctgacacaagcactccaaactggtttccatttcaattttctctcattattttatttaattaataggcatttattaagagctttttttgctaaacactgtactaggcacagcaaaaaaattcaaaataataagatctttttttctctgaaatccatcatttagctcttcctaaactgggatttaaggaaagctgtttctttttttatggttttgtttctttttgttgggatgggttgttcataggtgtgctgaaaggaaaaacatttttcctctttgcaaataaatgagtgtttaattattaaacaaagttaaatggatttttttaactgtgaagacttcccataacctttaaaatgctaatgtattttttgaatctacaagactggatttagtaagtggcattcctaagcttatttaatcaagaattctttgtctctcagagcccaattaattaacatctccctttgtactgtggctgcagaagttgagctatgtggtggattctttttatactgggctaaatgtattatacaatctgtaattatggtataaatgtgtattttgttttatccctatgtgttctagaatgtgagtatgattttaaaagcatttttaaatttaaaaatgtagattaaacattagagacaataaagtcattataatttcttacctcaatttaccattttttttctcctttagatagcatttattattctggaaaaagggatattcttgttttggggagaaggatttgctaatggagattttgcagaaaactgtgatgctgactgtgatatgtaacttgtgagcatttttaataagaagaaacatagaatgccagtccttattcttttcttgataaaagaattcctaccgaattgtatccaatcaatagctttaaggacttgtgattttctctctgcctttgaataattgcaaatttttgatgctaattcttactccataagtttaaacgtccctatttttccgattactaaacttatactttaagtcacaacctacaataatatgcagacaatccctgacttacgatggtttgacttatgattttttgacattattatgatgtgaaagtgagatgcattcagtagaaatactgttgtatccatacaaccattctgtttttcacttttagtatacagtattcagtaaattatgtgagacattaaatcctgtattataaaacaggctttgtgttagatgattttgcccaactgtaaactaaagtaagtgttctgcacatgtttaaggtaggctgggctacattgtgatgtttggtaggttagatataataatgcatttttgccttacaatattttcaactgttgaagatttattgggacatatcccacattgtatgaacatctgtattcctgcatcctccatatattccttttttttttttttgagatggagtctcactctgttgcccaggctggagtgcagtggcatgatcttggctcactgcaacctccacctcccctgttcaaatgattctctttcctcagcctcccaagtagctggaattacagatgtgcaccatcacacctggctaatttttgtatttttagtagagacggggttttgccatgttggccaggctggtctcgaactcccaacctcaggtgatccactgacctcagcctcccaaggtgttgggattacaggtgtgagccaccgtacccagccctacatatattcttaattttgtgcttttccttcaaaattaaacacagtagaacaatttaagtaaagctaaagatatagcaaatttgagcctatttcatgattttaatattggtctcagttatattttcattagtagtatcattttcatgtgtctaaagtatcacgtaaaatgcattagaatatttaagtaattgcacaggcattacaaaggaataaaaatgataaaattgccaagatcaaccagctggtcatcaggcagaagcaccccgtgatactgtgaaatacttggttattggtgaaggatgaaagtctagattcagcataggaaagagaattgttatgtgtatatgtacactggatggaggtgctagttgtttgcaagtcaagcattctaaagcctaggactgcctgaactagagcaacaaataacaaagtatcagagttcaaggatttattctgaccggatgattttggaaaccttcctggacaacacattgggctgggttctgaagaataaataggattcccacaaatttttccagactgaggagagaggctaagatgtgcaaatagagggtctatctaggagtgtaattttggagtgcaaagtatagagtgcgtaagggatagtgaagtaaattaaactagaaaaaattattgaggccagatcattagtactaacaaatttagactttattctctaagtaactgagagctgaggaaagtttttgagcagagggcatggtttgtgtttcagaacaattactctggtgggcccatagggagcagatgagactggaatgaggcagggaagctaattaggatgttataattgtctagcaagaaaagatgaagacttgattgactgtcaaggaaacaataaataggagacattttgaaaaaattaactgagcttggtgaataaatcaattagaaatccctttggatgcaagaaacagaatttcttttgaacagagttgaacatacagagccttactttattcaagtagatgcagatagatgcagatagatcaagtagatgcagatgaatctactttattcaagtagattcaagtagatgctgctggtgttggtgcagaggcttgacaatatcagtgacatcatttctcagctctcttggtttttctttcatgttgttgaacaaccgtctcctccacggcctactttaggtgagtgattggctggagctgagtcacatggcagcctctagctacagtagaggctaggaaggtggggaatagtagtgtcttgatcacctgagactgatcatggtctgtaactatgggctgatcacactgtccttttgaaaaaacattattagcatggagtacatgggcattggatattaggtgaacaattaatagagtttgctacagtaactaattggctatcggagtgcagtgggttgaatagtgtccttccaaaattcctgtccacccagaacattagaacactacattatttaaaaatgtgtgttgcagatacaaataaagtaaggatcatggtgagatcatactggattagggtggaacataaatccaaaaagactgtcttataattaccaaagataaacaaagacagatactattaaagtgataaagacaggttttgttttgttttgttttttttgtctttttttttttgagacagagttttgttcttgttgcccaggctggagtgcaatggtgcgatctcggctcactgcaacctctgcctcccaggttcaagtgattctcctgcctcagcctcccaagtagctgggattgcaggcatgcaccaccacacttggctaattttgtatttttagtagagatggggtttctccatttggtcatgctggctggtctagaactcctgacctcaggtgatccacccacctcaccctcccaaagtgctgggattacaggcatgagccaccgcaccctgcctaaagacaggttttaattagtaattaactattgcaaaagggaagagaatccagtataaactgaactcaactttgatttgttttaaagagagaatgagagaataggaaaggggaacggtagggaccagagtcagggagtggaaatttacaaaaagtgagaagacgagtgtcttagtctgttttgtgttgctataacaaaatatcacagaccaggtaatttataaagaaaagaaatttatttagctcatggtcctggaggtgaaaagtccaaaagcatggtgccagcatctggcaagggccttcatgctgaatgataacatggtagaaagtatcacatggtgaaagaaagcaggagagtttgtgtacaacttcaagccgtttaaataatcaacattattccattagtgaaggtggagtatcaatgactaaaataacccccatatggccccaactcccaaaactgttgtattggtattaagtttccaacacatgcactttgggggacacatctaaaccacagcagtgagttggcccatgtaaaatcatctgagtttgctaactggtactggtcaaagttaggctcctaccctcccaaagaggcaaaaagacaggggccctatcttcaggtgttggccagaacaaacaatatgttttttgggcagccttgagctttcccaagcaggaacttaaagagactggagtggtgatactaaggatgggaacttgagctgtcagaaactatactaatgtttgttcagacttttaatgagaatggaggaggaggccaggcatgaaggctcacacctgtaatcccagcactttgggaggccaaggtggatggattgcttgagcccaagagtttgagaccagcatgggcaacatggtgaaaccccatctctaagaaaaatataaaaattagctgggtgtgatgacctgtacctgcggtcccagctactcaggaagctgagaggagaggatcacttgaacctgggagggcagaggttgcagtgagctgagatcgcaccactgcaatccagcctggataccagagtgagacaccatctccaaaaaaaaaaaaaaaaaaaaaaagacagagagagagaaagagagaatggaggaatggaggagggacattgtcgtaagagacaaagttaagaaggctatgtgaaaatgaaggcagagattggagttatgctgctacaaaccaagaaatgtcagaagtcatcagaagctggaagagacaaggaaggatcctcctctagaaactttggaaggagtgtggctctggtgacaccttgatttctaatttctggcctcctgaactgtaagagaataaatttctgctattttaagccactcagcttatgataatttgttatagaagccctaagaatctactacatggggtgaaggagagggggaggtatctaaacataatagcctggaagaggatattgacagggctcagaacatgataccccaaagtatggcgccctgggatgctgagtactttgagctgaaggacattggaagggcctcagaagcaagtctctctaaacatttctcactctcctgtctctcatccttttttctcctccaggtgagtcatagaaatcagaatccctcttccccaaggtgggtcatagaaattagaacccctctcccacaaaacaagccataaaacctggaaagataacaagggccttgctgcattctgggaggaaggaattctacatggagagaccaagaagaatctaaacagacaggtgttactgagtattccccttcagtctattaccattccatcatacccttttggccaataacatttctacatggctgtccattcttcatagaatccaagcataaaaacaattttttccttggtctttgggtcttcatttctaaaggctcctgtgtcaagtaaaaccttttttttttctttgagacggagcttcttgttgcccgggctggagtgcaatggcacgatctcagctcactgcaaactctgcctcccgggttcaagtgattctcctgcctcagcctcccaagtagctgggattacaggtatgcaccaccacacctggctaattttgtatttttagtcaagatggggtttctccacgttggtcaggctggtctcgaactcccgacctcaggtgatccacctgcctcagcctcccaaagtgctgggattacaagtatgagccaccacgcctggaccataaaactttgattaaataagtttgttatccttttatcttgttaatctgtcttttgttataggagtgtcagccatgactcttacaatgggtgagggaaggtatcacacttttctgctcctacaatattaataccatgagtagaacatgttgtctgtgagacatttaggaaatattcatatgaggatgttaggcaagaattgggattatggatttagaattgaggaatgaagtaaggaataaagaaactgcagggaaaagaaaaataaacttcaccaagcaatagttaataacataagataaagtataagttagtatttaattgaccacttgaacacaattctttccctcttatttccaaattctattcctgtgtagcaggaatagaagaaaaagccagcatcattgagggttaatgaatttggcctataagggctaataaatatctacaaacaaactttggaaagagtcattaacaggactttgatttcccatttgccttagtagcaaatttagcagcactttttaaactgcctcatggatgactatctccattagtttttttttttaataagaaaacagtaaacactatgcatggtagtgttgtatcctcagtgcttctaatataatttcttcatatttctagtattacatttatctcactgcattctaattattgttctgtctcccctgctagactgggagcttcttaaaggtaatgcaccatttttattcatatttgtatttcaattacttgacacaatattcagcacttaagcaatttatgtaataactactggatggattgtaataacaataatagttaaggatgcagatctagagctagtttagttgggataaatcctggctttactgcttatttgttttgtgaccttgtgaaattactaaacctctctgtgccccagttttttcatcacaatgtgaaataataataagacctttgtcttggtcaatttgggctgttctaacaaaaatattatgtaccgactggcttaaacaacaaacatctgtttttcgtagttctgtggctgggaagtccaagatcaaggtgccagcatattcagtatatagtgagggctctttttctggttagcagacagcctccttctttctgtatcctcatatggctgagagaaagaaaggtcatctctctggtgtctcttctcataagggcactaatcccgtagtgaaagctccaccctcatgacctaattaccttccagaggatccatcttcaaatatcatcacattaaaattagggttttagcatttgaattttgaggacatacaaacattcagtccatagcaaacctcctcaaacaattgttgtgataattaaataaattaatctatttaaagcacttagaagattgctagacatacagtaagtgctcaatacacacatatatgttattgaattattaaatagaataatgcctctagcattcattactgctgttcaattttgtcttcattgttattttattttatgtcttcctgtgtaattcccttgtggcaatttcataattgctatagctttttttgtttgaccctccacatctcatgttcaaatttgatccccattgttggaggtagggcctaatgaaagctgtttgggtcatgggggtggatccctcacaaatatcttggtaccgtcctctggtaatgagtgagttttaactctattagctcccatgagagctggttgttaaaaagagcctggcacctccccctgcattctctcttgcttcctctctcaccatatgatctctacacatgccagctcccctttgccttccaccatgagtggaggcagcttgaagccttcatcagaaacagatgctggagccatgctttctatacagcctgaagaaccatgagccagtttatttataaattacccagcctcaggtattcctttatagcaacataaatgaactaagacaataatctacaaattcatttacttgattactggcaaattactcccatgagagtgagaacgttttctgtgaagttctctacccattccatgcataacacagcatctacacacagcagagattagtaacagtttgttaaaggagtaaattgatccacttttaccttctgtaaagaccaatttaaatctttcttatattgctaacactgaacctcctggttcaaagttaaaaaaaagataaggcgcagtaacaacagagtttcaggaagatctgggaaagaaagatttcctattattttttatttatttatttatttttgagacagattctcactctgttgcccaggctacagtgcagtggcataatctcggctcactgcaacctctgcctcccggattcaagcgattcttccacctcagcctctcgagtagctgggactacaggcacgtgccaccacacctggctaatttttgtattttttagtagagacggggtttcaccatatcggacaggctggtctcctgaccttattatccacccacctcagcctcccaaagtgctgggattactgacgtgaccccctgcacctggcctatttcctattaattctaggactaactacctgaaaataggataataccttgcatcactacattaatatactcatttttattgtcccctgtttctgagagtaacaacttcaaatctcctaccttctttcctgactttgacttcctataccgtcagctcttcagggcagtcttgacattggaataataataataacatcatgttcttagacaaagactgatccactctcagaaatcaggttaaaggttattttatgtgattcttttttgttttaatatgatttataaagagggagagtcaatgttgaagaatcagctattttaaaattgatccctctactggagtactaaaaagtatttgtgaaatgaacacgaataatctttataacattaaacattgcaaaacccaaatgcaaaatagtcctatttaacataaagtctttcatattgttctgttctgccatccttctatacatttgcccagacaggacagcaacaaggaaagaatatgtaaacactaatcatttctaacttgccatctgtgacagttcactgtgctgaaattagaaaggatggaatcacttttccatttccttaaggtcaccaaggacagacaagctcaggacatactgtatttgtcagaagaaaaagagatgactggtgaggtggcagtgacaaatctgttctaggttcagctcattttactgaagaatgtgtgtccccttctgacatttatcaaaagaaattcaattttataaaaagaaggatgtcaaataatagtacattgctaacactcattttgttgctgtcagaagggcagatgggggcaaaaagggaaaagggtggatggaagagaaagttattccagcaagaaacaaacaaagtcatgctaataatacacttataggcttgaatatatttctgattaaaacacctatttttgagatccatcttagtgcctggctcacactttagaataccagttttcacttcttccagacagaaggaacgacacaaagcaggttgatttgtgggttttgtgtttgtttttggttttgtattttgttattgtttgagtgccattctgctgcaccaggaaggaaagaaagctaatgaaacctggtaaaaccccaggtacaatgacatgcaccctgtgggcatgcaatcaatagttcttatggtgatgatgatgtttttctctggcagaaaagggtattttgggtcaaaaaataacccaaaagttgtgacagaggtaacggaaaaatagaagtcagattaaaatcaaaggaagaaattctaacccaaaagttgtgacagaggtaacggaaaaatagaagtcagattaaaatcaaaggaagaaattctatcaggagactaataatgaagctgacaatatactgtaacaagtaatagtgttttaccatactgcataaaaatattggattaagatacaaattaaatctctttctcagtgagggttttctgcagaacataaacaattaagctgctttctggagaagacaggaaacttgattaacagatccaaaaagacagcatagggaagatgggtttaacactaggaggtgaaacaccaactgttatccaaattgacttttccagaaacgttggataatttcaatcaaggactgaaatatactcttttctttttaagcgtcagtgttctctggacttaaacaagtcaaaggaggttcttattaaataaatgctactggtgcatatgttccagtcacagtctcctgaggtgagtatggagacactacagaaaattgaaccatgaaatagggttttgtgtctctataccaaaatttcaaatatctggaggtgtcctagctcatggtggctaagcaggcagcttgtgggagtacaggaggctacaggagacgccaggagtaaaacgacctattctgagtcctgtagtctctgtaaggtgcctatttgatgcaatctaagacagtcttatttagaatagggacccttagaagctgctaatataagtcaaagaaacaaatacttctgtgcatttttccccacaaataagggattgtcctaaacctctaagcattaaaccaggaatccagtaaaaaccaggcttattgtactccaatccccaactcacgtactgtcttagagattttcagacacaaggtgctaaaagttatatagcatattttaaaatttatctgttatcaagtgcctttcattgaacaaaaaaaaaatcaaattcaatagtacataaacaagatctttctgctccttcttggaagatttttaggagaattaaagtcatagagacaatcatctacatgccattaatattgtcatcttcacatattattaccagtattattaccagcacagctttcaaggtttgaaattttgcattgggctggccttaacatttggacaaatcctttttaaatatagggaataaataataaatttaaaaataaaatacgttaatatgcaattttttttttttgagactgagtctcacactgtcacctgggctggtgtgcagtggcaccatcttgacttactgcaacctccgcctcccaggttcaagcaattctcttgcctcagcctcccaagtagctggattgcaggtgcctgccaccacgcccggctaattttttgtattttttagtagagatggggtttcaccatgttggccaggctagtcttgaacccctgaccttgtgattctcctgcctcggactcccaaagtgctagaattacaggcgtgagacactgtgaccagccaatatgcaaaattttaacgctttaaattagaggtcagcaaacttttttcattaacagagagtaaaatatgttctgctttccattccatacactctcacacaactaatcaactctgctgttgcagtacaaaagcagccatagacaatacaaaaacaaataggggtggctgtgttccgataaaattttctttacaggcctctgcctctgcctctgcctctgcctctgcctctccctctcccctctcccctctcccctctcccctctcccctctcccctctccctctcggtctccctctccctctctttccacggtctccctctgatgccgagccgaagctggactgtactgctgccatctcggctcactgcagcctccctgcctgattctcctgcctcagcctgccgagtgcctgcgattgcgggcgcgcgccaccacgcctgactggttttcgtacttttttggtggagacggggtttcgctgtgttggccgggctggtctccagctcctagccgtgggtggtccgccagccttggcctcccagggtgccgggattgcagacggagtctggttcgctcggtgctcggtggtgcccaggctggagtgcagtggcgtggtctcggctcgctgcagcctccatctcccggccgcctgccttggccgcccagagtgccgagattgcagcctctgcccggcctccaccccgtctgggaggtggggagcgtctctgcctggccgcccatcgtctgggacgtggggagcccctctgcctggctgcccagtctggagggtggggagcatctctgcccggccgccatcccgtctgggaggtggggagcgcctcttcccggcagccatcccatctgggaggtggggagcgtctctgcccggccgcccatcgtctgagatgtggggagcgcctctgccccgccgccccgtctgggatgtgaggagcgcctctgcccggctgcgaccccgtctgggaggtggggagcgtctctgcccagccgccccgtctgagaggtgaggggaccctccgcccggcagccgccccgtctgagaggtgaggagtccctctgcccggcagccaccccgtctgggaagtgaggagtgtctccgcccggcagccgccccgtccaggagggaggtggggggtcagccccccgcccagccagccgccccatccgggagggaggtgggggggtcagccccacgtccgggagggaggtggggggggtcagccccccgcccggccagccgccccgtctgggagggaggtggggtcagccccccgcccggccagccgccccgtccgggaggtgaggggcgcctctgcccagccgcccctactgggaagtgaggagcccctctgccgggccagccaccccgtccgggagggaggtggggggctcagccccccgcccggccagccgaccagtccgggagggaagtggggggatcagcaccccgcccggccagccgccccgtccgggagggaggtgggggggtcagccccccgcccggccagccgccccgtccgggaggtgaggggcgcctctgcccggccacccctactaggaagtgaggagcccctctgcccagccaccacctcgtctgggaggtgtacccaacagctcattgagaacgggccgggatgacaatggcggctttgtggaatagaaaggggggaaaggtggggaaaagattgagaaatcggatggttgccgtgtctgtgtagaaagaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaattaaaaaaaaaaagttaaaaaaaaaaaattttctttacaataacagcataaaactttggcttcaggtcacagtttgttgacccctacttcatattatcatgtcccccccacccccatttctttcattcaccttctatcacagagtcacagctttgcactcacagtgtagccaagttgtagctacagaccaaacattgtaaagaaatacctccggggaacttgagaataagttaaaacttgtgctaaatcatgagtgaaatatacattgggaaacacagttaacaacccattccccaacctgcttactgggccatctttctaaaaatgcaaatttgatcctgcagctccctagcttaaaaggcttcacctgcaacagaaagccctggctttttagtttttcaccataggcttatttatggctggtcctgctttcttcccctccttatttcttctcatcccttccttctcacattctatgcttcagctacatagaaggacttataatttccagaatgatacctgctcccttgcctttcaacccatacacttatttttttttttcttcttagatggagtttcactcctgtcgcccaggctggagtgcaatggtgcgatctcggctcaccacaacctccatctcccatgttcaagcaattgtccttcctcagcctcctgagtagctgggattacaggtacccgccaccacacctggctaatttttgtagttttagtagagaaggggtctcactatgttggccaggctggtctcgaactcctgatcttagggaatctgcctgccttggcctcccaaagtgctgggattacacgtgtgagccaccatgcccagccaacccatacacttgttactcattctccttgaagcactcttctccacacatccttggccttgccaactccttgaaggctgagcttaggtgtcttaaggacttcaactcccagacacttctgtatacctgcgttataatatttttactgctggctgtgtgtggttgctcacacccgtaatcccagcacttcgggaggccaaggcaagaggattgcttgaagccaggcattcaagacagcctgggcaacatagtgagaccccatctctaccaaaaaattagaacttagctgggcatgtggtacatgcctgtactgccagctacttgggaggctaacatggtagaatcgcttgaacccaggatgtcaaggctgcagtgactcgtgattgcaccactgcactccagcctgggtgacagagcaagatcttgtctaataataataataataatattcttaccactatctacagatgattactggtgcagataaatttaaaattcttcttggccatgtgtggtggctcacacctgtaatctcagcactttgggaggccgaggtgggcggattgcttgagctcaggagttcaagactagcctgggcaacatgattaaaccctgtctctaccaaaaatacaaaaacttagccgggcatggtggcacatgtctgtggtctcagctacctgagaggctgaagtaggagtattgcttgagccctgggtggtagtggggagactggaggttatagtgagctgagattgtactactgcactcctgactccagcctgggtgacagagtgagatttcatctcaaaaaatatataaaaaataaaaaatttaaaatccttgaaagctgaaactgcattttcttgtaagcacatgatatccctcttagggtcctgctcccccatcccctgagcatgggaataaagaaaaaatcttgactccctttaggggaaaattccaggcaccccactatccttgagaaataaataaataacccactaatcaataaggtaataataagcttaaacaatagccacccaagtaatctagagtcataaaatgtttggttccctataaaaactaaagataacatcttgacatatttccctgagttgtttttcagaaacctgtacccccacaagatggaaaatgctgaccactgtcacacagacctcaaataagggagagctaaggactgaactctaatcgttgtcccttgttctaaatgtcttcatgaggggcctggagagggtcatcatgcccatagatcaaaccttaacattcctttcttctgaccccaagtttttagacaaagcattgcttccctaaccaattgtaaatcaaataatctgtgaacctctctatgacttgtaagcccccacttccagatattctgccttttgaggcaaaaccaatgtgtaacctccatgtattgaattacatatgattttgcctgtaacttctgctttcctgaaatgtaccccttcctttaaagacccttgcttgtaagccgtgggagagtttgggtcttaagtgttagctgcccaattctccttgcttaatgccatgccataaatgcctcactttctctcactgcaaatcttggtgtcaatgtttgcctttgctgcaccaggtgggctgaccaaagttgggttggataacacatggtatctggtacattgagaataatccctaatgcttattaaatgaagccatcaattatttaatgtctttaataagcttttggcctttctacttcagaatataactttagttattcccagctatgggcaatttattttcttttgcatattgtctataaatgatacccaaagaactaataggaaaaaaaattattagtcagttaaacaggtaatttaatatcaaaccatagaggaggaaaaataattgtctctctacccttcagagttcgtagctgagactctgaaggttaacaggagaaaaataaataaaagatgaataacgtgtgtacctccagtatacatggaaggcatactcagcgaaatctgaaagagtaaaatctccaggctaaatctcaagagatctcaaaagggttgtttaaacttcaggcttataccatcctttgttgaaacaaaaagagaagtttattgggaaaggctgattatgggagataggaagagtacagtatacaagaacagtttgttatgcaaacttaagtcagtcccttctccattgattaagagtatcttggatttagtcattctcttcctggtactaagagagagagagacacccttacaaataacgattttctttatagacataaatttctcttacaaaagggtaccttctactctagttttcagagcttctcctgtgtctgctgtttcccaaaataattcaattcaaaaaattctatgtcaaagaggcttatttggggtggtgtattctggtcttttacagtcacactttgagatgacgtgttctgaacgccatcaatataaaaatcttcttaacttgatttaaaatttttttcaggttgaaattagacatatagctttatgttgtcattattgttttgtttctttagagtgttaacttaaaaggaagaagctgaggaaaattaatatatgtagagagtttctttgggccaagcttgcagattgcaacacaggagcacagattgaagttgccctgaatataattcaacaagcagtagttacaagtgaaaaaaagtagttaaaggcaaaaaggggagacacagagtgggctgatacaaagttgcttgtcaggaattctcattgtttcatggaaatgacgtggagtagtgattggctatacatttttggctatagtgtgtgggttatagtgtctggtgtggcattattagcttaatttatagctacttgtagcaatagcaagcagtttcaagagattaatatatagctcaaagtgggaaataggacattattgcagtctcattttaatgtctctttgggcctggtaagtactgtcttcttttttttctttttttttttttttcttttttgagacagggtctcactctgtcacccagactggagtgcaatggcaccatctcggctcactgcaacctctacctcccagcctcccaagtagctgggactataggcatgcactaccataccgtgctaaatttttgtatttttttgtagagatgaggtttccccatgttgctcaggctggccttgaactcctgagctcaagcgatctgcctgcctcagcctcccaaagtgctgggattacaggcatgggccatcgcaccaggccaggacctgataattaaaaggcctcagataaaagttcttttctcaagagacaatcttaggaccacttgctgcattatctatcagtattaataaagccactttacatttaccctataagtggaaatattttctcaactaatcacttaacagccaggttttatttgagaagcaattaaacatttatggggtctacagaagatatgaacaaatgctatataaagacatccctaataacagactataggaaaaaaattgtgctttaatgcattatccacatacagcatgtcactctgggttactagattttagcctttcatgatctttgcattttattgcatatttattttatgactctttgcaagttaaaagtgacaaagaccctccccttaggctcctttgaatcttctttttgactaactctcactcttggtctcatccttgccccacctagtctagttttagcaagaatcctcttgaatcaatatggcaaaaatcccctgcccttggcatgtgatcactattgatgactgattaggttcctcttacttcatcctctatatcttttcacagtgggctgccttcagcaagaatcctaagtcagtgtagccataatccccatagtcttgatgtttcctcttagtaattttctatcctctgatctccgccctttaccttggccataaatccccactttttcttgttgtattaagaatgggatttcattctatgctgagatctctttttccctattgcaataattcctgaataaaatttgcttttatcactttaactttctgtctggctgtggtttgctttgacaatagacatgcatattctgtcttacagagtggagttcaatcgacttcccatctcctatgggggaaaaaaaccagttttgcctctatttgtaattccatttctttactccatagaaatgtgtgactttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaatgtgtgcctttgaattttcctttcaaccaattataatatctacccgccttccttactgaatgagtaaaataaacattttaacacatgcttatttgtatgcccacatgacagtcatgatcttaccttttcttttttctttttttttttttttttttttgagacggagtctcgctctgtcgcccaggctggactgcagtggcgcaatctcagctcactgcaagctccgcctcccgggttcacgccattctcctgcctcagcctcccgagtagctgggactacaggcgcccgccaccacgcccagctaattttttgtatttttttagtagagacagggtttcaccgttttagccaggatggtctcgatctcctgacctcgtgatccgcccgcctcggcctcccaaagtgctgggattacaggcgtgagccaccgcgcccggctgatcttaccttttctagaaaattatcttttaacaattttggaagttccactgaaatgcccagtggatttacctaccaaagccaggtaacctttgcaggcagagaaatgcacttcatgggcagtgtaagcccaggtagatcttttcttggctcacagaattgaatccaagatggcaagaaaaccttgctcactctgtttttctcattctaattctcctctatactaattttacatttttggttttgggttgtttactgtcagtaagttagtccccgttgcaggaagtaatggttgggaattcacttttatgatctgattatttgatgatctctgtaaatgaattaatagttaacagagatctctgctaggtgagagatagcagagaatctagtgggttagtcttttctgtttatctgttttctattttgaactcttgcagaaaccaaattaatgttttaagaaatcaagttcagctgggtgcagtggctcacgcctgtaatgccagcactttgggaggccgagatgggagtatcgcctgaggtcaggaatttgagaccatcctggccaacatggtgaaaccccgtctctactaaaaatacaaaaaaaaaaaaaaaaaaaaatagccgggcatggtggcatgtgcctgtaatcccagctactggggaggctgatgcaggagaatagcttgaacctgggaggcagcggttgcaacgagtggagattgggccactgtactccagcctgggcgacaagaacgaaactctgtttcaaaaaaaaagaaaagaattcaagttcacataatttagataaatttttggcaaatgatacaagcttaatattattggtttaacaaaaaatacctatgtcttctttgatttactagagaatgagaataatataatgtaggtgcttatgctacttgggtatgtttttcctaatcttaaacaggttaatagattgaataagcttgccttacttctacttcatgtttaagatgtttataaatataaatttatatttactcatactgaatcattattgtgataaactttatttcaacaataattatgttttgtgtatgtcagcttcaggacaattttcaaggtctgtaagtaacttaaaaccttggaccaatggtaagttgagttaattaatggagaatcattagatagacagacagtatttcaagatagtaagatagaatactcattactactcataatttcaagtttatatccctttacttcttattttcataagactatctctttgggtctgtactgaatgtgctgctcatttctgccactttggggagtgtataaaaatgatatgtgtggctaaggcaagctgtattgtgtgtattcacaagttctgctagtctgctgcaaaatgctggtgtgacagtgaacaattatccactctccaggtctctctgtgaaatagaagtgtgttactttggctaaaagttataatggatatgtggctttggctatatttaggagccatagtttctgacaaatacagctgtgtatttccattttttgaggaaaagagtaattttgtcccaaaggagtggagtatttttggtctccaaacccccttgtgctcttcaagcttattgagaaccacaaagaaatagaactgcctttgagatttcccaaaggactcccataaagtcacaaagatttgttcttttgccttctaaaaaggcagatgttaaaaataattaggctcatgtaacattattagggctaaaaacaaaaaacttatactgtaaaatatggtgccttgacaagtcttttttttttttttttttttttttggagacaaggtccactctatcacccaggctggagggcagtggcatgatctcagctcactgcagcctgacctgccaggctcaagagatcctcccactccagcctcccaagtagctgggaccataggcacatgccaccatgcccagctaatttttgtatttttttgtagagatggggttttgccatgttgcccaggctgatcttgaactctgagctcaagcatcttcccaacttggcctcccaaagtgctgggattataggcatgacccaccatgcccagcctcttgacatgctttgaactaaaaaaccagcctcagaaacaaagtctctctgactttctcccaccctcaccctctgtcccccaatctcagtcctctgcctctctgaaagcacagggagaggctttctctcaagttcatttatgggactgcaggaagttcctccagacagaatgcaattgtcttaggtcttctccctgtaatctcagaaaacaaagaaggttaacttgctggaatgatgactagattgggcaccatacccaaagcccagacagactttctcccaggctattgtttgttcttctcccctaaaaatcatttacttttcctctaaaattgcatacatcccccactccttctcccctatgaagagagtatttaaacttcaaccatctggcccttctttgagtatcacactttgtgtgactcccgtgcacttgcacgttaataaatttttatgccttttctactgttgatctgtctattgtcattttgttttataggctcaaattcttgaactcccagggagtggaagaaaactttctttcatccctacagtgtgttattattaatgagttacatagaaagagttgtcgaattaaaaaagatacttatgcttccctagattaaatttatatgggtaaaatcatcacaaacattttacaaactaaaatccatatgtgaagttcctagagatttgtcaatgccttcactgcctatgacatggttctatttatcagagttcaggtgtagctctgcctgataatagacaatagacaatagtatacagtagacagtcataatttcagttatttttggcatgccagctttgttaagatataattcacacacaacacaatttaaccatttaaactatacaattcagccaggcatggtggctcatgcctgcaatcccagcactttgggaggctgaggcgggaggattgcttgagatcaggagtttgacatcagcctaggcaatatagggagacctcctctctacaaaaaatttttaaaaatcagccaggcatagtggtacatgcctatagccccagctacttgggaggctgatagggggattgcctgagcctgggagatcaaggctgcaagtgagccatgatcatgctactgcactccagcctgggagacaaatcaaggctttgtctcaaaaatactaataataataataataataattaggtgtataattcaatggttcttagtatattcagttatgcaaccatcaccacaatcaattttagaacatattcttcacttcaaaaagaaatcctgtaaccattaacagtcattctgcatttccccactaaccaccaacccagaattgcctatttgggacatttcgtatagatggaatcatgccatatgtgatcttttatagctggcttctttcccttagcataacattttaaggttcatttatattttaccatgtatcattacttcattccttgttatttgcaaatattattccattgtacaaatataactttttatttatccactcatcaattgataggcatttagattgttttcactctttggttattatgaatgctgatgctataaaaattcatttacaagtttttgtgtaaacatgttttcatttctcttgggtatatacttagaagtagattttctaggtcatatggtaattctatgtttaatcatttttatggcaaccctatgtttaactatcagattgttttccaaagtggctgccccatttttcagtccactagcagtgtatgagggtttcaatatctttataccttaaacaacacttggccaggcacagtggctcatgcctgtaatcccagcactttgggaggctgaggcaggtggatctcttgagcacaggagtttgagaccagcctgggcaacatggcgaaaccacatttctactaaaagtacaaaaagctagccaggtgtggtgtcatgcgcctggagtcccagttacctgggaggctgaggtgggagggtcacctgagctcaggacgttgagctgtgatcacagcactgcactctagcctggatgacagaatgagaccctgtctcaaaaaaaccgaaaaccaaaaaccactacaaccaataacaaaaacacttattatctgtctatttgattacagcatcttaatgggtatgaagtgctatcctatcaccttgagatttacttgttttcttttctccctaatggctaatgatgttaaacatcttttcatgtgtttattggccatttatatatcttctttagagaaatgttaattcgaatactttgcccattttgtacttgggttattttattgagttgtaagacttctttatgtatactaggtacaagttccttataagatgtatgagttgcaaatattttctccagttcgtggattgtctcttcacttttttgatggtgtcctttgaagcatgactgtggtgaagtccacaattttctaatttttcttttgtcaattgtgtttttggtgttacatctagaaaggctttgcctaacccaaggtcacaaagatttataccctacatttcattccaagagttttattgttttagctcttacatttaggactctgatccatttttagttaatttttgtgtatggtttgaggaagaagttcatctttattcttttgcatgtgcatatccagttgtcatatttgagaatgatgctcattttaccaaatatgaccatgttcctataagtaactaaggttgtaaacttcatgaaaccaatgcttgcaatgtcctgttgggtaagctcacctggtacctggcttataggtttccctgccttccaggtaggtttagaaggtcactttctggcaggtccaaaagtcttagcatctttgggggacctggagaagaaagcaatttgtctcatttataggaaatgcaaggaaatctgatgatgagttcttaccttggtttcttagcctcatgatagtaaataatgagaggttttaaaagcccattccgagattgcttataaaaacttccagcaaagcaaatttaaggtctctatggtaaaggaattttcttgctacacctgtatatataatcaggccagatctgtcaatgttgagagaggaggaagggagaaaccagttaggcagcagttagggtgggtcctctgttgaattctttcaaacaaaagaacagcctgaaaaatcaagctgcaggcacagataagggaacttgcacaggggcttgcctaagacatacccaccgctgcacagataagaaaggctacacaggtgacttgcccaaacattcccgcaatggaaaatttcgtcctctgacacatgcacagtgaagggaacaaagcaatatggagtaattcaagctaaaggcctgcatgcacactaggtggatgcaatggggctaccagaaatttgtgccttatggaaataaaatgtccagccctcatcggttcctataaaaggctttgtattcaactttgaaaacagcaatcctctttcaggccccctctctgcagcggagagctttcttttttagcttactaaacttttgctccaacctcacccttggtgtctgcgcttcttaattttcttggtcattacacaaagaacttcctgtgatactttgggcaatgagaaactgctacattgtggtgcactggggagactgtaaccatgtgtatcttactttgtgatcaagaataatctttcgagggttattttttattaaaagaggagagactatacaaaaaaaaattgtgtttcaatggaaaactatggattatctacatacaacacgccttgtgttacctaatctagactttctaatttttcttagagacagggctttgctctgttgcccagactgaagtcaagtggcatgatcatcactcactgcagcttgaactcttgggctcaagtgatcctcccacctcacctcacctaggactacagggatgtgtcactatgcccagctaagtgtttgtttatttgttttgtagatctggggcctctctgtgttgcccaggctggtcgttaactcctggcctcaactcatcctcccacctcagcctcccaaagtgctgggattacggttgtgagcccctgtgcccagccagtcagattttagcctttataatctctgagctattttacaactctttgtaaacggatagactacacattctgtcttgtctgatagggtttcaatgaacttatctcccctctcagggaaaaaatacctttgcctccatttgtaattccattcctttattccatataaatctgtaccttttgacttttcctttgatccagtgtaatatttgcctgcttccctcatcaaataagtaaaatctttcacacatgttcattttttatctgtatgagagtcatgattttacctttatttcaaaagttatcttttaacaatacattacaaagtgggatagagatgaaatcagataagagagaaaaagacccatgaaaatgcataggtttaggatgtacctcatttggactctgcagagacaatgaaacaaagtctcaaagaagttgatttgccgaaagatacaaccaggaaatgggggtgagataagggtgaagggtaaacaataattaatggaaaagaaattaaaatgacacaaaacatgtgaataaatgctcaatcccataatgctctcaaatccttttttaaaaagacctatcatttttcatttaagagagtggtaaagaaatagaagtgtggtactattcagggctggtaagtaggtagcaggaataggcgcatttctgctttgtgaataagggagcaggatacactctttaggaggctatttaataatatttaaatacaagtatcctttaaaccagcatttctacttttagatgtttaattggtgaaatgcttgcacaagtatgtgatgatatatgttcaaggatgttcattttcaatattgttgtaatagaaagcttggaagcaccctagatttccatcaataaaggactgtttcagaactctgtatctagaatggtgcattttttgtttaaaaatatacatatagtggtcatcttagagggatgggactataaaactttgtactccacattttttgttttacatgtttgtattacttttgccatattttttaaaaagtaaaaatatacctataagagaatccaatcttttgaacttggtacagtatcatataaatgaactcattttttcagtgcaccaatggaagcttctcagtggaggtggagagggttgtagaacagcattctgaattggacctccatgaagtagggcatagtcattactcactagtcactaagaacattttctatgggatgtgcacaatatccagacaagaattttaacaagatccacacatgctacttgagccaatgaaacactttacttaatcaattaactaatgaaggttttagggcaaataactacgactgaagaattgatgaactatagaatgtaggtgtatgtgtgtgtcttttgactgtagttcccactgaagagttgccgaatgatgaattaatgctaaatgatccagatacacatcatataaataattacttataaatattattcaaatgaaatttatctactttaaacagctatttgtgcagttaattgattttaaactgcatatacttccaatttcaaaataggctgatttgaagtagagtcttcagtaggggcgtagcatattatgattttaaaaatttaaatcttatgttacactaaaatgctgtaggaaatagatttgatcgggcaaccaaaccgatgtcatgggtcactattcgtaagtaccatggcaaataataatgattaacatttaccacagacttattgcatagaaataatttctgtaagttatgcctccaagcaactcagtgatgtaagtaatgatttatcctggcttaacagaagttaactaaagatacggagggagaaaatgaggccagggagttctctggggcctcttttataagggtacaatcccattcgtgaaaactccatttccattacccagtcctatcccaaagaccttgcctcctaacaccatcacatttcaggtgagaattttgcataggcatttgggaagggaggacaaaaatattcagtccataacaaaattcctcattgaggttgtgtgtattgactagataaaagaaattcaacagtttccatcccaaatttgtttgctatccaatatagatagcttggtttttgttttgagacagagtcttactctgtcacccaggctggagtgcagtggcacaatcatagctcactgcagccttgaccttctgggatcaggtgatcctcccacctcagcctccttagtagctgggactacaggcatgtgccactgtgcatggatcttatttatttatttatttttgtggagacagggttttgctttgttgtccaggctggacttggacttctggcctcaagtgattctcctacgttggcctcccaaaatgttaggattacagatgtgagccactgcacctggcctcataatttctgatttatattcacaataaagctaaaagaggaaacacatgtattgtggaacaaaaagcacacaaagaagctgtttgaatgtctttttaaaatttttacttttcaatgtttttattgatgtgaaatatttgaacatatttataggatacatgtaatattttgttacatgaatagaatctgtaatgatcaagtcaggatatttaggatatccatcaccatcagcattttaccatttccatgtgttgagaatgtttcaagtccttacttctagctattttgaaatgtgtaatacataattgttaaatatagtcacctatatcactataaaatattagaacttattctaactaactgtatgtacccattaacccatcctactttacttccccccacgcacactcacagatagttcccagcctctgataactgtcattctactcactacctccatgaaatcaacatttttatgagcatatgagtacatgtgataatatttgtctttctggtttttgtttttgttttgagacagggtctcaccccgtagcccaggctggagtttagtggcactatcacagctcactgcagcttccaactccctgggctcaggtgatcttcccccctgtacctcctgactagctgggactacaggcacatgccatcatgcctgtctaatttttgtatttttttttgtagagatggggttttgccatgttgtccaggctggtctcaaactcacgggctcaagtgatcagcccaccttggcctcccaaaatgctgggattacaggcatgagccaccacacctggccatatttatctttctgtgtcaggcttatttaacttaacataatgacctccagtttcatccatgttgctgcagatgacattatttcattcttttctatggctgaatagcatcctactgtgtaaatatatgacattttctttatgcattaattcattggtggacacttaagttgattccctatctttgctattgtgaatagtgcagcaataaacacaggggagtatgtatccctttgatatgctgatttcctttcttttggataaatacccagtaatgggatagctggactacaaggtagttctattttcagttttttgagtaatcttcataccattttccataatggctgtactaccttacattcccaccaacagtgtatgagagttttattttctctgcattgtcaccaacatctgttattttttgtattttttatagtcatttttactggggtaagatgatattgtggttttgattagcatttccctgataattagtgattttgagcatttttattatacctgttggccatttgtaggtcttccttggaggaatgtctatttagatccttgcccaacttttaaatggggttgtttgtgtttttgctgttgagttgtttcagttccttgtatattctggatattagtccttgtcagataaataatttgcaaatattttcttccattgaataggttatctctttgctctgttgattgtttactttgctgtgtggagctttgtagtttaatataacttcatttgttaagttttggttttgttgcttgtatttttggggtcttagccataaaatctttgcttaggcaaaagtcctagagtattccccgctatgtttttttctagttgttttatagtttagggtcttacgtttaagtcctcaatccatcttcatttgatttttgaatatggtgagagataggggtttaatttcattcttctgcatataaatatccagttttctcagcaccatttattgaagaggatgtcctttcccccagtgcatgttcctggcacatttgtctaaaatcagctgtctataaatatgtaagtttatttctgggttctctattttgttccgttggtctgtgtttttctttttataccaatatcatgctgatttggctactatggcctgataatatattttaaagtcaggtagtgtggtgcctccagcttggttattttcattcagaattgctttggctatttaggctcttttttggttccatacaaattttaggatttatttttttctatttctgtaaagaatgtcattggcattttgataggaattgctttagtagtatggtcattttacaatattaattcttccaatccatgagcatggaatatctttacgtttgtttgtgacctttgcaatttctttcactggtgttttgtagttttccttgtagagatctttcacctccttggttaaatttattcctagtttttttgtttttgtttttgtttttgttttgtcattgtacatgggatttctttattatttttcagctaattcattattgacattataaggtatatagaaatgctactgatttttgtatgttgattttgttttctgaaactttactgaatttgtttatttgctctaggagtcttttgaaggaatctatagggttttctagatatagaattatgttgtcagtgaacagagataatttggtttcctctttttctatttggatgccttttatttctatctcttatttgattgctctggcgaagactcccagtagtatgttgcatagaaatggtaaaagtgggcatcctcgcttgttttagttcttaggggaaagggttttagtttttccccatcagtgtgttaactgtgggtttgtcatacatggtctttattatgttgaggtatgttccttctgtgcagagtttgttgagtgttgtttatcatgaagggatgttgaattttatcaaatgctttttctgcatctattaggtgatcatgtagtttttgtcttttgttctgctgaggtgatatatcacatttactgtttacatatgtagaaccatgcttgcaatcctggggtaaattccacttgattgtggtatattatctttttgaggtgctgctagatttggtttgctaatattttgttgaggatttctatgtctacgttcattagtttattgacctgtcattttctttctgtgttgtgtttttgtttggctttgttaccaaggtaatactggttttacagaatgagttagggcaaattcccacctcttctcttttttagaatagtttgaggagaattgaaattagttcttctttataagtttggtagaattatgcagtaaagccattatgttttcagcttttctttgttgggagacttttaaatttgttttcaatctcattacactttattgatctgttcaggttttctatttcttcctgatttgatcttagtaggttgcatgtttccagggatttatccattttctctaggttttgcagtttgttagtgtgtagttgttcataatagtatctgatgatcttttgtatttctgtggttatcagttgtaatgcctcctttttatttctaattttatttgggtcttctctctttcttcactggtctagctagtggtctgccaatattatttatcttttcaaaaaacccactttttgtttgctgatttttttgtatatttttagtcccataggttttagtatgctatgtttccattttcatttgtttcaagaaatttttggcttctttctttccttccttccttccttccttccttccttctttctttcttttttctttttttgagacactctcactctgttacgcaggctggagtggagtggcacaatctcggctcactgcaacctccgcctaccaggttcaaccaattctcatgtctcagccccccgagtagctgaaactaaagtcatgtatcaccacatctgcctaatttttgtatttttagtagagatggggtttcaccatgttggccaggctggtctcgaactcctggtctcaagtgacctgcccacctcaacctcccaaagtgctgggattacaggcacgagccaccatgcccagcctgatttgcttcttaatttctttgttaacccaatggtcattcaggagcatattgtttaatttcatgtatttgtacagtttccagaaaccctcttgttttttatttctagttttatttcattgtggtcagagaagatacatgatatgatttcaatgtttaaacatttgttgaggcttgttttgtattctaacatatgggctatctttgaaaatattccatgtgctgatgaatgtgtactctgtagctgtcagatgaaaagctctgtaaatgtctgttaggtccatttgatctaaaatatgcagtttaaacccaatattcctttgttgatattctgtgtagataatctgtcagttgctgacaatggggtattgaagtccccaaccattattatattggagcctattcctcactttagagctaataatatctgttttacatttccaggtgctcttgtgttgggtgcatatatatttagacttattacatcctcttgcccaggcacggtggctcacacctgtaaccccagagctttgggaggccaaggcaagaggatcactcaagactaggagttacagactagcctcagtaacatagtgagaccccatcttacacaaaattttaaaaaattagccaagtacggggcatgtgcctgagggtgaagtgagaggattgcttgagcccaggaggttgaggctggagtgagccatgattgtgccattcccttccagcttgagtgacagagcaacagagcgaggctctgtctcaaaataaaaaaagagagaaaaaagatttttatatcctcttaatgaattgatatctttatcattatataattaccttttgtctctttttgctgtttttcacttaaagtctgttttatatgctataaatatagcacattctgcttatttttggtttctgtttgtggaatattttttccatccctttgcttttagtctatatatgtcttcacacgtgaaataagtttcttgtagataagacatagttaagtcatgttctcttacccattcatccagtctatatcttttaggtggaaattttaatttgtttacattcaaggtaactgctgatatgtgaggacttattcctgtcattctgttaattgttctctggttgttttgtatatcctttgttattttcttcctctcttattttttatctttatggtttggtgattttatgtagttgtaacatttgagtcctttctctttctcgtgtgtgttttctctattcattagttttatactttcatgtgttttcatgatagtagatatggtccttttgcttccaagcacagaactcctttatgcatttcttgtaggtctggtctagtagagatgaattgcctcagcttttccttgtctgggaaagtctttatctttttcttcatttatgaaggataatttagctgggtatagtattcttgagtagccatttttttcacttagcactttgaatatatcattccgctctcttttggcctgtcatgtttctgctgagaagtcaatttttagtctggtgaggattctcttatatgtgactaggtactgttctcttgctgttttaaaattctttctttgtctttgacttttaacagtttggctacaatatgacaggaaaaagcctttttttggattgtatctgtttggggatctttgagcttcctgtatttggatgtctaaatctcttgctagaactgggaaattttcagctaatattttgttaaataggcatttctatggcattaacttctccttgccttctgggacacaaaacatttggatattttgtcacttatgatgtcccatatatcagatagcctttcctcattctcttgtattcttttttttttttgtctgattggattatttcaaaagacctctcttcaagtttttcaagtttcttctgcttgatctagtctatcattgaagctcttgattatatttttaaattttatttattgaattcttcagttccaggatttgtttagttcttttttatagtgtctatctctttggtgaatttcccattcatatagtgaattatttttctgatttgatttctttgtattgttcatctccattcttttgtatctcactgagcttctttaatgttatttttaatttctcaagcatttcataaatttctcaagcatttcataaattactattttttgaaatctgttgttggaaaattattatgttcctttggaggtttcatatttccttgttttttcatgtttcctatttcctttttttttttagatggagtcttgctcttgctgcccaggttggagcacagtggtgcgatctctgctcattgcaacctccgcctctcgggttcaagcaattctccttcctcagcctccccagtagctggaattacaggtgcccaccaccacacctggataatttttttgtatttttagtacagacagggtttcaccatgctgtccaggctggtctctaactcctgacctcaggtgatccacccgccttggcctcccaaagtgctgggatcacaggcgtaagccaccacgcccagcctcctatttcctttcattgacatttgcacatcaggtgtaacagtctcttcttctatttttggattggcttttgcatggggaagactttttcctgtaggtgaatctatggtgttggttgggtagggcacttttgctttgattctgggtgtgtgcagtagtgcaggctcataggagttcctcggctataaactcagtcagtggtgtttgtgattttctcagtagcttgggctctggttgttaatggaagctgtggtgaggtttttctggggacaggacaaccctcaggcttccaggtggcacttgctggccggtcttgcttccttctttctttctttctttctttctttctttctttctttctttctttctttctttctttctttccttccttccttcttttcttttttctttctttctttccttctttctttctttctctttctttatctttctttctcttcctctttctctctttccttccttccctttcttccttccttcctttctttttctttctttcttatttctttttttttttttttgtctgtgatggtctaagcaggccattccctaggtccccaggtggcacatgcagttgtgtgctggtggtggtggtgatggaaggctgggcaggcccatcttcaggaccccacgaggagttcccagatgccagtagttatgaatgaggcagggagatgcccaggcctccagagagcatgcttggttgctggttgctggttttctaggcctgttgttaggccctttgcttgtgtgcatgtgttcccagggcaactgttggggtggtgtggccccaggctcccaggtggtgtgtttggggcactgaggggccaagcctggtaagatgggtctgtttttaggtgtcctgttggcccacttaagtgttggctttagtgggtggggcagggcaggcccccaggcctctggaaggtatgatagggtgccagcagtggcaggtgttctgaggctattattaggccccctgctggtttgcatcctcacctgggtgactgataggatgggctaacccctgggtccccaggtggaaggtttgggaacgggggggtgtggttccagtctgggtgggcctatccttaagctccccattgttgcgtatggccacaggctgtggtgagcattgtgggtcgatccccaattcttgggcagtgtgctcaggcagggatagtagcagtggcagtgggcagtaaaaacccatcctgaaggcatatgcaagtgtgcagtagccctgctagggatgggggtgctatttgtggtagccatcccaggaaggtggggttcagactctggacagtatgtactttggctcccagtaacagcagtggctgaagcagctggcaaggatagcccggactccaggcataagcaagtgcatggcagccctgctgctggggagagcattagggttgctgtttgtgaccacagcttaaggtagatggatttcagactctggggtgtaagcactttggctccctcctccctggtgtgctgcacctctctctccccagtgtataggacactgtacgggctagattgctggggatcctgctgttctactggttccaactggcatctcacctctgtagcccttctggtggatgtggggaaatgtcactgggactccagggaggtggagatgcaggagctgtggggcactgggacaggatgtagcttggtggaagttgggctctcaaaatggtgtcatgctgcagctgcctgggagttaggagacggggtggtgtgagacccactatgagctccctctctggagcaaaactctctcatggactctagggagctcctcatgccagtctcagggcctgcagggcttgaggaactctcccatggctagtattacaggaatctgtggtaaggatgtggaccactggggatcttgcacttcccctttccttgcactgaggagcctctctgagctcccagctgatcctggctgggctgtcggtttcacctctggctccttcagtgcctcaggtgtttcttgtcactttgttaaattctagctttctctcttagatgttctgttccaagtgtgagtatctactcaccattttggttctttgtggaggagctgagtgtcttgtgcctctagtcagtcatctcaaaacgtcactgctcagacttcttttttttttttcttaaatagagacaggatcttgctatgttgcccaggcaagttggtcttgaactcctgggttcaagcaatcctcccacctcagcctcccgcagtgctgggataacaggcatgagccaccacacctggcccaaacttctcgagagtagtagtgtttgacttttgtcttctgtggtgtaattattctctaatagcttgggattgaactctgacatgataaacagtgagtgtatgctactgagagaccaaaaagattggaatagttcacaaagggatataggagactctatttcccaggaggtcctgaacaaagatttacccacttagagtaagtataggcagggatacccttgaagctagaacactaagaggtggcacttatatgactctattcttgagaaaatttattttttccccctcgtggttggttataacatcgaaatagttaaatgaaacttgctctgagttgttatttgtctgccaccctcccctttagagaaactgatttctgaataatttctcttgtacatgcattttaaaggtgtgtaattaactggtaacaggttgttaggtagctgatgaggtgtgaagtagccactaatttgttttctttatttacaactttccctgctcttgaagatgacagcatgatgtttttcattccctgcttacttcaccagattgaaaagtgatttgtgaagccatttttaatccctcaaattccattaaaaaggaatctccaagggagtcttaatcaagacataatagacactaaaatgtgatcacacaacagcacttctaatatggccctatttcaactataatgttaagcgtttgcctccagtttactgaactcagccctaacactgacctacaacttctgaaatgaaataacctctatgcagttggcaattactttattgtaaatgtttgcagctaacatactttattgctttagaatttaacatataccccaaagggataattcgttaccaaattattatagtattatcagtaaaatagtttgctttccccttcaaattgccttttcccctacttaataatatatataatttaaatcagtttaagaaattaaaatggaaacataatgaaatgagaatcattaaaaacaccacactagaatactgaaaatgaagctgaaacagaaatggctaaatgtaaaatttgtatgtaaccaaaaggggtaatttgaaaccagggagcatattgagttattggatgagtttgatgaaaataaaaactctgtccttgaagttttaaaaatattaccaaaagtaagctacagaatatgtaaagaatatatcatggagaactccccttcacccttgaatagacagttaaccaacatgcaacaaagcacagatgttagatacgtggcaacattttcctttctacctgtcagagcctacattaatacttccatcgagaacattgtggcctccaggatactattttcaaatgtagatatgtctcagagcatcaatgctacaagttgctatggtgatcacttttgtatgataataaccaatgctcactgagtttttgatttatggcaggcactgttttaagtgctttatagtattaactcctttaatcttcacaacaatcctataaatctcattaggactctaagaatcctattaggattcttattttatagacaagggaactgaggcccaattttacagttaaaagtaatttggctaaggttacatagtgttggagaaattaaaaacaaaatctcttcccaatctctcagcaaagaaagaagagaaaggtaacagttttattattgaataagcactaaaccagaatgtgatgcccatcacaggcaatatgctaagagattgcaaagacagaaagaaatctcagccttttccatagccaagcagataccagatacaacccattacatacatgttttcttttctcttttttttttttttttttttttgagatgaagtctcgctctgtcatccaggctggagtgcagtgacatgatctcggctcactgcaacttctgccccctgggttcaagtgattgttctgcctcagcgtctcaagtagctgggactacaggctcccatcaccacactcagcgaatttttgtatttttagtagagatggggtttcaccatgttggccaggctggtctcgaactcctgacctcaagtgatccacccgccttggcctcccaaagtgccaggattacaggcatgagccaccatgtccggctacatatatgttttcaagataaataattatagtaagaggtctgtcagcactatttgtcacacatagttatcctcattttacttgatattttgtggtgttagctaattggctttatccagaagaaaaaacaagcatctcatctctttataataggaggtagttttgcagcttggagcaaggtatctaccaaagttaggctcctaccttcccacagaagacaggggtactatctcctctgatgtttacatttcaaagagatggctcctaggtcttaaaagtgacaaaaggcctatcattttcaaatggaattttatacatttcaaagagaggaggaagtccttacaattagaagggtttttgttttgttttgttttgataaatgctttaagaagaaggagaggatgaaaagtctcttcctttattttcatttttttctttcttttctctctctgtgtgtgtttgtgtgtgtgtgtgtgtgttttgtttttttgagacagggtcatactctgtcacccaggctgaagtacagtggcacaatcatggctcacagcagcctcgaacccctcagattcaagtgattctcccacctcaggctcccgagtagctgggactacaggtgcatgcctccacacccagctaatttttgtatttttcatagagacagggtctcactatgttgcccaggctgatcttgaactcctggcttcaagcaatctgcctgcctcagcctcccaaagtgttgggattacaggcgtgagcccctgcatctggccttatttttaatttgcatttgtccttacaacagataataagtagtggagttaggatttaagatagtctagctttaatttttttttttttttgagacagagtcttgctctgtcacccaggctggacgcagtggcatgatctcacctccacctcctgggttcaagcaattctcctgcctctcagcctcccgaatagctgggaccacatgcacgtgccaccatacctggccaacttttgtatttttagtagagacggggtttcaccatgttggccaggatggtctcgaactcctgacctcaagtgttccacccatcttggcctcccaaagtgctgggattacagacatgagccaccactcccagccactttaaagcctttttaagaatcctatactatgccatctttgtaagcttcctacttggaagccattgaacagaggcaatatactgaggaaattaatatattcactcaacacttacttaatgagcacctactatgtaccaggcactttgctagttattaaggatataattatgaataaaacagacaacagttttgccctcatggaacttagggtctaggtggagagactcatattaaacaaatagttcttcaaggttatcaaacaaaattatgaaaactgagaagaatgaaaagtataaagagttttgagagcatattaaagagagaatgtcaactagtccaggtggtcttgagggctatttaagttcaaaataggagttttgatgaagaagaaaggaagataacaaaaggataatttgaggtataaaggaaaacaaaaaaaatctcaggacccctaaacttcttattgcaaaagaggttaagctgcgaggctgagttaggcaacaccctcttccaaatgaacagctgttactaacatgcatcagccagatccccatggaaagataaaaggcctcaagcatctatgaagggctgcccccacacatcattcataagttctttgccggtctcctataaacaaggacatgccaatttaacttaaggtcttcctaaaattaaagtctgttcagttccacactgatagtgtagtacaagtttatcttcccaggtgcagaacaaagacaagactcatttctccacctagccagtgatgcctgcataactgaatcttcctttactccctttttctcttcaaaccttcaccttatcttatgtaaaatgtagattgaccaggcactaaccaaagtcccccgggaatgtaaccattcgcccgacctcctacctgcccctcttcctacactccttcccaactttaagaaaatgtataaatacgaaaactcttgagagtctctttggaaaaaacagccacagatgtgtctgtggcttgtgtttttcccagacgtgcttaaagctggcttaataaaccttgatgattgagatttgtgcctcattttggttgtcccagctttggggtattagattgggaggaataggattaaaaagtaggaatgctaccaggcacagtgactcgtgcctgtaatcccagcactttgggaggctgaggcaggcagatcatgaggtcaggagtttgagaccagcctgaccaacatggtaaaaccctgtctctactaaaaatacaaaaattagccaggtgtggtggtgtgtgcctgtagtcccagctactggggaggccgaggcaggataatcgcttgaacctgggaggtggaggttgcagtgagctgagatcataccaccgcactccagcctgggtgacagagcaagactccatcaaaaaaaaaaaaaaaaacaaaaaagtaatgccacactttgaacacttattctgccggactgaaataatatcatttgatagcacacatagaggtggaaaaggaatgatccttttcctccccatcataaagcatcatggctgatgccccagtttgggtgctcagaaacagatgccccaaaatatgagactcccccatctcaaaaaaacaaagttgggcactgttgattaatattttaaatgcttactcattatttttctagtttattcctttaatattttatttcattttttatttacacaagtagttcatagatatacaatttacacaaggtgctacagattgaatgtttgtgcccccctccattcatatgttgaaatcctagcccacaaggtgatggcattaggaggtggggcatttgggaggtgaataggtcatgagggtggagccctcatgaataagattagtgtccctataaaagaggccaggagaaatccttcaccccttccatcatgtgaggacacagtgagaagacatccatctttgaaacaggaagaatgcatttcacagacattgaatctactgataatgttgatcttggattacccagccttcagaactgtgaagaataaatttctgttatttataagactcagtgcccttataaaaagtccccacagggacaaagacaatagtgttctttatttatttagtagagacagggtctcactatgttgcctaggctggtcttgaactcctggcttcaagagatcctcctgccttggcctcccaaaatgctaagattacaggcacgagccacaccttgccaacagtgatatattttatcttacttttttccccactctattcaggaacttctctgtgattccagatgttcaaagtatttcatcacagctttatttgtcttaaatccagatgtctttcgttaaatgaaaaaatgagcaaccaccaacaagctgagattatcttcttccaatgagcaatgagtcagaactgggctggactttcagtgatccttttaattttattttgtttaaatgctattgggagtaaacccatgaatgcactgtgaccccagaaaggcatgaagggcaggagaggaagaattagctatgagcaaatggggaaggcaggcagtgagctgctttgcattaaaattctaaaagttggttgtggcaggggacaagtgcccggagagaaagagaatgtaagggaagtgagccaaataataa

SEQ ID NO: 864 - DNA, 423052 bp, Homo sapiens
aaatattcctgctatgtgaagtaatcccatgaacatcatatggagacttcatctgctctgagccagagaatcctgtccaatgtggaaaggaccttggaagctgccctggatatcctggacctctctctcatttgtctaagctgttagaatgcctgtatctttgacattaattaatagagtttgatactgggcaagatctctaatgcatgtttatcagatttgacagtctgatcctgtatgtttgctcagagaggaagagcccagtgtggctgctatattgtgaatgggaggagaatcataaaaaaaatgatttcagaggcttaacgagtagtcagataatatagtcccctgtaagacactgtaaggcctttgacttctgctctgagagaggcgggaaaatattgaagggtttggagtagataagtgacatggtaattgttactggtatcttcaacaaatactataaggtgccaaggacagaaataaggagactagttaggaagctgtaataagtaggttaaagatgttggtggctgggagaggtaaagttagtgagaagtacctgtattctgcatatattctgaagaaagaaccaaaaggatttcccaacagattggatataaaatatgaaaacaacaaaagaaagaggactcaaggataacctcaagttttatgccctgagcatgtgcaaggataaaacagctatttgttgaaatgaggagaaccatgggaaacagcttaaataggaatgaggaggagttcttctttggatatactgggtttcaaatctaagtaaatatcgaaatgctgatgagaaggggaccattggatatatgagtctggatatataggaaagaagtctgggatagacagataaatttgggagtcatcagcatatcaatggtatttttaaaccacaagcctggatgaaatcactagagagtcactgttactagggaagaggtccatgaactgatacctagggtgctctaattattagagatcagtaaaaggaagaggagtaagcaaagatgactgagtagcgactagggaaattagtgaaacactaggagcacatggctttactggaagccaggggaagaaagcatttcaaggaagaaagaatgatcatctgtgcctttttaacagtaaagaaaaacgaggattaaaatttgtccattggattttgcaacatgcaggttgctggtgaccttaataagagatatttaaaaggcaaaacacatccccattttagatatctaaaaataattcctaaggttctggctaggataaatgggtaggtgataggctgcagatggacttagtgagtacagttataatactccatactcagcttcaaagtatgaggaaaaacacccaattacatttctaactaatgaagtgttaacacttaaaatgaaatttaaacacattaacacagaaaatcagggggaaaagtctcacatcatacagtttactatttttaacctgtctcttcttaaaatgagatcatgaacatcacctgacaagggcacgggcccatttacaaacaaaattttcttggattaaagggcctcctctgtttaagaggagagatccagatttaggtctataagcttgcccaacagtgtcaaatcctctgggtacagaagatatttccaaatcagacatttctgctggaaacagcagatgggaattttgttttattttatacatacccttttggcaaatatatctctgaaaaacttgccctgcagaaactaattgtctaagcaagattttctttttttttaggttttcgcccaacaggaatcaaatctgtgaatagagaatttaaggctggatagcagcactatttttgacttgattacaaagcagaaacagagaagaccaggcactgactggctagttgcagggaagattagacggtgagattggcatccagggaaaatgcacggccaactgggaggctgccccactaccttaatgccagggatactagatatggaaacagccaaccatttccagactctgttgaagaagcagttttctcatattggtaaatgtggctcagggtggataaagggctaaatctcccagaagtgaagttttggtacccacagttgtacagcatgatatgctgtagggcaggaaccaatgggaaaggacgctgatatactgaattccccctattaaattccaatcctttgttaccttcatctttacctgcatctttgttacctgcatcttgcaaataagcaagagttaactgtttaaagcaagcaagcaagcttgtttacagatcattgaaaacaattatcaacttgatgagcttcaaagagctgtgggataatttagtactaatctaaagagatagacaacatttctaaaatgttgcttattttagcagaaaacagtttaaggcagattccttcccacatggttcagctgacagccagctgcccacataaattcacgtgagtacattctctccaactgtctctgaacatagaataggctatattactaaaagcctttttctgttggaaatgtattctattaaacactttttctcctaagcctcagctgcactttcatgagcagtatattgaacccaaatcaaaatctctactttgtgttgagatctctgattctcaatggaatctgataaatatcaatttgatttaacaaaccattttggagcagtgataatttgtcaggagctgtactaatgaaaatatgctttagagaccaattcttatcatcaaggattgaaggatggggtgagcaaggacaaaggaatcagaaaaaaatttcatggaagggacattatttgagatggactgtgaaacatggctagggtttcaaagggtagaagaacattcctaaaagaaaacacaatgtgcaaagacccagaagggcagaagcactgagtctgcacaggcccaagaaaggtctgcttagaaattgctcaagatttcagagtagcagagtgagatgatccaggtttgattttttgaaaattagactaggggcaggataatgaaagctctaaaaatatgagaaagaaagagaaagaaaacaagcatttgtggtcaagaaaagaaggggtttctgtttttattcagggaaatttaaaggaaaatagatttttgtaggcattacaggattaaagtctacatgactgggttaatgactgattacccaagtcagtgaggccttccctaaccaatctatcctaaaatcacagcagcctgctctcacacatgggggcatgcctcttttagagttgatttttgaaatagcacttaccacaacctaacatactttaaacatgtttaaacatatattaaagcatattttacttacttagtttattgtctgtcttccttgaatataatgtaatatttatgagaacagtgactgctgtatctctacaaacataagtaataactaattcactaaatgcataaacacatgaatgaatataaaaatgactgaaatctaacactgtcattaaaagaaaccagggagccaggcacggtggctcacacctgtaatcccagcactttgagaggctgaggtgggtggatcacttgaggtcaggagttgaagaccagcctggccaacatggtgaaaccctgtccctattaaaaatacagtaattagccaggcatggtggcatatgcctgtaatcccagctactggggtggctgagacaggagaatcgcttgaacccaggagacagaggttgcagcgagccaagatcgcactattgcactccagccttggcaacagagcaagactatgtctcccaaaaaaaaaaaaaaaaaagggatctaggttctatctccagctctggcactaagaacatcagtttaggcaagttacttttcttccataaagtgcatttccctcatctataaaattgaggcctaactgaacttacatacacccactgtaaaattagactaagtccccagttaaatagctaagactacggcattttcctgccagacatgtgaaattgccacatttttgtcatgccactgccctcttatacacatagttaaaatcacttagccagaaagaacttatgatgcaatagacatgcttccatttaaaggaatgtttacaaacagcagctctcctatttcttgaatcaagctcagcatgagcaaggtcacagcctcattcagatgaagaaagcaaagtcaaggcccgggtgtctttgatcaatttctctaccctagctttcccatgatccagaaagtttgtttccccaaaggccgcccttaactgattcaataccatgttttctggatgattttgatcataagtttggtctgaggatcacaactacaaattcaattcttccatatgtccaaaattccctttagtgctaacgtgctatatttccataaatttttatagaaacttaccaagctgtggggttgataatctttctttcttcttaatacaaatgcatcatcagaatacgcatggtctcaaacataccttttctgaggcattaaaaaaacatagtgatttaggggaattttaggtaatttgaatgggtaataaaaaacaattgtaaagtcctttgaaaatgtaaaattactaagatttattcaatgtcattatttaaacataccctaatttgttattatttaacatttgtttcccagttggtcagttatggctgatgagctgcagggtgatgggaacttcatgccatctgtttcattgctaggagcgctagtctccccaggtcacttactgtgattataaacatggcctcaaaggaaacagtgactccatgccctaagaggccagaagctcagattttcttctcccaattctctcaccgatttactgggcaacttctaaggaggacattcttaaccttgaattatcttttgacccaatctttaatagacttaataggggtaatattttttttcttttttgagctttcagattatattaactttttttctatatactattctccaggggtaatattacttctcatccataaaggtgtttgctggattaattaaaatattattccaggatagaccacaaattgaaatgtggaacaatgatcattccttcatgtctatgagttcatgagtcattgtataaaaatagtgtcggttcattctctgtatcattacagagtatctttttcaaagaagaagtagtaaattctggcccattcatgcctgtatgctatctatttaagtatggtaattcaagacattttttaattggcactaattataaataataaccccagcttcacaaaacaaacagaggaagcagtcactgatacatttactttagaattagacaaaagtctctgtccccaattttctcactcatcaacacagcaccaccatgatgttttaaattctaccattagagatttatctctctatgtgttatatattattccccccaagacattctcttttaaaaagctgatatccctaaaaggagtaggatattaggatgcaaccaatcaataacattgtgtgaagtctcacagggtggaaggaactcaagagtattagatgttttgtggatagcagagatagaaaagggaggcaggagttgtcttaagacaaacttcacctagctcatggttttgcccaggaacaggcttcagctatgtggtggcagcaataggaaaacaatgccaaagaggtaaacttgctgggtttcaaaaattttgtttttgtcgtttatctaataaaaaaaaaaaaaaaaaaaaaggagccagaagcgaaaactacattcccagggtagagatatgagttaaacttcacatttctctttttttttttttttttttttttttttttttttttttttttgagaccaagtcttgctctgttgcccagactggaatgcagtggcatgaacggggctcactaaagcctcaacctcctgtgctcaaacaatcctcctcccaccagcctttccaatagctgggaccacaggcgagcaccaccatgcctggctaattttaatttttctattttatgtagaaatgcaacctcaccctgttgccctagctggtctaaaacccctgggctcaagcaatcctcctatctcagccttccaatacctgggattacaggtatgagccactgcacctggccaaacttcagatttctatacaaactattatcttttctggtccttggtaaattggaggcatctgcaaatattgtccattttttattacttctaaagtaggtggagcaaggtccagttactgcatagggcacaaaagtaaggacaatacagggagagagggctcaggctctgcctatgctacttctgcctacaactgccagtgtctgagatccatacctagtcatgagttgacagggcactggcagggcagagtttgtggcgataagaggcttcactgtaaaattttttatcaaaagcagcatctgctcatttaagaaacacttttatctgattcatttccttgtcccaacaaataccagtctttttcatattattatattgtctcatcatgctaagacactatataaataagcattaataaatgcaatccatatagaaagacattattcatatggaaagactgaacaaatgatagaatttttaagccaaatcaagtatatatcatcttgaaagacatgcaagtatgcaaataaatgtaaaataaagtggcaagtacaaaaattatatgtgtttgctatatactatggactctccagaaacagtgccacttttttcatcttataattaaaaaataaaaagacatattcactgacaagtattattaaacacactatgaatacagtattttcttctgtatgtatatgatgttaaatgcaagttttaattaatggtagtatgtattacagttttttttaaaaaaaaacaatgttcacatcatgaaagaagatgtaacaaattatgaaattatgttatcaaaatatggaattatgtgtttaaatccagttaagccccagtatcctatctaaaagaagacctatcaaatgcaaactcaccacacagaaatgctatcctaaagtatatcatcaaaatccactcagaaattttcctggagttgcaccatttttggctacctatacctgctctaaggagaagctcttatcatgttctgatttgagaatacctctttcaatattggctaactcttcttgtctttcaagattcagggcaggcatcactctttggtactgcatgttattatattaacctatacaaaccctattcctattgtaccatctttgtgtgtgtgcatgcatgtgtgtctgtgtgtgtgtgtgtgtgtgtgtgtgtgtgtgtgtgtgtatcctccccactgatttgaaaatcaccgattttcttttcctagtgcctacaatgtagctgccctaattaaatgggggaagagaaagctggcttgccttttatttaaaaaaataaaaaactatttcattcaaagaaaatgtgtcaagtgaatgtactgtagcacagattccattacttgaaagttatcattacctgtctcccattatgataaacttcagtagtgccttaaagaaaccttttcaactgatctgcttttcattttttaataatgttcagtattattcttgaacatagtgacagaatgcaatcctaggactgaagagtctaaatgtattctatttgtcatgagtattgtatttagtgacttgaattcttttttatgtagatgtagtccatcagttatcttatatatttatcagagttcactataaagaaaaaaatttctttaaaaatatgatgcagaagagaagaaactttatgctattatgtgagcaaattagctgtcaaaaccaactttaaaaggcttaccaaatagcatcctaccctttggaaagtagttgccaaggtaaagagtttaatcaaagtaatttctacatgatgcctatatttcaataatttatgaacggtacgtttgaactgaaaagacctccatctaataaaaacacaagtatttatttgtttttattttcttactcatagaattttttctttattcctctaggaatatataacaattggattttgtttatgccaactaacatggcatctctaaaatgagcacttatcttacatgaacaatttttcaaaatcttagtgtaaagtacagtctcaggaccacataactcccgctaagactattatatactccattaacatactgatatggtttggctgtgtccccacccaaatctcatcttgaactgtagttcccataatcaccacatgccatgggagggacccaatgggaggtaatttaatcacggggacagttaccctcatgctgttcttatgatagtgagtgagttctcatgagatctaatggttttataaggggtttttcccccttttgcttggcacttctccttcctgttgccatatgaggaaggacgtgtttgcttccctttccatcatgattgtaagtttcctgaggcctccccagccatgctgaacggtgaatcaattaaacctcttcctttataatttacccagtcttgggcagtcctttatagtactgtgagaatggattaatatacacacccaatggaagaatggacaaaagctgaataacataaaattcatcacaaattaagactgcttttggagtaaaataatgtaaattacacttatgccctcatgctgtatttcactgctttggccagtggttctcaagcttcagtgtacatcagaaccacagggaaggcttattaacacagattgttgggcctcacattcagagtttctgatatagagtaggtcaaggttggggcctaagtaagtccatgtctaaattccaaacatccaagtgatgctgatgttgctggtcacgggaccacattttgacaatcagtggcccaggtaactacatccacacagatgcctgccatgactccaaatccacctctcaggatcaggcttatctatccaattgaccatctggatatcttggagagtccctaagtacaaatgccctacattacctaaaacctatctcagaaaaaaatgacaccaccatgaagcaagttgctcaagttgttcaagcttagaagtcattcttaactactttctctctctggtcacattctattcctacacatgtttccaacctgtctacttcatctctattaccacactaatctaaaccagagtcatctcatgcttggaccacagcaacagcctcctaatcagataaatacaaacactccatttctactttttccccacccgatctgttttctgtaatgcagacagaataactgttataaaacataaacatgatgacattaaaattctccaatgacttcttatatcttttagacaaagtctaaaatccttaatgtggcttcccataacctccaagataaagcccttactatatctcttcaggattatcttgtgtaaactctcccacctaactatgctggccttcaaccacttctcattttatcctccctcagggcttttgctcatgctaatgtctataaacagtctccaccttgcttttttagcaaactcctcatttcttggatctcagcttaaatggcatgtctaatacaaacctttcctgattccccaaaataaataaatcactactatattctcaaaaggcactgtacactgctactttagtatgattaaacacactgaaaattacttggtcatactacaactatttacctcactagctaagctccacaaggaaccattctgtcttgttcaacattttaatctcaaggcctgtacagtgcttcacacatagtaagtgtcccaaactaggcactgattggctgatacatagactattataaaaatttttatgtgttaatagagaagaggagcaaacaaaagtagaaaagagctgaccaagttcacagaaatgtccagccatgggcttattcccacaggacatccccaaccttttcaattgggctcacctagcccttttctttgggcccacacacctcagactctaggaccaaaattggcaattggcagaaagatagagatttcaaagtcagcttttcatttacccagtaagatcacctcagattataatacagaagtacatagcaagagtacagaaattagctaactgatctagatgttggaggaggtgacaatggagtcttgatagagtataaagaacattacaaatggaagaaacacctagatcaaagtccagaaattaaaaatagctcagcatcctgtaatctcagcactttggaaggtggaggcgggcaaaccacttgaggtcaggagttcaagaccagcctggccaacatggtgaaaccccatctctactaaaatacaaaaattcactgggcatggtggcgggcatctgtaatcccagctacttgggaggctgaggcaggggaatcgcttgtacccaggaggcggaggttgcagtgagccgagatcatgccaatgcattccagcctgggcatcagaataagactccatctcaaaaaaaaaatatatacatacctcagcaatgccgaaacattactggaacactgaggtataaagcccaaagcagtggaaattttgggctgcacgagaaagacagggatcagatcatgggtagccttatttgacataataaggaggttaccatgagctcatagcctaacaggaaaaatatggaaaactagacatcatacataataataaactctaaaataaaggaagtggccggatatagaacaacagttatcctgccatgggtatggggtcatcatgaacaaagcatacaaacttctaccttgaggatgcagggaggtgcacgtgcaatattgtgagattcagagataggggacattcattccacctgatgaaggaacacttcccgagggagcaaggtctgaaggggtcttaagttctggatatacagaggttacggttaggaacattcaaggctcaagcaaaatcatagccaaaaccacaaatattacatggaatatttctggaattaataattatgtttggctggagcatagtggcataaagggaaggaatgaaaaggatataaataaaagtaggtttgatcttaatactgagaggatgcaaataccaaagtcatcagtttgatttataacaaactccattttttattaagaactatatatacttcttaaattttatggaaactaataacttgcctacagtttcttcagtcaacatataattttcaaagtctttcatgggaagaaaatgtgcttccctaacctattctttatttactctgccaatgacacccaaaattattacttccatctgggttttaattacacctgtttttcccagggggaaaaaatcaatgtaaatccaaataaaatatagtagatagttctaaaatgtaattagtgataataatcaagcaattcctacaggaaaaatttacaagtctctgatctggtaggatcaccttttcaaaatgggaagtcatcattacataatatgaaacattaaaacttccattaaaaggaaggctaaaatgagtcttaaataagatgcactcatattaagaatctttttacagtaactgaagagaatcttaattattttactttacttgagcctctctaaaaaccttattgccagtaatttgggctgacgaatgtagtcaatacagaagagcctcaattttaacacttctccctcaaagcctgtccctcttgtggttttctgataggctattgttagattcatttacagtaaaataattaccagctccctaagcaagacacatagcaggttatctattgtcccttagaggactgttggactgttcttaacaagcatactaaattacaatagcagctttattgcaattaacaaacagacatgaatcaccaatccagttatatctcaaaagagagaagggttttctgaagtatactgctgtggttgttttctgaacaactgttttgtaatcctaaattcaaagacccgtatttaagcaaacaggcacatgtcccaggagcaggcaacacagatagaatagtttttcttgttattcccaacagaaagagtaatagtataatgatttagagaattaacagagtgcagacatgaaaagataccagcattccccatcagtacgtaaagcactcacgcttgatcatttacagctctgtctgcttgacatcttccagtctctgatcccaaagcagtagcaccaaggcgcaactctgcttcttcatttacattgacattctaatctcgagatgtgtcagaattaaagttggcaagtttccagactatttgaattctttcatgttgagaaaaatgcaattgcactgtgcatattcataggaatcccatggaggctcccagaggatctgctcacagagacaaggaatacaggtcagtgcctgtaagtcaatgagaccacattgcccactcataagaggtggagggacgctaatgagataagagacttggcccaaatgcttctctacaaataacagcaaagcactctcacacaaacatttctaccaacaaactcaaatatttccgaggagaattagcttgttaaaaagaaagtttatgttctgaattgaattcctaatggttttgaaccagaattactgttcccccaactagcatttctatacttgggctacttcctacaagtaattcacactccaaaaacagttgtgggggactggtgaaggaaagacagtaattatactgaaaatgtaataatacaaaattcacttctaacaaatcagatacaacttattcagtgtgggaggtgtgcatgagttattcacaaggtaacacaattaagttttaacatacaattttatagggattgcactgaatcggtagatttaatgataatgattcttccaatctgtgagaatggaatgtttttccgtttgtttgtgttatctatgatttctttcatcagtgttttgtagttctacatatagagatctttcacttccttgattaaatatattcctaggcattttttaatagctattgtaaatgggattgtcttcttgacttggtcctcagctagattgttattggtataaagaaatgctgctgattcctgtatattaattttgtatcctgaaactttactgaatccattgatcaattctaagagttgttcagtggagtctgccgggttttctaggtataagatcatatcatcagcaaacagggataatttgacttcctcatttccaatttagatgcctcttatttcttaatactttcaacttttccccattaagtataatgtcagctgtgggtttgtcttatattttctttattatgttgagatatgtccttctaaggcctagtcttttgaggatatttatcatgaaggggtgctgaattttactgaaggaaatttttgcatctattgagacgatcatatggtttttgtccttaattctgtgtctgtaatgtatcagatttaccaatttacatatatcgaagcatccttgcatccttgagataaatcccacatgatcatggtatattaatctctttgatgtgctgttgtgttctatttgctagtattttgttgaggattttgtgtctatggtcatcagagattttggtctgcagttttcttttattgttgtctccttatctggctttgggatgaggttgatgctggcctcatagagtaagttaggaagaattccctccccctcaattttctggaatagttccaagaggattggtattagttcttctttattatttggtagaattcagctgtgatcccatctgatcctgggcttttaccaatgtcatttttcacagaattagaaaaaaaaaatcctaatattcatgtggaaccgaaaaaaaaaaaaaaagccaaagtaatcctaaggggaaaaaaagctagctgcatcacactacctgacttcaaattatattacaaggctatagcaaccaacagagtatgggactgatattaaaatagataccaagatgaatggaacagaatagagaacccagaaatgaagccacatacctacaaccagctgattttcaacaaagtcaacaaaaatatacactggggaaaatgccaccttatttaataaatggtgctggaaaaaatgaatagccacatgcagaagaatgactggacccatacctcctttcaccatccacaaaaattaagatggattaaacacctaaatgtaagatctgaaactatgaaaatcctagaagaaaacttgggaaaaactcttccggacattggcctaggcaaatactttatgaccaagttctcaaaagcaaaagcgacaaaactaaaaatagacaaataggatttaattaaactaaaaagcttctgcacaacaaaaggaacaatcaacagagtaaacagacagtctatagaatgggaaaaaatatttgcatttgacaaagggctaatatccagaacctacaacgaactcaaacaactctacaagataaaaaaaaaattaaaaagtgagcaaaggaatgaacattttccaaaagacgtacaagcagccaacaaacacacacaaaaaaatgctcaaaatcactaatcatcagagaaatgcaaattaaacccacaatgagataccattttacaccagtcagaatgactattaaaaagtctaaaaacactgtaattctggctattcaggtggctgaggcacaagaactgtttgaacccaagaggcggaggttgcagtgagccgagattactccaccacactccagcctgagacagacagggaccttgtctcatttaaaaaaaaaaaaaaaaaagtctgaaaacaacagatgttggcaaagatgcagcagaaaagggaacgcttgtaggaatttcagtacaacctttatggaaaacagaatggagattactcaaagaactaaaaatagaactactattccatccagcaatcccactactgggtatctacccaaagagaaagaaatcattatataaaaatggtaactgtaatttgtgtgtttattgcagcactattcacaatagcaaagctatggaatcgacctaagtgcccatcagcagaagactggataaagaaaatgtagtatatgtaacactacattatgctattcagccataaaaaagaataaaatcatgtcttttgcagaaacatgggtggaactgaaggccattatccttagtgaaataacttagaaagtcaaataccacatgttctcacttataagtgggagctaaacaatgggtacatatggaccgtggagtaaaagacactgaagactatgaaaggtgagaggatgggagaggggtgagggctaaaaagccacctgttgagtacaatactcaatatttgggtgatgggtacactgaaagcccagacttcaccactacacaacacatacatgtaaaaaacttgcacttgtatccccaaatatacaaacaaataatttctttgaaaagttttaacatacacatttacagtgcttctcaacaatttctgccctatggtatatagagaaaattatactctttatatgagacatgagtaaacatggtttgtatgtgcagctggagtgaactagcctgggggctccagccactctcaaactcttcatctcttctccactcccaacaattgtttttgtaaaatgacacacttttattgtcaaaaaaacacagtcagatcagatagttttaaaaatgaatgtcaccatttagagataaccattgtcaatgcttcactaaaacatcattccagtttctctctacacatatacagacacatcagttgcacaccccagttgtgaaactcagtaataaggcatgatttacacatatttgtattaacgctccaactgaagactttttcatctttaagccctgaaagtgagaaaggaaaacctaataaagtatgatcttttgttaataacatgttttataattttctagctcatatatattgttcttgctctaccttccccacatacacaagtaatctagttttctgtgatcaaaactatttccttgaaatctacacccaacttgtacccagaaattagatttaaaactctacctctaatccaacttttaagatatcttgttcttaacagaattagaaatattcattttaatggtttctaagtcatcagttctatgagaatgaaatattttcccaatccttaagacatgaaacatgaaaaaaaaaatttcaaccacccaaataatccataaaaatcaattaacctaagtagtctattgagagcaggtcctctgtgcagttttgataatcacagacattgaaaaacattattgtatttgattttactttttatctcccaataacaaatcttatacagcagaggctattttatggaagtgataaggtttacgccagattttcaaaattgggtaaaatgtataaaacagaagaataaaagcaaagttggaactaatgtggtcttagcctgattcaaaaagctcactgtaatgggttgaatagtgaacccccaaaatgatatgccgaagtgccaacttccagaaactgtaaatatgaccttatttggaaaaagcttttttgtaattaacttaggatcttgagataagagtactgtgaattaagatgggccctaatccaaagacaagtccgttgaagagaaggagaaacaaacagaaagacagagaagaccatgtgaagactgaggcagcaactaaaaagctatttctactagccaaaggatgccatcttgagatcctaagtgaattacgaaaaccctttttctaaatattattgtctcaattttacagttttgtcatctatgaaactaaggcaagatttctctgacttgatatcacataggaagggacaaagcaaagatctgaactcaggaagtcgggtgcaaaaacatgtgcttttaattactatattataacctcttttgcttgaagaacaaagtggaccttggggtgtaaaggaaaataaacagacatataaagaggccaggttacagagacttcaaaatacaaaggattttgtccatgatgcagcatatagagaacaaacatttcgggcttttaatgcattgcccagttcattgcattgactccatctccaacctctatcttgacctatccagttttctccatctttaatgctgactaacccactagtgtcaaccttcttagtagtctcctacttctactcttgcctattcaaactattctccacaaataagccaggatttatctatcttttaaaaacaagtcaactcactcctcttaacaccatcaatgacttcacaggactcttgaaacaaaataaaactccttgccatactctagcaaggccctaaatgatctggctttcccttcgacatcgtctcattattctcatccatcattatgttttagctgtcacagcctcctttctgttttacaagcatgccaagctcttccctattcccgggacgtcacatttgttgttccctctgcatgaagtccttttttcccagttcctgcatggctcattcacatccttcaggtctcagctcacataacatctcctcagatgtcttcactcttcacctacctaaggtggtctcttaagttatcccaagattgtatttattactaccaaagcccttatcacagtgtgagaatatcctttatatacttgtttactgcctatcacaacacagaacagaaggcccaaggaggcagaaactttgtccagcttgttcaccacagaaccactgtacctaaaacagtggttggtacacatcaaacattttagaaaacattagtggcaagcaaaaaaaggaaatgtcatgatgaactggtcttccgagaaacttggtctaggaagtaacgtacaggatgacttcccaaaagcacagactaaagaaacagacaaattaggcgcctcttactaaaaacttagtaataagtgtttaaaggcttggataagaactgattgagtaagaacaacaaagaaaggagtgaaattggccgggtgcggtggctcaggcctgtaatcccaggactttgggaggccgaggcaggcagatcacgaggtcaggagatcgagaccatcctgtctaacacggtgaaaccctgtctctactaaaaatacaaaaaaattagccaggcgtggtggcaggcgcctgtagtcccagctacttgggaggctgaggtaggagaatggcgtgaacccagtaggcagagcttgctgtgagtggagatcacgccactgcactccagcctgggcaacagagcgagactctgagaaaagaaagaaagaaggaaagagagagaaagagagaaagagagaaagagagaaagagagaaagagagaaagacagaaagacagaaagacagaaagaaagaaagaaagaaagaaagaaagaaagaaagaaagaaagaaagaaagaaagaaaaagaaagaaagaaagaaagaaagaaagaagagagagagagaaagagagagagaaagaaagagaaggaaagaaagaaggaaggaaggaaggaaagaaagaaagacagaaagaaaggactgaaatttagaaacttgcagaagataaaggcaataaaatttagtaaccccttaaatacataggatacagagactaaaaaatgtggcaagtcaagaaactgtcacaaacctcacagcttaggttacatggaagacttccatagcatttgaagtctatactttatatacttcataatttaacctttattttatccaacaggaccaaacactaagtacccaacagagacacttgggaggcatagtaaacttcacagaggtgccatcacccaagctgacccaaaaaataaccagttatttttgtcaaaactaagaagacattaaattattacatccacgtttatcagaaaatgtaccaacattctgtacaccagcattatataaatgggggtactctgttataagtcaaggataggaaatgacatcaagtggcaccaaaaacaaacaaatttgatttcatacagtgaagagacagatcagtcagagcagtaaacagctcttctctaaaggtgacagggtactggaaagagaccacaggaatggtaggacaactaaggttgtttttatagaaatcatgaaatgttgttaagctatagcaataaatgtagcataattgttgctaagttatttagtattattttctttttttaaaatacattcaagtgtaccatgaaaaatttcagtattcaaagctgtgtccaaaagagaaaataattgggaattgctgaccttcaatatttcaagcattgtgctaggtagtggacaaataaacattaataaaacatagcctcataaagcttataagactaattggctatgatggaaaacaagcacacacataaaaaaattatagaaagaagcgtgacagatcaacttctggcatgacagtatgaggatctccactgttctggtctcccgtgaaactggttaaacaaattttttaaggcaaatgatcttcagagcagacagcaaatgaagaaatatctgttcttacaaaaatggaaattcggtaagaaagggaagagtatggtatttgaaccaagactgctcccttactccccattcccagttcagaaataaagagggaacttttgtaatgataaaagagccaatcaatcaggaagttatagaaatgataaacatatatgcagccaataatgatgcacttaaatatttgaaataaaaactgacagaaatgaagggagaaacagatgattcaacaataatagttggaaatttaaataactctttttttgattttttttttctttttaagacagggtctctctgtcacctaggctagagatcagtggtacaatctcagctcactgaagcctcaacctcccaggctcaggcaatcctcccacctcaacctcccaagtagctgggaccacaggcgtgagccacaatgctaagctaatttttgtgtgttttatagagactgggtttcaccatgttggccaggctggtctcaaattcttgggctaatatgattcaccccctcggcctccctaagtgctgggattataggcatgagacaccatggcctggccaataactcactttcaacattgcatagaaccactaactagacagaagatcaacaaggaaacaggagacttgaacaatactataaacaactaatctaacagacatcagtagaatactccatccacaacacctgaatatacattattttcaagcacatgtggaacactgctccaggacagatcatattctaggccataaaaaaacctcaatgaattaaaaggataaaaataatatatgttctctgatcacaatagaataaaattagacatcaataacaggaaaaatgtggaaaaatcataaataggtagaaattaacctactcctatgtaaccaatgggtcaaagaagaaatcaaaaggggaatcagaagaaaaacaattacagaacattgtggtaaatgcaagaatgggagctagcaaggagctaaatgtgcatatagagttgacactaattctacctaggaaaatgcaagaaagaagaaaactacagaacagaggaagtaacatttaggcaggtcttgaaagatgaatatgaatttatgtggcaaagacagggagaaagaaaatgaaaaacatggaagcagcttcccaaagcagggaggtgttgaagtgaatgataaaatctgaaatgatgagcagttaggagtggctagcatgtagggtatgtggtaggagaatggcagtcgaggaagacgagctggaaaaagaggttagggccagattgttaataaacaagaacactactccaaggggcctgggctttactttgggtaacaagacatcattaaagttgtaaaaagagacatgattggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagagacatgatcagatttgcatttcatatcatattctatgtcacagtactcatgtatattaccattttctcctcagtatatataacaaaagtttttcaagacaggtaaaataccctgtagttctcatggctctgccacagttacgggctcaatgctgggaacactgcagccatctaaaaaaaacagttactttttcactgcactaatagtacaaaacttctagatatattttgctcataaactgaagaactgttcttttgtttgcaaattcagttagccttgctgactattcaatataactgaaaaaaatcataacttgtgtttccatagcttttaatgtcactgaaagaagccttaacatcctcttctccttcattactacattactacagccacccattgtggcagttagacaaacgaagccagcatttggagagagggagtaggactgagaaattggccaagaaaaaaaaaatgtatttagttcatggaaaggaaacttgaagggaaatccatgattcttagaagtggaagagtttagggaggaatgtttgggaaaaccgtagtgctgacaatgactttgcttaagggtagcaagagtgaagaggaaagacaggtcagtagagttcagaatgactataagcccggggctttaaaaatttcacaaataagaaaggttgcaggcactgagagcaaaaagaaaactggatgaagtgttgccatagaggaaagaaatccagagtgaaatctctagctcagctatgacaatgtactctgtgagcaatgaaagttcaaggggtttttggaatactacaaaactatccatctttatggtggacaaaaagttgcaaatacaggaaaacacactcactctaccaggcattggagaaagtagaacaaaatgcagatctggccacctaggagctcaaatctaatgaaaagggagaaatgcaaattaatatgtgccatcagtgaaacaaggactgatgaggctgtttgtctacagccatgagccacagggtggagtgactgtgctgagggtaaggaagagcttctcagatgaatgagaggatcatggagaatggaaaggagtttgcaccgacagcatcacataataaaggccttgcaaagagaggatatagcttaccctatgacatgaaacagtgtggcatatgaggaggaaatgaaggaacacaaggcaggaaaggccatcaggatgcaattacagagggcttttagtacaatgtaacagcctaacaaacgacctcaaaatcgtatgatcatctaagcaggacaccctgtgaggaaaacaaaaacaaaaataatcagaaatcatcatttacaaaataattagcaatgtttccttgggaaagacctgattgaacagagaaaagcctttaaaatgatcagaaaatgaagggaagaggcaacactaaagttttcaagtttggactgaagtctatgaaatcatgatatcattaagggcgtattctctaaatttcagaacactagcttaaaggggaatcattgaaacttaagggagaaaaaaagcaattcagaatcatacaagaattacataaatgctcatgcaattcaattttcagtgctaagaacagacttccccaaagcagtattcccctggtcaaatcctctagaccctcaccaatcagaattcatttctccctcctcaagacttccacagcatatgatagcacttaacacagtctttcttgtgtctctccaactgtaagtcaatttcctgaggctagagaccacacttaattcatatttgtatacccaacagtatctagattcaataaatgcatatttatgtactgcaaaatattcacagggatactattaaatacaaagtaatgtgcttaatacttctgcatgataaagaatgagagacaacaataaccctgaaagtcctcatatctggtaggggggttatgtatgaaaaccagtcactataatccaaaaccaaggaagaaggttcaatcaaagcttacacttgtaggttgttatgttgtttttcattcattacctacaggattccaaaaggatttttgatagcttacagaagtacatacagtataacactaaaaagactaattattgagaaggcacacataaagaaaaaataataagagaagaagatggagtcaggacagttcacgaaaagtttaacagaagtacagttagagatgcacttggcatcaaaaccaacagttagaagattctcagcaacagttgctcaggagaagtttagctattcctgacactgggacaggacagttaagaactttctcctatggttgttcataagacaaagactatgtaatatatggaccatctccttaagcattccaccacgatcaacgcaataatgacttaactgagattgcgtattaatgaccctcaatctgtcaatgattacaccacactaccactcagtaaaagcaattctcaaagggccaaaactctacgatgatgtggcttgaattaaaagaaaaggtctactccctagcagaatgaacggattacatattcctcagaaatattatgcaaatattatcatagagaccgttttgataaggacaaagtggcatagagtttgagattgtggtctccgagaaaaaacaggaatataaatattctctgttgtcaattaagggcatattgaacttagagaattagcagattaacaaccaggtttgcattacttcatgaaaacaaaacagcagcatgtggagagtaccccactcctaagcaaaggaaggccatgatttctctcagaaaatggtcatggatcctctttaacacacccatcagtgggtgactgaggtcccagagatgtagagcctagtcagaatgatttagggatacacactttccaaggcaggcattcccaatcaccatgctgtaaaagaaaacatttgataagacacccttagaataattcaaattaggcaatgtttcaagataaactggctgcaaaatgtgctctccctagagaagtgagatgacttgctccatggggttgttactatgaaccataaaatatcagaggatctctgcaattgattttagagaaggtgctatgaaaccattcttacagccaataattagatatcagaaacaatgttctttaaagcccacctcaatcctgtctgtggtaataaattaatgataccagcataagaaacaaccttacttttctctacatgggaagaaaaataagaaggagcatatatcctgctcacttaagtgtgccaagccattacgatacaaaatgaatctctaaacgtacatattcctgctttacctgctcagaagtatttactaagcaatcaggaaaacatctgcaaaccctgattttgactgtggtattaagcatcataactgctacgtaaagccaccataaaggcttttgtattaaacaccataactgatttgtaaaggcaccatggatggagggcaaaggatggcactaatatcatggatacagatgtaacttacagtcttttgttccacaaaatcaagaatccacaccaaaaaaaaaaaataaacaaacaaaatatactttaaattggcaatatttttctcaaggtattgagtatgaaaatggctacgtcggcttgctagttttgttcaaagttgttatgaaattaaaaactgccatacattctgattcgggcccagagttggagggaattgatgattatccaataaaaaatgtatataagtctaattacagagaactagaaatgtaaagccaaaaagacagccctttgaaatagccctcaagcagtttcacagacaggagaacttccacggactcccttctgcatgatggatagttggaccaacagaaagaaatattggagtctataaagtttgcagcatttaatcttgcttcataaagctggaaaatataatctatccaaattccaatcaaagagaatctgggtttccataagctcaataatgaaatgccttgcataggtaaacatcaaaaattaccaacattacatttctaagagtcacatgacgattctcttgtaatttattacagattttttttggctggttttcgttcttactgttgtttccaatgcactaagatatatgttaaacaatgtgctatgagagtttcaaagacagcagagatcacattcaattgtagatatgcagccataagcaggaataaagatgtggtcaaagggaagagatattctatgaaagaaattcgtatttggtggatttaggttatttgttaataaaattaactcaagatggattaaagacttaaacctaagacctaaaaccataaaaaccctagaagaaaatctaggcaatgccattcaggacacaggaatgggaaaagacttcatgactaaaacaccaaaagcaatggcaacaaaagccaaaactggcaaatgggatctgattaaactaaagagcttctgcacagaaaaagaatgaacaggcaacctacagaatgggagaaaaattttgcaatctatccatctgacaaagggctaatatccagaatctacaaagaacttaaacaaatttaccagaaaaaacaaccccatcaaaaagtgggcgaagggtatgaacagacacttctcaaaagaagacatttatgcagccaacaaacatgaaaaaaagttcatcatcactggtcgttagagaaatgaaaatgaaaaccacaatgagataccatctcactccagttagaatggcaatcaataaaaagtcaggaaacaacagatgctggagaggatgtggagaaataggaacgcttttacactgttggtgggagtgtaaattagttcaactattgtggaacacagtgtggcgactcctcaaagatgtagaaccagaaataccatttgacccagccatcccattactaggcatatacccaaaagattgtaaatcattctactagaaagacacaggcacacatatgtttattgcggcactgttgacaatagcaaagacttggaaccaacccaaatgcccatcaatgatagactggataaagaaaatgtggcacatatacaccatgaaatactatgcagccataaaaaaggatgagttcgtgtcctttgcaaggacatggatgacactggaaaccatcattctcagcaaactaacacaacaacagaaaaccaaacaccacatgttctcactcataagtgggagctgatcaatgagaacacatggacacaggaaggggaacatcacacatgggggcttgtcagggggttggggggctagggaagggacagcattaggataaatacctaatgtagatgatgggttgatgtgtgcaacaaaccaccatggtatgtgtacacctaggtaacaaacctgcacattctgcatatgtaccccagaacttaaagtataattaaaaaaaaaaaaagcctggaaagacaagttggtggcaaattctgaatgatcttgaatgctatggtaagatttagtgcttaatttgtaaggtaatcgttatcatgatgaactgaacctggacctgaaattataatgagcaaattatctcaagttattctttctgtcgcttcaaagggatatataaatcaaaaggccaattctgaaaattttaggaaagagatccaagctattttgtagacccagaaataaactttatacctactgttctattttgttttgttttgttttgttttttaagatggagtctcactctgccacccaggctggagtgcagtggcgcgatctcggctctgcctccccagctcaaacttttctccagcctcagtatacctactgttcttatgcttggttgttgtgttttaagccttctgtgacctcacggaaattttgatgttgacacagctccaggttttacataaatttaaaggccatttgaattggaatttgattaatgaacataaaacctagtagtgaagttaacactctcttaacatccccaccacaaaagcaaagccttgaattgagtctcactctattcaaatcactcacattcttattgcaaatttcaaacctacttattatctggtagtgtcttctccccagtctgccactgcacatagaaaagaaggacatagtttaattgcttcccatgctcacagcagtaagtccacatcattcttaattttgttttataagagtttttcttcaaatacaaacatcatgctattgatccaccattaggtatcatgtgcattaagtggatttcctgggagtggggctgttgaatcctttcatactccattgcctatcaccctttacaaaaatccctcactgtgcaacacataatatgaggaataagaaaaattaggagaaatattctaaatatatagaagaaggtaaatagactgcctatatacttggtaaattctgatcatatttgtatattcgttggaatgttttaaatgccttcagatgtaattttaaaatataatctgtgtttatttaagcatgattgacttctttttaaaaaaaaaaaaaatgaatgatttaaatcctacagaccctacttatgtcagaggtcagcaaccttgtagaagtagtgtgtgccaagctgccagttcctatttctgtcaagcaagggagaaaagaagcagaagcccaaaataggcaactgagaaatatctgtgatacacagatatgtgaggcctttctgatgaatctattgcaaattgaacttttgaccctgtataaatcccctttttgtgcttcatgttttctgattgcacttatcactatttaatactctgtctctctttctctctctctctcactatatatatatatacaaacacacacacacacacacacacacacacacatatatatatatctaattttctatccacctcccaactagaatgcaagctccaaaacagtagagatttttgtctgctttatattcactatacctagaataatgcctggcacctagcaggatttctgtaaatatttgtgggaggaaagaaggaagtgtgttcaaataaagatcctatagaagttcttcatgtgcatttcataccttactatgtgactttaattagaaaccactccctcccttaaaatccaaatgaggccagctgcttaagaaatggatatcatttctagataaaaagaggcagtggaaagacacagatagtatcttgcaatttggggtgattcaatcagaaaagatcttttgagggaaaaaaaaagttcaacaagaaacaccaagaagcctttgcagaagaccagtggttgcagcagcagctcccatcatctaaatgtcttctttttcaaagggcagggccctcctgggcgatggcccacaaacatctcacagagtccctaaggagttctaccaaactgaatgagtctcctaattacaacattaaaatacctaccatccagtcttacttttgacagatgtccttgtacttttacagagcttagagtgaaagcatctaaaaaaatgtttacctttaacctggtataaggagtaatgtaccttttttcttccttcagtttaaaatccattccaccaaaacctggccgtctacacacaaaatataatgatggttatcaggggccacaggaaaaggatgagaaaaatggtgattaaagggtacaaaatttcagttagagggaataagccttagtgatctgatgcaaaatggtgactataataaataataatgcattgcatatttcaaaattactaaaaaggtagatttcaaatgttttcaccacaaaaaaatgacaagtatattagaggaaggatttgttaattaacagatttaatcattccacattgtaaacatgtatcaaaacataatattgtacccataaatatgtacagttatctgtccattgaaaataaaactaaaacaaaacaaaaaggctttgctaaaggaatctccacaagcttccaaggatatttgaaaagttctacctaaatcactactgtggtgatttaagctctttcttgcctgtccccctgcagtgaagaaagaacagctgctcatcatcactcatataatatctcttcacacacagtgaaaccaagaaaacaaccatattcaaaaatgcctgtcaaaagacaatcgtcctgggaaccactcatggcctctgtgtctatgatttcactgaacttgaagactgtaattaagtccctattcagacttcacttctctaggctaaataaacccaatcctttagactttcatcacatagcagatttctcaaaccttttaataatttctgttggattcctctggattctctccaaattctacataataaaatcatgaccagggcttcaggagaaaaagggaattgcctggcagcctcttaatgttatcctcttacatttgtacagtttgtttttcctccctatgtgaattaccctgcacacatttctacagagctatattcagtagatgtaaatgtactcagtttacatgtactagttcttccaacttgccatgattttttttttgaagtgtaatcctctttttgttttccagagtactggcatcctagcctggttcaaagaaattgacatattatgtgtcactaatgaaaaggaaaaacatcaggctaaagactgtcatctagagagtattattcagaatctacttccacaaacttcccagggtgggccaggtgggtttagatttcaactctgccatttactagtttcaggactgtggcaaatattgaacattttttggagaataataatgcctacttcccagggttatcatgaaaaatgaattgagttaataatggaaagaatatggcagagtgatacgtgctctgcataatactatatatattcattattttatcttctttatggaacaaccattataaccactttgaactactttcacagcacaatggtaaaggccaagagagctcattcctctatagaatgaaactcaatatgaaggatgaaaggctggtcaaaataataagtcaaaagacttaactcttagcatatacctcaccatcctgcttttcagtcagagcagcagcaaggacatgagatataagcaatggtgtacacctaagaagtgcagggaaactcaaaaaatgataacccagtatgagcaaaataaacttagaaaccaaacccctgaattcggctctttccccagtgtattgattgagcattagaccaaaagactgatcaggtataaatttagtattttattttagaaaagaatagcttactgctccaaagataatcaaaatattaatccttttcactttttgtgagagcaatttttgattctaatgtttttaaaaggcatataggtttcaatataaagaagctacatattatttcaaatgaaaaacaagatgaaaatcctaagtagaacagggcaaaaaattaataatgtatttttttcaacgactttcctgacatttgacctcttggtggggagtctacgcagctagcaaaccaaatacgtacctccttcacaaaactactataaaaatataactactgtttgacaaagcacttacggatatgcttcaaaattgctgattgacaaggatataatattatctgtagttttaaaatatttttaacaatgtggttcaaaaaactttccatgtattagattctatgtaatgtaatcttagcagagagaagtcacattcacaacgtgaataaataagaggagagctaacatgcaatttcttccatacaccaggtgctctgctaaacaccttatacaccttatctcatttaatcctcagaacactttaccacaagtgaatggggaaattgaagcttagagaaggtaaataactgttcagtgtaacaaattaagaatgatactcaggaatacataaatcaagatatagatttcaacccaaccctattctgatcatgcaatcaagttagtaggtcatcactagcatttattttaataggatattaatagaacagagaaagaccataaatagtaaaacagaataaacttctttgaaagtcactgctctaaaccactgctatattagaagcaactaaacatcaaagaaacattaatcttaaaagcattcaagaatattcagagatcatttacccttaccatttcactttacagatgaagaaacttaaagtttgggttattttctttacccatagtcatatggctagttggtggcaaaatcagaacaagagcccagggctaacaaaagtatattgatttgagagatgtattataaggcataatttactttgagttaaacagatttttctcaataattacaccaggaacatgggcataaacctaaactgtctcaggaaaaccagaatgagcagtatatagctctagaaattaaccaaaacttgtcaaacaaaagtaaacatggtgagaaaaatgatcgttcaatggaagttttttcaaaacaatgtagttttaatttacatacagagctataagtaaaaataacccttatatctaggctgtaattctttttccgtgttttaatgtttacataatttaaacacgaatctatcagtgaaacaagaagaaaagattataaattttgagcaaccgtggcaacaaaaccatcaggaccttgtcaatgactcacaatgatttcctagtattttccagtgttgataccaaaactggcaaggacagattcaaactaaattgctgatactgtgaaataatgctcaccagatgcaagcgccatgtaatgcaagtgacagtttctataaatataattcataactaatattaattttcaaaggacttagcaaaaactaaaaaaagaaatattttattttcatatgtaattttctcagtcagtatttcagagtgaagattagtatgggtatttcttaccccagctaagtataatgtagcaataaatggacttttcaataactgagaagaaaactaatattttagcctatgaaatcattatgtaaatttaactggcttatactgcagcccttatgacttgaaacatctgttcgatacaagttttctgataatatgtgaagtttcaaactgcatattacagcattttgcagcatatttgtaacatgatggttttgtcctttactagataggagactttcaaggtgtgacctgtaacaaggtactgaagttactacttacttcaccatctgctcatatgtattttcatctaaaattacatagcattcataactatattagaaaactgtcttcacacaatttggcacttaattttatgtgttgatatattgcctgaggtccccaatgcagtatcatgataaacaaggaccacagataagaaccaaaaaggagataaaagggtggtaagttggcaaaacacatatgacaaagcttaagtactgaaattgtggtacagccctaaagccttcacacatagactgtatactcatagtttagacacaagttgaacagattaagagtgcaggtttccctttccacaaaagattagaataagtaaaatggaaaagagtcacaagactgtcacagagaagcatgcagcaaacaatacacatgaaatatgaattgggaagccagtgaaaaagaaggagaaatcttattatacggttattcataagaagtccaaataaagccaacaaaactctctggctgttctagcaggcgtataaatgtgtgcaaccattgtactaccattttacatacacaagtaaaatttatatatatataaaaccacctagagatacttttccacatatcacatggagctatgtataatgaaattttgtcagtgttatttatgatagtaatccaaagtaacaatcacttggaggttcgataataaaaatgtggcatatcaacaaaaattaactctaaatggattttatacccaaatataaaacctaccactataaaactttcggaacacatagaagaaaattttcatgaattctgagtaggaaaggatttattagaaagaatgttaaaaaaaaaaaaaaaagcactaaaaatgaaagaaacaaattgctacactgaaattcataaaaatgaaaagcttctactcttaaaaatacatcatttaaaaatgaaaaaggccatctatataataggagaaaatatttgcaataagtatatctgacaagggagtaatatcaagatgtgaagaactcataactttataagaccaataaaccatcgttaaaatgggcaaaataatctgaacagatacttcacaaaagaagatggtcaataagcatttgaaaagatgctcacatcctaattcatctgaaaagcaaaaactgaaaccacagtgaaataccaatacatgaaattaaaacgactaaagttaaaaactgataatactagacacaaacagacatttcgccagagaggatataaaaatggcaaataagcacacacaaagatgttcaacatcactagataattaggaaatcgaaattaaaactaaaatgaggtatctttacacaactgttagaatagctttaaaaaatggtaatcccaatgctggtaaggatatgaagaaattatataaatcatacatttgctggtaggaatataaaatggtacagccaccccagagaatagttagaaattttctttaaaaaaaaatagaaaacaaaatttaacatacacttagtacacacttagcactcacaatactaggcatttatcccagagaaatgggaactgtccacaagaaagcatgcccatagatattcataacagactttttttgtaataatcaaaagttaaaaacaatccaaatgtcttttactggctgaatggttaaataaactgtgttatagccatactactcagcaatgaaatgcaaaaaactagaactctcaatacatgtaacacaacaccttggatggatatcaaaggcattgcactgagtgaaaaagccaacttcaaaaggttatattctatatgatttcacttatataatattctctaaatggcaaaattatggagatgaagaacagattagtggttgccaagggcccacaaaagtggagaggaaatggagaaaagggagccaaaagggatgcataagaatataaagggctagaatgaggaatctttgggataacaggaaagttctgcatcttgattatggtggtgtttgcatgaatctacaaatgtgacaaattccataggactatatatacatgtacactgaaatgaatccatataaaactagtgaaatctgaataaggtctgtggattgtaccaacatctcttccctgcttttgatacagttctaaaattacacaagatgttatcactggagaaaactgggtaaaagaaacacaggacctttcagcattatttttgcaactatgactctatttcaaaataaaaagcttaaaaataaaagactgacaatattccaagtgttgtcaagaatgtgaaggaactcaaactcttatttgttactggtgagactgtcacacaatcactttataaaacattttggcagttttagaaataaagttattatatacttatcacaagactcaggaattccattcctacgtatttaccaagagaaaagaaaacatgacaacacaatgacttgtgcataaatgtatataccagctttaatgatactagtcaaaaactagaaacaacgaaaatatccataaacaggtgaatggataaacaagttgtggtatattcccacaaagaaaaattgcacagaaataaaaagaaatgaactagtcattcaaacaacagcataaatgagtctcaaaaacaagctgaacaaaagaaaccagactcaaaaagtgtatactgtataagtccatttatacaaaatctagtttaggaaaaatgaatccactgtgacaaaaagatcagtgatttcatgcagccagaagcaggatttactggtaaggggtaccagggtactccttcacatcttggggtgaagggaatattctatatattgattgtgatgttggttacaaaaatgtattcatttgtcaaaactcactatacatttaaaatgacattatcttattatatatattataacttaataaagttgaaaatgtggcgtatgcttaaaacagaatatcaagtagcaattaaagattatgaattttatgtacacatggcaacatggaaaaggaggaaagaaccaagcaggatttatagcacaatacttcagcattaatggagagggagcttattatactggtcaaggaggtgtggactctagaaccagacagcctcagctgaaatcctggctccacacttatgagttacatacccttgggcaaattacttaatctttctgtgccaagagggatagcagtacttgccacacagggttcttgggaggatccgataaattaatgttgctaaaagcttaaaacagtgtctgggatttgaaaaatgctatgtaagtatttgttaaaaatatataataaaacagctgggccaagcacggtggctctcgcctgtaatcccagcactttgggagactgaagtgggtggatcacctaaggtcaggagttcaagaccaggctggccaacatggtgaaaccccatctctactaaaaacacacaaaaaaaatttagctgggcatggtggcaggtgcctgtagttccaggtactcaggaggctgagacaagagaatcgcttgaaccagggaggcataggttacagtgagccaagatcgtgccactgcactccagcagcctgggtgacagagcgagactctgcctcaaaaaaaaaaaaaagcagccgatctttttttcaaggatatacatatatctaaataaggtgatggagaggaaactgtaaggacatatattaaatactttacatacatattcaatgcaagaagaagaatgcaggcagtatgaaagaaaagtaataaactaaaataaaggggttaatattgatcagtaatgagtgtctgttataagcaaacatagtctgtgcacttgaagtcataaatgggagaaagtacagtcaaaaggcacaactatcaggactaactttatttaaggacaagcctacatacctcactatttgtcttgaattaccagaaccataaataactggtgtacaatgtcattgagacttaagaaaaagagacaaaggcaaagacagaaggcaccaagacagggtacagttaaaaacacacacagacaaatgccaaatacatttgagaaagagtttccatcatgttcataagtaggatattataacaagtcttggacagctgtcattatgcataaataatgtaccacaaaattgaaagctacatgaacatagaaccggccagaataccaaacagtggtggtacacaccagttatcactaaatagctgttaatctcattcaataaccatcactgaatgcctactatatgctaggtgttctagtaagctcatcaaataaataatcttcaaaatgcaacatagaattcagtggccattagaaaaatcaaacaagagtttgtcattttcagaagcaaatacaaaactattattagtggggttttcccagataattctttaaaggtagctgaagcagaaaaaaaaaaaaaaaaagaaatgcgtgattatctacttaaaaaggacacaaagtggatcttttgaaaaataaaatattaaacttattaatgagataacagtttactgtagtttctgatcataagcaacatgcacacaaaagaggaatctcatgtgtgaatttgtcttttttttttaataggaaggattctgcagctaccatgcaaagatacttgcatatggtctgtttacacatagaatttattgtctagccagggcccattttaaaaagaaaagagaacaaaaggactaacggcaatatacaagcacaaatgaacaagggctgcatccttgctgacgaaattgcagtaactacaagtaaggaaagtaattatttcaacaggtatctgaaataaaagctggatagaccctagagaagtggagtggaattacagtaaaacttattttgaaggaaaaaatattaagacatctatagacatataagtatctctgacattctcagttaagaggttcttagttgagtaagtgatactggtcctctgggatcaggtcacagacttacagagtcaaatgcctgtaacaagtatcacacacaacctaaaacactcctggataacatcctgtacttttaagtgcagagatttgtttgcagctttgctgaggtcctcaattctgtttgcatagcagacccacctgaagatctttctaaaagtacagacacggaccccaccagttaaatcaaaatcactagggctggaagtcatatgttgtctactaatcagccaaaataatgagtaaagggtttttctttaattaaattttttttattttgagataattgtagattcacatgcagttgtaagaaataatacatagagatcccatgtactctctagccacattgtcatagtagtgacatcttgcaaaaatatgatgcaaaatcacaaccatgatattaacattaacacagtcaaaatataaaacaattccatcaccacaaggatgccttctgttgtcctttcatagacacaaccaaactccttccgcacccatccccaactccaagtcctgactccgggcaaccatttcataattttgtcatgtcaagaatcttatataaaggtattcacttgtgacctatgtgcattagttttctttgatgcagaaaaattccctggagattcagccagattatttcatgtatcatacctttccattgctgagtaggattctaggtatatatgtgtacaattaatttcaccactgacagttgcagaacattcaggatgttgccagtttgggcccaccaataaagttgctacaaacattcatgtacaggtttttgttggaacataagttttcatcactctcagataaatacacaagagtgcaattgctgggtcgtatggtaattgcatgtttaggttcataggaaactgccacactgttttttttccagagtggctgtacaattttgtgtatcctatcagcaatattatgagtgatccagtttcctcacatcctcaccagcacttgatgttgttactttcttattttagtcattctgataggtgtgtagtaataacttattgtgattttaatttacatctctctaatgcctaatgatgttgtacgtcttttcattgtacttatttgtcatctgtatatcttctttggtaaaaagtttcttcttgtcttttgttcatttcctaattgaattgtttattttttgcagttaggttttaagagttatttatatattctagacactgggggtttgtttgttttgtttttttttttggcaggagatatggtttgcaaatattttctccaagcctgcagctttgtctttccattctctcttaacaagagtcttacacagaacaaataaggcccaatttatcaatctttccttctatggatcatgctttcagtgtcaagtctaagaactgattgcctagccctagatcctaaagattttaacctatttttttctaaaagttgtatactttcatattttgtatttaagccaatgatccattttgagctaatttttgtagaaggtatgaggtttaggtcaaggttcattattttacctgtgaatgtccagtttctccagcatcatttgttgaaatttctaaccttcctccattgaactatttggctcctttgtcaaaaattaagttggccacatctgtgtaggctatttctgtgtttcatatactatgccattgatctatgtgtctatccctccaccaataacacattgtcttgaatactatagctatacagtaggtcttatcaaaatggtttttaaatgtaaattacgccatgtcagtttcatgctttaaaaaaaaaaaaaaaaaaaaaaaaaaaaaaccttaagaattccctgccacaattagaatgatatcctgactccttatccaggctcacagagctgtacatgactagattcaccagcctctcaggtcacacctcacactgcacaggcccaggtcagtacccattagcatcaccagtctttttgttctctgagtacatcttagtaacttcactggaatgcccttgccccagatttctacaaggttagttctctgtcatcagttctcaactaaaatgttacctcctaaaaaaatacttccttgactatccaagctatacaaacacccaagtttaatcctctacatatcagttagcactacctgaaaattttatcatttatttacctgttgtattgtctccctgacctcctgaaccaaaatataagtttcatatgaacaggatccttgtctgccttgttcagcagaccagcacatagaatagtgcttgacgtccctatttatgaagtgtggcatgaataataataagtacagcaataacaaaaacacatctatacatagcacttgtctaaaagctctttcgataactctgtgtgtgtgtgtgcaggcacatgcgggctcattcagtcttcatgataaccctaggaggtgctattactgttcccattatataaataaaagaaattgaagcacggagaggttaaataaccaaatcaaggttacacatctactaaaagagcattagtcatcacacaaaaaaagtaatgaaataaagaatttgtttttctctttggcttatcttatggagattatgacaattaccaaaatctttattacctagaatcttttatttggtgacttatagtttaagttccaaagaaaaatattgccatataaggaaagggtatgacatagaatacacctgaaagagagttttcttaatatgactcgtttgtgagataatttctggggctaccacatccctggttttacactagagtccagtgacctgaacctccaatactgaagtcactaaattttcttcacaaaataactgtatcctactagcatcaagacagcacattacactgccatcttgcctccatccttgaaattttagaaagcaaaatatggcctcatacaaatatcatttggaattctgaaactgcaaagatacccaggactcaaatgtttaaaaacccaaatgcatttctaagtatacattttcccccttagattgccttgttctgctctaagtatcctcaaagtgctttgattttttttctctaagtgagctatagaaatctgaaaagttaaaatagcatgtattctttacagatcatttcatcattgtatcaactagtaagtattagcaatttataacgtatgaatatgttctcactctttccttaaagagaaaatcacacagacatcagaacaatgaatctctggctgaataaatttaaaagttcagtctcataaagcaaattttttgtttgtttacatatactcacagtttggaagcaatcaatcttgattatttatttctgcaatgcttttacttacctctataagtgctttgggatttgatttctatgatcatgactatgcaaagttagggcatcctatattttattttgtgggactcctttcatatttgtgaagaaataacttaaggttgattctcccattctttaaaactacacctgatccatatgtcagaaataataatggcaaaaacaaggcaatttttcaaaactgagttgacagtttttgaatattaagcttcccaaagatatgggcttcacacatttctctgtacaatttttaaaaaggaaacacaaaaatcaatctcaccacctttactagggttcttcagggatttcataaatgctttttggtgagacctcatcatttaatgtgcaataaaagaaaaaaaggtgtgatggaaggaacagagttgagggaacaactactaaaaccacaaacctcccaaacgaactttactctgaacagaataaaataccctattgaatactctaaccatcagttgtataggaaaagaaaaaaaacataaaaattatctcatacattaatggaaagtttattgcatcagaaagaaaatgaatttccatatactgttaatttcatacactaaaatgaattgaagaaactaattattcataacgaatattggcctttgggaaacactgcttcctaaaaggatttaatggtcaaagcttgtgtgaattattatcatgaattaaactaatgaaaggatgaagatattgttaacagaagttctgaaatgctaaccttgccatttctgtcatgagatgagaaatcaatgtccaaataacatgtgcagttaaagctttaacaggaaataagtgccacagaatctacagaaagaggtttttcctatctctcaacaaaaaatatatgaatggaggtaaggtggagaaaggggacaatagtaaaaatcatgccccaaatggaaatgaaattagcaccctgagaatgaattgagaagagtaaaaattaacgttcagccatttgtagaatattgtgagcccataggtgtgtatatatataaaatgtgtatatatacatatatataacgtgtgtatatatatgtgtgtgtgtacatatgtatagtgtgtatataaaacacatatatgggtgtatatacatatataatgtatgggtgtatatacatacataatgtatgggtgtttatacatacacatatataatgtgtgtgtgtgtgtgtgtgtgtgtgtgtgtgtgtgtgtgtgtgtgtggtgtatcctgtaaagaggaaattaaaccatctgaattatcagtgcccaaaatcaagatgacccacatgttactttaaaaaatatataattagaagggaaatttaagaaagtttaaaccttacctttcctattttcctcaacaaacaaaaagaaacaacaaccaacacattcaaaaaaattgatctacttgacactgatcaaaggaaagtctcggaaataagaatttgaaagtataatctacctaagagagagggctctttgttggagaaagtggctccagatttcagattttagttgatgacaggaagtgaaataagaaaactctttgacaagtgtatgaatagagaaactttgtcttgtttttttgatgaggtaggttgttttcttttgatttgctatgaaatggcatctccagagtcttgcaagggttaagaagagtgggaagctgggtaggaaaaaaaaatccaagaagagtacgagcagagttggagagagggctaaattattagaaaaggaatggcactttgtttagcaacccagaatagcagtagtgtgaagctcagtgggatcagctggcttcagggctttacaaagaaatccatttccctgagtgctaaatattttttttgagatggagtctcactttgtcacccaggctggagtgcagtggcgcgatctcagctcactgcaacctccgcctcccaagttcaagtgattctcccgcctcagcctcctgagtggctgggactaatggcaaattaataaattagcactctgatttatatatcagtaataccagaggctgcagtgcagtggcacgatctcagctcactgcaacctccgcctcccaagttcaagtgattctcccgcctcagcctcctgagtggctgggactaatggcaaattaataaattagcactctgatttatatatcagtaataccagataacatatatttatgaatttgtttggtgagtctatcctggaaaggctaataaactttaaaataatgaagaatcagctttcaggtcctgtgaagctaagaaccatatcctagaacctggtcttagaaccaacacactccctgtgagaatgtcactaacctggatgagttctccattctattgttctctatctgcattgctttacacaaaaagtggttgataattaggtaaactagcttctgaggaaaagtggtggaggccagaatagggcaagggaatggatggctgctgataccttctagaaactatcacaaatttttataataaatctctaaatatcatgaaatgtaaaaaagatggcccaaatttgcaaggatcactttgatatctttgtttaaataaaatttatatcaaaatgtgtgcaatgactatcttttcctcttcttcattctattttacatttctaaattttccaaagtacatatatacaattttaatcatcaaaaaaatttataaattcacagaagatttttagagcagtgaaactaccctatatactctagcagtggatacatgttattacaaacttgtccaaagccatagaatgtacaacatcaacagtgaatgctaatgtaaaatgtgaaatttgggtgatgatgtgtcaatgtcaattcaactgtaacaaatgtaccagtttggtgggggatactgataaatggggaagtctatgaatgtatgggaacaggagtaggtacatagaaaatctctgtatgttccgttcaatttctctgtgaaactaaaacttctctaaaaattatgtctatttaaaaaattctagcataaatctgtctttatttatttggtatctatgtcaacaaattttcagaaatatttaaaggcctttcatttttatatatgagatcacattgattatcactggactctgtgtgtgtgtgtgtgtgtgtgtgtgtgtgtgtgtgtgtgtgtgtgtgtccagttttaaagcagaaaaggggttactgactgggaagctgtaatgatgagatctcttgataaagtaatgcagtgtaagcaatctttagagactctttcaatttgatgatgttttctgacttttatcctttgggctgaatcaagaaaaataaaacaatttacaaaactaagactctgctacccacagcaaatgggggaggcagggaagactatattgattgtcaatatatagcaacattatattttttaaatttatccttatgaaaattatctctcattattaaaagagcttctctgatgtttaaagaactggttaactatattctatatagatatatattacattctaattatattctatatatatttttctatctattttctttatatagtccttagtttatcatttctgtccattttctacacaaataagatgggaacctcaaaaaaggaaataagcacctctattatacaatcttaaattgggttagaaaacttagtaccttacttttggatcctaaaaaatattttattgatatattccagaatttaagatcttaattttcttatatatttgctctaaatggcacttgaaataagaaactaaagagtgattaatatttggccaatgttacatgaatgttactatttatcttgttattcttattttaacagtatttaccaatactgtcgagtcactaagttttgatttttggttccactccttctagtttcacttatgcattttagtcctgatctttgcactaaacatgcttatgtgtaccatattctgtaataaaatataactaggcaaaaactatgattatctacctcgcagtaggtaaaaatatagaaggttccagagtgatacttctcaaaattatatctgctatatataacatataaactttgcataaaaacaatataccattataaaatataattacatacattttatatatatagtatttattaaatcgagaaaatattttcaagttactatgttccccataagttttaccatattcataatttacagtttgtttttattccttgagagaattttttttcttacttggaactatttcctatttgttccaattgtgtttccaacttccttagaaatggccatagcaatacaatttttattgatatactagctcatggggcattgtttcttgttgttaggtgtaaatccagtaataataaaaataagttccataaatacaaaacagtaaaattcaaccaaaatcaggcctgatattaaggggatttgaatacatatacagaatataattgaacactttaagcaattctacaaattttaagaaatagagatatagattgagattttcacaaactaaaacaattatagtgatatagttcaactcagtctcttaacttacaactatgcttgtgcgtatctgtccaaattcaattgtatttctggcctataagattatttgcttcaatcaaccaacatagagaaaaaaatcccaggctaaaaagtaaatataatgtctacactggcagtaccctatctcacagatatattgtgacaaaatcttactattaatatctgtaaatattatacacctttcatgaaaatatgaaagctaaataaatatataagggtaaacaaataaaatctaaaggtaaagttttatttggtgcatttgagaaaaatacaaaagaaaaggaaactttgggtcttattggtgatgtaggaatctggagattgaagacgtaggcagtggggatagtgcaggagtgaaaaaacaagcagttacaaaaaattatttaaacttgccatcttaatgtaatatgctttgagtcggcctttatttctatgtatggagaacaaaaagtttctaggcagaaaaatattataaaattgatagtacagacagtgaactactacaatttaaaaacatctgactctttctggccaatcttactttaatggtatcatcatacaaaagaaagaaaattacatggaacaaatgagaaaaaaaagtacctttgtcataaactttcaaatataacattataataaaaaattctcaggagaaattttgggggaaaaaaagatgtattcttcaataataatttaacttggcctaaattcatgagaatatcctccagttttgcaaactgccttcaatttgctgagaaccattcttttatgccagcttaaaataagcaaagattacacaagtaccatgtgccaccttaaataaggaaagggaaaaaagtacaatatggtatttaaacagctgtgtgaagatactggttaaaacaagaatcatttttcagctgagcttgtaatgcttcattttgctaaatttaaactagtgcatcattaacttaaccactgatttgtagaataaagtacagaaccgcacctgcatataatccaataaacacaataatttttcaaatggttgtgaaattgtcataatttgggatcaagatttgagagaaggaagaaaaaataagaagacattatttcacagatgtactggagaaaatacaattgttttcattatttgcagttttatttgagtgagctgacaaatgtacaacaaacagtacacgtggaaacacactagtaagaattctatgccaggcaattagtgaagatgattgcaagaaatcaattttttggaaataaacaaaaattttaaatgttatatggccagtttggatgagtattataagtaaatgagctcaaaccagttaacgaaatggaagaaaacagagtgtgtgctcaaaataattttgctcccaaaggtccataaggaaccatttagtatatcagaagtattcatttactatgtggtatctccctggtcaaagaattgatactttttcacatagattcactcagtcttgtctttccactatgttagaggttttaaaccccaccgaaaagttcaatagatacaatatagggaatatgattcatgtatttggatgaaaaaaagatcatatgcttattttcactaacaattagctaaaagtttaaatttccctttattaagaatgcagacaacaaatcacagtagtatttgttgtacttgtgaccgacagaaataatatatattttgaaatattgttacactcatcactaactccaaaattatagtacctgttagaagtaatgccgcatcccattactattactattcatgtattactattttagagattttaaaatattttgatggcactatttcaatttagtttatttcctttacaatcctatgcatttattttgtgcattaataacattctggccgggcacggtggctcacacctgtaatcccagcactttgggaggccaaggcgggtggatcacctgaggttaggagttcaagaccatcctggccaacatggggaaatcccaactctactaaaaatacaaaaactagctgggcatggtggtgtgtgcctgtaatcccagctactcgcggggctgaggcaggagaatcgcttgaacccgggaggtggaggttgcagtgagtcgagatcaccactgcactcaagcctgggcaacagagcgagactccatctcaaaaaaaaaaaaaatctaagacttttgagttcacatgcttaatttttttttttttaattctgagactggatccacgaacttcgccagattggaaaaggggtccatggcacaaaaagtattaagaacctctcattttcaatttggcacataagataagggaaacgtagggagacaagaaactctatagcttaaaattaacttttatgttaaagttttgtttctgttggtctttatttttaattctggaagagcaatcatcctaaattaagccaatcaaatacatattgctttaagcactaattaacaccttcttcttctaccttttattagttctaagaaatgttctttggtttaaaattttccactaataatggaaaaagtatgaaatttcttatccttatttaaccattttaaaattaactccaatatgtactacattatgacagagcagattttacatcgccctgacagtaaagtatactgcattcttggtcagatgaatgtaatgagcttcttgtaatcctggctaattgatataggaatgggggaaggatttgcaagatcaatagccgtataccaagtgccagagacaagaatgactggctctagtaaaaaagaacacatctagaagagtatctccaatcagaattgcaacctgattaaatttaaaacagagcattatggtttctaacgcctattctcctttgcgcaaggcaagtaggtgagtaaaatgagtatgtgctaaaaatctcttttaaaatttttaagtatttaatagcagcggtaatctctgacatttctctagtgaatttactgcttttgatttgctctcctggatgggagaacagttccagggctttccacttgtccccttctaccacaatatccttcattccatggttcagaaagccaatatggacattctgcaagctacagaggatatctagtcaaggtaagcattgaagaactggacaatgatcacaaggtagataaacaaactccctggaactacagtaagagtaattcaagttacaaagaaagaaaaaggaaaagaacatgagagaagggaaagaaagaaggaaggaaagaaggaaggaagaaaggcaggcaggcagggagggagggatcatttggtccccataaggtcacactttgacaagaacaatggtcaagcattttgggtctcccctccctgccaaggattagtgtcaagtaagagccatgtatggtaatccctgaaataactaagaatttccctttccacaatgtacaatcatcctggtaaatgactgagatcacactggggacaacttgaagaaagatttttggtatgtatttgtagcaatactcatgctttatcttcagagggatacagttgccctcatttcatttaagggctgtggctctgtgaactggctccggtctagaaactgagtgagaggccatgatgttgtatcagggtgaggaaatgagttttctgctcacgacatcaattatgtttctgtaccctagagtctgtattttagtgatatttcagccaccatcaaaaattaaaagtttggtgtcacaatagtctgattgtcactctggctcttccacccattatcgcaattgtactcactttgcttccagtgattacactgggacactcagcctctgccactccagaattccatcattccattaaaatgagagagtctattttgaaagtagcacctaatatcacatccaaggcaatcagaatacagccttcccagatttcttcaaggacactgatgttcccttcaccaatgcatttctcaatatttccatgaggaaagcatttgtgggtcacacatgataaacccactgcaacattcctatctccctaaggctttgggatattttcatgcaagactgaagtcactatggccattacagactcttcaagaagagggaatttaatctccttagagaaagaagaagaggttggttccacaataaagcactggggaaactgcagatgaagcatagaggaaactggagttcaaggctctgagatttaggtgagttcactcacataaatatattcatttcaattatcatgatccatgtctaccattcatgtcttatcttccatataagaaagctagtgaggctgtgaattcaacttgtactgtgattctataattctcagaactgaagtttggttcttattttcagctgcatcattactgcaatgataaaagacaagacaatttgtgttggcagtgggagtggggaggggatcatagatctctgtttacgtgactatccttgaactgagagaagtcctgaacccataatttcctttctataaaccttctagtgtagtcaaaaacagccaacaggagtcattattcaatccataacagtcaattacaacttccatttgatttcccaaaactttgactttagtaaacacttcatttctgataagaaaggtgatacattaagtaactgagctgaccctgcatggaacggcaattttccactggcaatgatatactattgtgttcaattgcagtatggtcagataaccaatctcaaattctcatctttgaaattctgtctcctaaaaccactcctggttattgttcactaaagaaagcagaaactactatagacatttccagaataggaaatttaataccagaaactgattatacagttgttgaaggggttagaaaaaaaaggaagaaataaatacttgaaggcacaaaacaaaaacagggtttcaaaccaaagtgagggtgctaccccactaggctggagcccacaagcctgcagtaattgctgagctcctggaaaaacttctacaggtgccactgggaatgctctgttattgctcaacagagcctatactgtccagcagcaggagtactgctactgctattcaagatgccaacactaatgcttctggaactcacagccaccagaggtcaccttcagtatcctcttctgcatgctgaagtacaccatccaataaaaggaaataaatagctgcttcttctctcctaccttacaatctttcaagattgccttgctttggctgtacctaatagaaaacttgctagcaatggaatctggcatgtgtggttcacaggttttatatctttgcagtagagtgtggaagggcagatatatagataagagataacagcactaactgtcacaaaaccaaacaataatggaaaaacagaatgtgatgcattttatcttctaaccatttataaaataaattaaatatatgttttatggtataataataactgtaaagaaaaccaaatactacacaagcactcaaaatgccattctcaatctaatcttaactttcttaataatcaacaaatacttactgtgtctatgttcctgacattgtgacaaatcccagagttacagatgtaaaatcaactataggagtttttactctcgtcaggaaatagaatcagaggaaacagacaaaatacagtaaataataactagactatgtgtatcaggtatacaggagagccaactacaacagccaagaagggtcatagatggtgtataatttggatatttgtccaatccaaatttcatgttgaactgcaatccccagcactggaggtggggcctggtgggaggtgtttggatcccaggggtgtatgtttaatggcttggtgctgtctttgtgatagtgagttctcgcaagatctagtcatttgaaagagtgtggcactttctgccctccactctctgtctagctcctgcttttgctgtgtgaagtgcctgttcccgctttgccttccaccatgagtaaaagctccctgaggcctccctagaagcagatgctgctatgcttcctgtacatcctgaagaactgagccaattaaacctctcatcttataaattgcccagtttcaggtatttctctatagcaatgtgagaatagcctaatacaggcggcttcagggaagtgacttggggaaaaactagggcttctaaagaatacaagaaaaaataatatttcagatcagaaaaacagcatgtatggaggcatacagacctgacaaagcataagatgtcctggaaagtagaattgtatataatttgaaatatagcaaatgaggagataatcaggaatatgccgaagaaaaggttagacaggcaaaaggtgagcaaagtatgattctattaatatattgctcatacaattgattgaatgatgttgcatttgaaattttttaatttaaattttagaaagataattgccagaggaatggaggattgactagagtgaataagatgaggaaaataagatcatttagaaagctgttctagtataggataataaaactgaagtaatgcaataactactgaagtaatacaataaactgaagtaattcccacttgtctaggaaaaagctagttctcctcctccttctctatgcaagttccccagcttctaatcaatctatcagttaagcccactttaataactattaatatgttttcaatgtccattttaataactgtgttttctacaagattaaagaaataaaattatcctatagatttttctaaacaaatagtggagacctatggaatataattgcaagggtagtaaaaatgtaacttaaattaagctgtgaaatatattctattttttgtctgctattttgtcatgactgtttgacagaaaatctacccttttaatatgccaaattcacacatattaattaggagaactagaagttaaccaaagtaaatcgggaggaaaatattttaaaagtatacgtgcatatctcacccaaagaaaaattccgatttaattctcacttcttttaaggtggccctcccccagaatatcgttgactttttaaaacatatcataaggcaaacatttgtgacgctatcacagtccatcttatacaaccaaccaggaaaaatatcctctttaatcaaaatcagtaattttgcgttaagcttcttttattgatatgaaaaatttgggcagtcctgcagagagaagtccaaataacacaggaaactagccctgacaggtggtaagacaataggaagaaactagtatttcctcaggatcttgcttatacatatggtacttatgatactttactaaaaagtatttatctgaatccttcagtagcctatgagtcccttaatggcaggaaatgactgaaaaaaaaaacaaataaataaagtgaagacagaaacgacatggatttctaaaaatatttctgatgcttctgcatttcttaaaaatttacgtggatattttccaggatggacaattatctgtgcacacaatgcaatttgctcttccaaatcctttctaccacagcttcagacttaagctctatttaatgtaaaccaatcatagtaataccttcctcaccgccacgtagtctttcagtaatgaatgagactacgtccatttaagcaaacaacacacaaggaaacatttcctagtggcttcttaaaaaaaaaaaaaaggcttcatttttcaactaataaaaaggtgagtattacagataataactacataggaatgtaaaaaaaaacttactctggctatggaagtctgaaaagacttcatgtaagagataaggcttaaaccacacctgaacaacaggaaagtacagttatgcatcacttaatgatggaaacacattctgagaaaagcatataggcaatttcataattgtgcgaacatcacagggtatacttacacaaacatagatggtatggccgactacccctagcttatggctcctagactacaatcctgtacagcatgtaactgcactgaattccataggcaattgtagcacaatgatatttgtgtatctaaacataaaaaaggtacagtaaaaacatggtattatcctcttatgggaagaccatcaaaaacacagtctatcactgacattatgcagtggcacatggctgtatctgagagtagacaggaattacaactgggtggatggtataaagaaaggcataagaagcataaagagtggaggatgttagatgtattcaaagcacaagccagccaccccaagtaaaagactcatagacaaagaaagaacatgcaggaaacaaaagtcgaaaaaagggcctgaaaaccagaatatatttcattatgttaagagccaacaaagtaaaattcttagttatgatctaaatgtatgatttagggatgaatacatagttagggagaaaagaaaaattatttagccatgaataaattaatccaggttcttattcatcaagattccattttgaagagggctgccgcttaggaacactcaagctacgagggccataaatttaacacacacatttctttatgaaggagtagagagaataaacaaattttttaaaaagtaaagggagaaaagggaaaataaagtaatatgcaaggacatccgatagtcaaaatgtattatctcataaatttatatgcttcagtaaaaaaattatcatatttacaatcaaaaaaggccatttgtaaagaatctcacatatattatctctgtcaaatctcacaacaacccaatgagagagatattgttggctccttttttttttctttttttttttttttttttttttgagatggagtctcgctatgtcgccagactggagtgcagtggcgagatctcggctcactgcaagctccgcctcccgagttcaagtgattctcctgcctcagtctctcaagtagctgggattacaggcacgtgcaaccacgcccaactaatttttgtatttttagtagagacggggtttcaccatgttggccagaatggtctcgatctcctgacctcgtgatccgcccgcctcagcctcccaaagtgctgggattgcaggcatgatttttggctcgtttgtacagacatgaaagtgtctcaacgtggttaagtgagtttggaagagccagattattatccaggcctctgactttacatcctgtacccactcaggcctacctcatttcattcaagagataagtacaacacaaagttcaacaacatctgaagccattctgaactagaaataaatgaagattctaattgtcagtatatcattattcagacataatgtagaaacaaaggattttgccaagcttaatatggtttggctgaatgcaagatttatatattaagatccaacattatatgggcaaagaaatactacctgactctctggaaattgaggtttatcaatcagactccctagatattcagtattttgaagatataataatactgaatcagagacagaaaaaaactagtaataaaatactcaaaggtctaaaaattaaaggcaaattttcttagcaaagagtacatggcattctatttaaaaatcaacaatttgtcttcattccccagatcataaacccaaggagaccattataaggctgctacaaacaatctgtcagtttgatttcacttggttagtgagggtgttgattttgttgttgaactgcttaagaaaaatttaagatgcttaaagaaagttctttaaacatattaataataagcttttcaaagtctgtgaatttaatatttcattatttccttgaacctgttagagttaagtgaaactttgaaaattccaggaaaggttcaataaaatttgttatagattctacatggtctcattttcctttacttaagaaaaaataccaaataggctgttatattttgaaatctacattttttcaatctgccctttaatgagcaccaattatggtaaataaatattaacagaatataaccacttacttataatgcaatccttataatgttatatttatccaagccatgaaggattagggaagtaaaaactacactagcttatgatttagcagttttattttccaatataggtcagaatctaaaaagttaaagagtgaaggagggccacggggcctttaaggagcccaaatatcagtgtaaatgaaagggtgattgattctctcctcaaagcagatggcgtcctttccccagatgcctggttaatacagatgtggaagccaatggagaactcaggttccttacaaagaacagaaaaggggttgagcacacaaacaattcaagagttcaagggctggtggtgaaatctggtagtaacagattgcagacacatacagatgtctaaaggaaacagcaaaaggaagatctgggaagcaactccccaggaaaagattttaccatagaaatcatcatcatcattaagaagcctcagatcagatgtaacctatagcagatctgaacatgactaaaccctagacaaaagtaattaattccaaaacagtggtatggatcaattcaaatgagaaattgattttctagttctgaggtgcaatggcaaacttgtaagtcaaatgatatcctagaagacagcactttttaaagacaataccttaccaagccacttgaagacggaataactataccataatgaagaaaaatttctattacttaatagattcttttaaaaatattttagatactaaattaggactattacataattggtattatctatatttcaactatggaagtaacagttcttcatttcaattaacaagctaatatactgtctattcatcatgattcgaccattagccagactttgctgaataattctaagattagcctgccatttagccacaagttagccaactatatagataagtgaactattttgctatcattaccttaaatgttgtccacacatcacaatgaccaataagaaaacatccctgtcctaccatcctggtaatcagaaaatcaccatgtggcttaatgtaaggctaagtaagcgttaccaaatatgtctgtaggagggcaagtctgagggcacgattacactttcaagactttgtgaggaatcatttgtaatcttgtcacactcaaaaaaagtgctgagagcattcttttttcaccctcacatcatccagagaactgttcagcaatataaagctgtgaccttgatgttctatatagcttaaagaccatagttaaagtcctcataagcactaaaagtcatctctgcacaggaagtagaatatccttctacactaatgtgctacatattatagatttctccaatatgttccaaatataatataatgttatttccaaaaccgtaaaaaaaattcatagtttagcagatctaagtagaactccttttggctggtgagatggtgggaagagattagggtagaaagtggaagaagcagagtcataagagaatagtaatcagtgaactaccaaaattttcatcattcaaaatttttacaaatcaaaattttagctttaaatcaattttatatgtttggtttcaaagatcagccctcaataacaaccctataatctgttttaatacagaaggctatattctatagcgataagttctattttagaaaagaagcaatttaaacctaagtttttttagaatgttagcataacatatagtatgaaacaggaaacaaacagattaaaggaagaccagaacattggctgaaaatacaccttcagggcccatttccaggtaatgcccaaggcctcctaggggataactaatagttaatatttcggctgccacattccatgggaggtcgtaacaatgactttatataaaaattatttctatttttctcttttatttttaacttagtactattaactggagctctttcttcccttgttaactattcattactgtatatttctgtgcattaaaaccactttaaaaaaaatcttcatccccacatcagcctccatcgtgggaagatatatatacacagaaagagaggaaaagtcattgatccccagccataagtcaagtgaggcttcaacaatagatcatacccaggctgcacactgttaggtcacagaacatgtggtcacactgtcctaccaagacagaagctaattctatgaaatcccaaactacaccttcttgtgtttctccattcacctcagtcaatggcttcaccaccatccatccaccttcttactcaaatcagaagctgaggagccactctgcctcttcccattcttacagtccaaattcttgttcactcatgcaactattcatttctctctcacttcctcagcatttgcttcagcccatataatttctgacctaggtgattttatcagtttcctaactggtttccctttctctggcctacaacccataaattctaaaacacaatctgaataatctttctaaaacattttaggaacaacccactaccctcagatcaagtccaaactctttaacactgtttacaaggcccttgataatctgactggttgctgctcacactgaactcttaccactcccactgtggtacccaacaatgccaaacaatttgaaattactcagttactcatattctctcagtactaggcaccaccattcctcatccagaacactaaagcaattgagtttgattcaggtgtaatcctcaagaaaacattgttagacttctccagtttctccaggtgacacatctgtgtgctctgaaagcaccctatgcttatagttatcataccatacagtactgtttactttgttcttcctcccccaatcactgattattagatccttaaagtacaagcaacttattcatatttgtatcataatgactagaatagtacttggaacaaaggagacactcactaaatgtttgctgaattaatgaataaagatataaatgaaaggcggtatgtgttccatgttttcttcaagaaaatatggccaccaaaatgtgtatgaactaagtattctccaatctgcccaatggaaaaataaataaataacagctaagagtttgtcataaatttcagggcaatcctaatgaatctaggaaagtcaattgatcaagaggctacatcatggccttttgatttgacttacccttatttgctcctacgataataccaaaaaagcatctgtccatacagtgagaatgtaagtcaacacacaattggctcagggtaagcagattacaactctattaaaataaaagaattataatcaaaatcctgcttccgtatatgatttaatcattgcacactgattaaataaatgacaataattataaagaaaaatctccatccattttgagtgctcctgagaagctagagactactcagatctctgatttgaggtaatattctcaatgtctcaaattaaatgcaaatattctcatggaaaaaaaactacaacaatctttttttttctctaaattattaatatttatctttgaggttgagattctcaggtttttgtagtacatcatgggagtgatataaaaggagtccttaactgcaaatcaaaattttagccttaaatccaaagcttgctttactatatagctatgctctaaatcaccaaattcagaaatcctttaaaatagacacttgaatgtggtttcaatgtaagcactctcttagcagactcactcttcaaagtccaaaatgaaagaaaaattatatgctcagcagtttatttaattaaaaggaatggaactacagagtgataagtatagaaaagttcagcatgtcttttcaaaggactgtaaaaaaaacttccaacactttacttatattcttgcccttgtgactaagttatggacaatgaaacaccttgagttatgatacaaatccttaaacctaaaatgccatatgttaaaactcaaattatgttaaagcccataactattttaaaaccctgtgtataatgtgatctactgcattcacagtacttaaagtactttcatttttgaacttttataatttctgcaagagaaaacaatgccaagagacatccctacagtaattaatgtaagataacagctttgaatttacagttattggtaatttaattagtcttgaacatagccactataagacttgataactactaaacaattattaatgaataaaaggctggcccccagattcttttatgccagacccatggaaatagtatgtgccagataaatagattctcaataaatatttattgaggtcgaattgaccccatgactggttagatgcagaattttagttcacatcatatagacattctgaaactgaatttaacacaagcataatatcagcataatattatactgaattgtacagacagaaccatgagtcactttctgctccaaatcaatgaaatgttgaagtagaaggaacagcataagaattctccattatgtagctaagtttgaaacaatggtagagaaatctccaggtcccaaaaaatgaaaaagaaattcgatatctgggtggtagaaggaactgaattttaaaaaaaattagaaatatactaatattagtaatattaatactaatatacaaatacatttaatagtggtgttctcagatcacgacgcaaaatctccccaagaaacctactaataatgaataataatttacatgagaaaaagaccttttcacctgcaaattaaaaagcaggttaacatttatgggtcatggtaaaagcacttctccaaagaaaatccatagcattaaatacttacatattttttaaagaaataaaatgaggaatgcatctatattttatatcaaagcctacgtctcccagctttgttcatagcattaaatacttacataattttttttttacaaaagtaaataaaatggtgaatgcacctttgttttacacggacggctgcatctcccacatttgcaaactcttcactgtaataaactctctttcttcaaaatgaaaaaaagaaagcaaataaaatgacttaaacatttaatttgaaaagctagaaaaagactgacaacagaaaacaaaagcagaaggaaattaataaaaataaaaatgaagtcagaaaaacagcaaaattaataaacagatcaaaaagctggttctttcaggcaacctacagaacaggagaaaatttctgcaatctactcatctgacaaagggctaatatccagaatctacaatgaactcaaacaaatttacaagaagaaaacaaaaaaccccatcaaaaagtgggcaaaggatatgaacagacacttctcaaaagaagtcatttatgcagccaaaaggcacatgaaaaaatgctcatcatcaccagccatcagagaaatgcaaatcaaaaccccaatgagataccatctcacaccagttagaatgacaatcattaaaaagtcaggaaacaaaagctgctggagaagatatggagaaataggaacacttttacactgttggtaggactgtaaactagttcaaccattgtggaagtcagtgtggcgattcctcagggatctagaactagaaataccatttcacccagccatcccattactgggtatatacccaaaggactataaaacatgcttctataaagacacatccacgcatatgtttattgcggcactattcacaacagcaaagatttggaaccaactcaaatgtccaacaatgatagactggataaagaaaatgtggcacatatacaccatggaatactatgcagccataaaaaatgatgagttcatgtcctttgtagggacatggatgaagctggaaaccatcattctcagcaaactgtcacaaggacaaaaaaccaaacactgcatgttctcactcacaggtgggaaatgaacaatgagaacacagggacacaggaaggggaacatcacacaccgggacctgttgtggggtggtgggagtggggagggatagcattaggagatacacctaatgttaaatgatgagttaatgggtgcagaacaccaacatggcacatgtatacatatgtaattaacctgcacattgtgcacatataccctaaaacttaaagtacaataaaataaaaaaagctggttctttgaaacactcaacaaaatagaaaaattactagccaacctaataaataaaaaggtgggggagattagggtgaaagcccaaaaacacaaagtgaaaaataacaaagaagaaatagtcatcaaaagagatgaactgaaagagaaaatgaagcacaaagaggaaaagaaatctattgtatatgcaaataaatctgaaacataggtaaaataaaatttcatttggcaaaactgaccataatagagagagaatgcattaaggaaatgcctaaaaagggaagtaaaactaattagtcaactacagaccataattcatcagaggttccttaaattaagttgaggcaagtcactctttttcaagttgagaaaagatgctataaaacatgaaggcatgtttgagaaaaccagtaaatatttttaacaatagttcctagagtcaaataaaaaattcattcaaaatcatgtgtaatataatgtttaagtgtaatatattcaaatgagaaattccaatactatattccctaacaaagggaaaaaaataaattatagctaaaaaataaatattcaatatcaaccaatatcaacaacaatctgtttattgacaaaatgtatttttagtttttaaaaaacaataaaaggtaaataaactaaaattcaaagtgcaaacaataacacaccaaagattttttttgaatactgaaaatctaggggaacaactgctcaacatttggttgcttcacaatctgttaatttttttaatcaaatatgactaagataagtctgccacatccataaaaacattaactgaaattaatatgcaaattatggtgcctgtgtgggatgccatttcattaatttcaattcactgacataattgtgttctctgaatttatgagatttgcaaatgccatctcatagagaatgcaatgttcagtgaatgttattttactagcataaaacccaataataggttaatccacaaaaaagaaatataagattttagttacaaaataatatatgttttcatagctgtatattctttgagctaattcttagagctttttaaaataatgtttaacttttaatataacactgattaatggtagcaatcttggaaagttcaaaaaggtatataaaatgagaaccttttaaagattagctatctttaaattataaataataacagtatttggtatattttgcttcaatcttcttgtatgcagataagtacaaatgtgaaagcgcgcaaaataaatataatgttttaattccattttttccacttaatatagctatagatattttaccatattagtaaatgaattccaaaatataattttaaatgaatgtatattaagatcatcatgtggacctaccaaaatatttttaatctttccattattttttggagtttaggtttttttagtgttttaatagtataaatccttctgtaatcgagcccttcatgtaattatttgtgtctctgattatttccttaacaaaaaaatccttgaagtgaaattcctgaatcaaaggatgtaaattttaatatatcatctaaatacctttcaaaaatattgaaactttacattccgaccacgagtatataacttctattcccttgaccccttttccatactacattctatcttttggcatcatcagtgtagtagatcaaaatggcatctcacagttgattcatttgcatttctttattagagaggttgaacccctcatgaaattttactgtagtaataatgttctggaattttaatttaaattataatgtagttttgcctataactgaattgtgagcaacattgctatttataatttattactgcttgaagttgcatactgtaaaacatgctgtgtttaaattatgtacagtatttttttatggttagatttcataaaatctcctaaaccaaacctgagtaaatttctgctctctttacttgctattactttcaggtctataaagatataaagaaaattacacttaatcgaattttatatattttaggtattttgaaggcaattagttcatcataatacctcaattgagatataaattatgcatttataagactgagattgccaaataaaaattaagatgcttagcaaataatgaatttgattaaatttttaaaattttctcaaaactacaaaaaagtttttgatcaataccaaagattataattgaaatatctttccatctcagatattaaagttacaataattccaaaattatgggcatgcattctccctccataagtgaaagctgtacaatgcctcaattctcagttgtctcttaaacaattccattcagaaatcttcttcagctgctaacatattcctcattaagattcctacttctcataaacatttctccaaagaagacataaaaatggccaataggaatatgcaaagatggtcaagatcactaatcatcagaaatatgcaatgaaaaccgcaaggatatatcaattcacacctgctaggatggctgttaccaaacaaacaacaacaaaagaaaaacaagtacagggaacactggaaaaactggaacccttatgcactgttggtgggaaatgcaacagctctggaagcagtatggaggttccacccaaattataaaaagaactaccatttcttggagcaatcccattttcaggtattatccaaaataaattttggtttttggtatttcaaaataactgaaatcaggatctcaaagaagtatttgtattcccatgttcactgcagcactattcacaatagccaagatatggaatcaacctaagtgtccatcaatagatgaaaggataaggaaaacgtagtacatttacatactctagaatattattcagcttctaaaaagaagggaatcctggcatatggatggggaaaaaggggaatcctgccagcatagataaacctggaaaacactgtgctacatgaaataggccagtcacagaagcgcaaatactgcatacattctacttatatgaagtatctaaaatagtttaattcataaaggcaaaaagggaatggtggtggtcaggggcttgggagagggaaaaatgagaagttgctgtccaactggtataaagtttcagttaagcaagataataattcttaaaattcatgtaagagaaaatattatcaaaatagaatgcctcatttaacctgctttatgagtgttcactcacatagatcattatatataaaaagtgtcactgtaactaaataatttctacaatttcattaacatgtactcaactccctttgctgcatgtctctatcatagctgttcctgcgaggtactgtaacccaccattcattcatccatgtacttcttacacttcaaaagactgaactatttcttttgtagcacttggcatgagcaaatacataatatattaataaataaaaataaatataggaaaattcagctcacaaatgtgctatttgtgcatgaaaaggaaaaatatttttaactattttcagaaataagttagaggctagaaagtaatcttatggtatattaataatttaaaagtcatcatcaaatcctgtggtttggccaaaataaatgcagaagtagaaagaaagagagccataaattgcttaaggtcagaaatgcaagctgaaaacatagtgtacataatacaagaaattcttaattctccagatttctatgtgtcaaaaggctcctgatttcagtgtggaaatgagggttttaactacatacctgaatcacctgtttggaaaataggtacgtatagtagatatataatatataagaatacatatgagaataaagtattataaagcagcataaccacccacatttcaccatcttttcatcattaaactaaaaaatatttttacaaaaccacatgacctctcagtcataatagaactaatgaaactacaaagatccaatcttactcagagaacttgtacgatttttgaaaacagcaccattaaaacagctctctcagagtattctcctataagctcttaaaagttattttgaaaactgtcaatacagctggggttcttttccacccagtggcaggttacaaaggaatattaaagatgtttcaaaaactgatataattcaggaaaaataatttaaacaatatgactgcaattatgacatattacaatgaaatacatggcagctagaactaaataggagcccacagaatgatacttagaaatgcatttacatggttactgagttttccccagtagaaaagcaactatcccttcttgctccttattggtacaaaaattatttcagggcccacaaattctaaaagcattacaaagtttgaagaatataaagtaaatggcaattataaaaagtaagggtttatattttacaagccccaatacagcaaggcttagaattagttataaaaactagaggtgtgttacgtcttagagtaggtaacagctggatactgtgtagaataaatgctcatgcccatgggtgggatgttcataatgctgaagggcaagagagagagatgtatagcttgagaagtgatgtggataattgcttgtcattaaacagcagagtaattgctgcagcaaattcccatgtaactattccacatgaaacttcaacgtgcccttggacttactaaacatacatagttttctcagataaaaagacagcagtcaatgatgcaccacacttaaaaagatcattattttattatttagtctcacaaaaaaacattgggaccctaaccattaataacacagagaaaaaaaaagccattgatttttacattagtaagaccttggtaagatctcagaatctactttttcctaacctgctcagactaggtgtctcataaagcctacaataatttaaaagatcgtcacatcttttgaaaagctttcatgtacaatcatgttattcagtattcaaattcataataagccaagatacgaaacatttaagttgctgcaggatgttgagcgctattaagaatgcattaatagagaggattctaggcagctgaagctgtggcagaggtataaatttgaaagtaccaaaatatcctgaaaagaaacagaaacaggaagaggaaaaaaaagagaaggagaagaattaaaactacacaccctatctcaacataactagaaaacaaggaaactccaaacttcaaagtacttgtaaatataaatataaacatcaagacctacctacctctctcatgtgctcctgccagtagccttcatggagaccaagagcagttcaggagaaactacacaaacgagagcagagaggagttaagggcaggttgaaccatgatttaaaaccactgctagaaacagaaagaaactcagcccttggccctatatatactgaaaagtgaacagttagctcagaacactgataacagaaaggagacttgaaaacgcacatgggacatgacaagccaccttgcaaaggcgtcactttggagagaaaagacagctaaaacaacaggagaggtttctttggaaactatacattagagagagaaaaaggggagaacatttcgaattacataaaacaaaagaaaatttaaaaattggaaggcatatgccatttgaaaaccatgccatccagtaaagaaacaatactttgcttacaataacaggagagggtgctcttgaactagaaatgttaagccatcccaacatacagataaacaaaaacctagcataaaaagaaaattgaaaataaggacccaaacaattaaggtgataaaaaattccaccctctcacacaaacaaatggcaagacactggcaagaacagtggcaaaacagaagaaaaccataacactcaaaactaataaatatccataaattctgcaattaggtagatttaaaaaacaaccttgaaataagaattaaaaactaagtagagaaatgaatgaccagaaaattttaaaaggaaaaaataaaacaccaattgattgaacacagaaagaaaagagaagaaaaatacaaaatcacatcagaaatggaacgtaaattacaagatgcccaaggaaaaacagatttgaaagaaaatgcaataagagacactggaaaaatagtagaaaatcaactaaatgaataaaatgaaatagagaaaaaagtaaaaagggtcaaagagaaagtggctgaaatggaagacaggaaaaagaagatacaatttatatataaatggaatttctgaagaagactttttaaaataaaatatgactaataatgaaattctaaccaagaaagtattcaaacacaaacaaccacaacttatatactgaaagggcccactagccacggggtggggggaaaaaaaaaacttgtaacaatcaactcagagacatattttagtaaaagtagtagacattcaagataaaggaaaaatcctcagggaatccaggcaaatgaattcaaacaacatacacaagtaaaagaattagactggcaatagatttatcaaaaataagattcatatccaacaagaggttagtatacaaaatgtacataaagctcaaatgactcaatagcaagaaaaccaaaaatccaatttaaaaatggtcaagatatctgaataaaaatttctcaaaagaagacatacaaatgtccagcagacatatgaaaaaatgttcaacatcgctaatcattagagaaatgcaaattaaagaccacaatgagatatcatcttacacttatcagaatggctattatcaaaaagacaaaagttaacaaatattgacaaggatgtggagaaaagggaatccttgtatactgttggtgcgaatatatattagtatatcgattatgaaaaactgtatggaagttcctcaaaaaactaaaaatagaattagcatatgacccagcaatcccacttctgggtgtttacctaaaagatttgaaatcagtttgttgaagaaatgtctgcattccatgtttattgcagcactattcaccatcgctaagttatggaatcaacctaagtgcccatcaatggatgaatggataaacaaaatgtggtaaatatacacagtgaaattctattcagcccttaaaaagaaggattctgtcatttgtagcagcatgtgtgaaaatggagaacattatgctaagtgaaataaataaggcaaacaaagacaaatatcacgttctcacttatatgtgaaatctacaataacctaactcatagaagcagagagtaggatggtggttaaagcagttcaggcagtaaggaatggggaaatgataaccaaagggtataaaatctcaggagaaatatgctttttttagttctattgcacagcatgatgattatagtcaataatagagtactgcacatcttaaaattgctaagagagtaacattcaaatgttctcaccacaaaaaaaggtatttgaggtattgaatatgttgttaactaacttgatttaattattccacattgtattcatggatcatacatcactttatactccataaatttatacaattataaattatcaatttacaatttttaaaaagattcaaagcaagataccaatggggcagcatttccataaggctccaggaaataaagggaaatccaaggatttgtatatagccaagctgccttcgagtatccaagctataaaaaaagtttttaacatgcaagaattcaaggaattctggatccatgagttcttaaggaatctactagaagatgaccttaacccaacttgttattaactgggaaagttaagcaaaaaaactaatagtatacatatatatatttatttgtaggtataagacacacgggaaaatacatcatgtgctatatgctatatattatgtgctgttttctcaaagtagaaataatgccacaaaaacaataagacaaaaaggctgttttataggcatgaggcaggaactaaagaatatcaataacagccgaataaccagatgttaaaaggtcataatgtttaaatggggaataaggacgttagtaaagaaataagtataaacacatcatctagaccaaaataaaaccttcctagaaaaaaaaacttcaaaaatcgaatagtaaaaaaggttactagagaaagaagccaagcaaatataatatagcgtgcataatatttataatatgacaaaattaaaatcaaaacatcagtcttttcaataattgtgcaggcacttaacctaccaactgaaagaaaatcatataaaatcaaatgcaagccaaaaagcattaaatgtaacaaagaaggacacgttttaacgctaaagccaaaatcacaataaagacatattaaatataaatatctatgtaccaaataatatagtacctttttgtaaaacaaaaactataagagatgccagaagtcccaaaaagaacactaataataggagattttaacatactacttagaacaaggcagatcaataaacatgtaaaatgaaaatttaaaaacacctacaatataactaataaggtagattttatgaatatatgtcaaactttacaccctaaaaataaacttttctctcaaatgcatgtggagcatcacaaaaactgatcatatattaggtgataaggaaaatatcagtatgttctataaaatagtaatgctataagaaatattttctaaccaaaattaaaataaaactagaaattatttaagcactttttaaaaaaggctccttgcgatggttaatactgtcaacttgattggattaaatgaaatcagtctactactccacaatggaggtaagggatatctggaatacaggagatcccttagggtgtctcttagtattaccatgccctctgattaaggtcaatgggaaactacaacagcccaatccagtcagggctacaaatagcccagaccctccaggaatgaaggtttgtgtcactccaccaggaaaaaaacaagacctgctgaggtgcttgctgaaggcaaagggaatacagaatgggtagtagaagaaggtagtcatcaataccagcacgtgaccagttgcacaaacaaggactgtaattgtaatgagtatttcctccttcttttgttaagaacatgtttgtgcatgtatatatttgtacaagaaaatatcttcattttatttcctttttcctttaaatgtgacataagattcattgacttgctatcagcatttaagtgttgttaaccttacataatagcatttgggttggggatttgtgcattcctggttgtacgaaggatagttttattatgttaggcataattatgatattattgtctttatttgaagactatgatttcaggaaatgtatatgggttcaagttgacaaggggtcgacttgtgatggtaaatattgagtggattgtaatattgattggattgaaggatgcaaagctccctaggtgtgtctgtgagggtgctaccaaaggagattaacatttgagagacaaaggagagacagacccaccctcaatcttagtgggcaccatctaattaatcagctgacagtgtagccagaataaaagcaggcagaacatgaaaagactagactggcatagtctcccagcctacatctttctcccgtgctgggtccttcctgcccttgaacattggactccaagttcttcacctttgtaattcggactggcttccttgctccgcagcttgcagatggcctattgtgggacctcaccttgtgatcatgtgagtcaatacaccttaataaactccgctttatatacacatctaacttattagttctctccctctagaaaaccctgatacactcttcaacctgtatatcttcttctagaaaaaaaccttttcttaaacaactcttaggtgaaggggtaaatacaagctaaaagtagaaaatatattttaaacaattataagcacactacatatcaaaaatttttatttttattgatgtaaaatatacatatgtaatttatcatctataccatttttaagtgtataatttggtggtaataaatacatattatatatatatatatttccccccttcatctcctcctcccctcttccacttcccagcctctggtaactacaaatctactctctgtgttcttgacagtcacttttttagctcccacatgaatgtgaacatgttatatttgcctttctgtgcttggcttatttcacttaacaaaacggccttctgtttcatccacgttgctgtacatgataggatttcattcttttttatggcagaataatattccactgggtatatataccacattttctttatgcatgcatcagttgattggcacttaggttgatcaagtatttttaaagcaatggtcagagaaaaattcatagccttaacatttctatcaatgaaattttaaaaataaaaaagaattaaattcccagctcataaaggcattcagggtaataagctaatttgtataacatggcatttcatacatgcatgactaaagaaacagtccccaggtatgctctaggttctcatccttttttcaacttggtcctggcagtgcaaaagacttccagggaatttagctccctagaagttgatggcactgattgcccaagtatgtaagataataccagactactaaaattattgttttttaaaccttcacttgtatttcttccatttccctcacttttcctaacgtctctcagtacacagaaaaaaacaagagaaaggttgattcggggtaatatcagtcaggtaacgatggaattcagaaatttgagacacatctcttctttcttgaggcatatcactcttatactgttaatcattccacagagagctctaacaagaagctttcattggtctttgaatctgtagcaggagcagtttataggccaagtcccataagctcagctgagattcacacttaccgatgctcttctggaatctaaaccttaacactggcataagaagcagaggagacagaaaaagagacctaaaaaaacttttctttatagaaaagatacaaactagagctaggtttcagcctccctcaccttctctttggaacagatcttacatatttaaaaccatatttgatgaaatggatgcatccctttaaatagtaacagatatgaggatgactaccaaatatctctctgttattataagcctggagagtcccaaaaaagtcagccagacaacatgaaatgtaaaatgtctaaagagtggaaatataacaaagctaaatggcaaatggacagggaggaaatatctacagcacaaagatgaaaggttaatattatatagaacaactcaaaataaaaataggtaaaagttatcaacgtgaaatttacaggtgaaataaacatgagaacatgaagatatctccaagatcactaataacttaagaaatacgagaaagtttattgaaatgctgtttatagcagcagtaagtagaaacagcctaaatgtccatcagtaagaaaattactaaaaagactaggaaatacacatatcaaagaacacaacaggacactttaaaagaatgagtttgagctacataaacaacatggaaagttctctaacatttattgtgacatgatgacatttattgtaaatcgtttaaaggtgtgtaatatgcacaagtttgatccttcttataaaacagcaggaaagtatatatttctacatgtatgtatataatttcatggaaatacacaggaataaagttatctgggatgatatacatcaaatgaataataattacctatggggtaggaattgctcttggctaaaaagggtaagaacgttcttgtactttgtacatcaatagatacttacttgatgtttaaattgttttgtcaaaaaaatggtttcaagtatacttaatttcatcttaagtttttgttgttgtttgagaagggatctcactgtgtcatccaggctggagggcagaggcacaatgttggctcactgcagcctcaaactcccaggaagaaatcctcctgcctcagccccccaactagctgagactacaggtgtgtgccgccaggccggctattttttttttttttaagttttttgtagagacagggtcccactatgttgcccaggctggtcttgaactcctgagctcaagcaacccacccacctcagcctcccaaagtgctgggattacaggtgtgagccaccacaccaggccttattttaaagtgaatggaagataaagaaataaaaatattatgtgtttaaaatgttttagatacttttagttatgatgacacttctcaacctaacttgtagtctcaaccatatttttatatgttttatctatctttgatttggggtggatctctcaatactatctttcagcttaaaaattatctctaacagtaaattttctagagtttatcttgtctacagtagtgttttaatttcaattacatttttcaattccacagtttctaataagttctctttcatattcatgcattcatgtttcattctgcctattttgttatataatttcttgctctttctcaatgaaagttctctcttcaattatcttcataataaagcacacttattttatagtattgatcagatctttctgctaaattaattttacccaaaatgaattcatgtttacattattgattaatcaagttgcctttctcagaagtagacttttttttttttttagaattttggtactcagtcttatttatactgaataaggtaaagtggcttaacagaaactagtcttgataaggtaaaccaaataagtgaaaatagtgccaaacacagattcataagcatcatatatatttaatgtcaattgttccaatcttttctcaactccaactttaaattttaatcaagttaatgaaaagcaagcctacattgttattatttaagtctgaatattcggccttcagaaattctgcaaaactttcttggttcagtaagatttctatattaagataaaaaatctatctaatgcaacgaacatccacagctgtcagctaaatgaaatgtctgggttttctttttttaaaaaaagcagagaattataaaaagtaatacactaaatagtttattttaacttagaaacacaaatagatattgatttgcctatcttttaaagttatttgaagatataaaaattatttaagaatagccaataatagaaattatgccataatcaccccattaattactttttttctatcttccatggctcccagcacatattttgcagtatctaactgaaggtattaattaagttatttggatggaaggatggatggatggatggatggatggatggatggatggatggatggatgaaatggaccaatgaatgggcagatggatggacagttgaatgggcaggtaggctgacaaataaaagaatcaaccattcagcaagatgagccaagtctgacctcaaattagttaaacctagagtgtcttagttacccaaggtaaacagagaaactaagtaccatacatgggcagatgtatggacagttgaatgggcaggtaggctgacaaataaatgaatcaaccattcagcaaggtgaaccaagtctgacctcaaattagttaaacctagagtgtcttagttacccaaggcaaacagaaaaactaagtaccatacattcaggattagattttccttcttttccatcaacattagcagaagcaaaaccagcaacagcatcaacaaacattcactaaaaatctgtcatgtgaaggcctctatgaggtttaccagagatacaaagaaataaaaaggactgcctctgcacataatccagttggagagttaaaacacacataaaaggatagattacgattcagggcaacttgtgaaaggtggcaagtaggtgagacagagaacagagtgagacaaaggaagaaggcaagggcagaagcacagtgaaagcacttcatggaggaggcaggacctcaactatggtagagaagagaaagttctgcagtcaaatgcacagtggcagagatgataactgtagggcaaagatgagatcagtttaacagaggagagtgtttgtaggaaagatgtgtagaagttatgtgtgattaaagaatagaagcaaactgtgaaggaaagaaatgctattgctattttttttctccttagcacgttcctccccccctttttttgctatgaatctcaatattttagataagaacattaaagttcaaccatctacccccacccctgtcattctagttacagtaaattgttattgcataaatggggactaggtattctcaataataaactacattggtaaaaataattaatggatatgccataaatcaaacaatcatatataataagtacacttaatagtacaagtttatgaaaaataaattgctttacctacttgggagttagtttaggatcttatagcacaaaaagcacacatgaaggaaataaaaattgttgatccttatctagcatcatttagccagacactgtagtatatgcctctgattatcatttcactaacacttactatatactctgtgaggtattattgtcttgtgaataaagaaatctaggtttgtaatttttatccattaatgagaaagaactagcaatagaaagaattagcaggaattccacattcttgtccctttgccccaatattgcatgcatgtgcacatgcttaagatttgcagttggcaacaagcttcaccaaaaataaattctgtcaatacaactatttatcctgagtctcaagaatattgtcccaggagtcaataactaccttttttcttgatcccagtacactacaagtgagctcctctggattttatttgtacaaacgattcttccttcaaactaaattactgtaaaaacacttaccacaaaggaaattgctaacaaaatcattatctacctcagtacaaactaatgttattactttcaggaaacagaagcaactgaattatataatagaaatattagtttaaaaggtcactggatgtcagaatgtatcattttgcagaagcctcttgagactattcatcagaaattataatgcttagaacatcaaattcaatgccatgattcagcagatctctctcctccctggttcatttagcaccagccatgaagctaagtaaagggaagatagttattctctctgaaaagagagagtatttctctctgaaataattccttccacttgcaattaagaagaattaaaaaaaaagagaggcccatgtaagttgttctttattaatatacacctaataccctacataaatatatagaacatacaccttgacattagctctaggaagaaccagcttagccctacaccgcattttacagatgaagcaactaagacacagtgaagtaaagagtttaaccaatcaaaattgcagaaatagtgactgaaaaaactggaagtaaggaggagtaattaaacaaactacaccactcctctcaactagataaaaactattcagtacaattgaacatgaaacaaagatacaaaagctagtaatgttttcagtcctctatctcattcaaagacttcaactcaactttttattctgtacctatacttgcatagtaaaagaattttggtgaaaattgactagttagccttctgtaatatatcaaaataccttccaaacaccatactgaaaggaactgaggctaaaatagcattcaaaagccatatcaaataaggatgctatgttccaaaacacatggtttaagaactgcacatagccccccagagtgctagttgggattctcaggcaaattatagttgtcaaagaaatatcaattctttgtagatcactgatactaccattctatatacagaatactctagaaacaattcactgtaacatattaaacataatcaagaaactctagtacatgtggaaaaaatagaaaaaaaaagttattgggtatcaaatgaactgaaatccgaaagttcctttttcctgacttcaagttttgtagcatacacagtgcaaaaagaatcattattattgggcaacaaatatatctatagtaattcaatatgatccctgaatatttgacattttttgttctgttacagacttctttgtacttcaaagagatgacagcctgataatacatccattcaactttttcctatgtcaaaggaaaagctgggataaacagaaaaatataaaagatgttattctagttgttcttaaaaaacaaagtaattatatcctatttagattctttaagaattaagactgtgtatgttttcagccaatatgatccctatttcctcaaaacacatctctaatgtccaccatactttcaaatatagaacataatagaaccactttggagaattctttagctgtatctcctagggcagaacatgtatgtacatatcctaggtcccaggaagtccactcctagatttataccaaagagaaattcacaaatgtacaggaaagttcaagcatttgtaatagccaaaaactggaaacaacccaaatgtctattaacaagaggatggaaacataaatcatagaacagtcttacaaaggaatactacatagcaaaaaaacattgaacttctgttataaatagcaggaatgaacctcacctgcacaatggtcagtgaaagaagtcaggcacaaaagagtacttactataagtacgcttttgattaatacacacttctggcaaatctaacctatggagacaaaagtcatctgggtaaagacaggaaggtcacatgagggaggaaatgttctttatcgatattgatcagtgtgataattacatggaccaatactctggaaaagttcatcaagctgtactttcaagatgtgtgcacatttctgtttgtatgatatacttcaatttttaattttcaccaaaaatattaagtatatgttagaatttttcaaagattacattctgcagcaatgaattcagcagagcaatattgagaataattggattctagtaataattcgtctactaatcagctgtgtaatcaatctttaatacaacctaacctctcagtgataattctggtagccaatacatcacacagaaaagttctcaagatattaaatcaattttattcatttaacaaatatttactatgagccactgttctaggcacctgtctcttgcattctaatggagggaaacagaaaatactcagcaaacataatgaatgaatatatgaataaatgatgtaaactgcaatcaatgtttaaaaaaacatagttacatacatatgaatttgtacgtgtatatatacaccaaatgagactttcaatccagtcttaacacacctaaacatatataaatacagaaaggaaactggcttgaaataactatttcattatgatctaaattaaaaccattcccatggtaaatgctcctgcataaatctttataaataattagccttgataacatatgaaatatttaaacatatccttgaaaccacagaggatagagctagaaccaaaaaggcagatttttcaaaggaagaaattagttcaatattgctatggtctgaacgtgtcttccaaaaagcaagttttagaaacttaatcccaatgcaacagggttgaaaggtgaggcctaatgggaggtgtttaggtcatgcaggctccacctttatgcggagattcacactaattacaaaagagtttgaggctgtgtgtttgatctctcaccctcttttgacttctttttgctcttccaccacaagatgaaacagcaagatggccctcaccagatgccagctgctcaatcttagacttcccagactctagaaccatgagccaataaatttctattcattataaattacccagtctcaggtaggctgttatagcggcacaaaacaggccaagacaggtatttaagaaagaactttaagtaaccaaaatattttaaaagacaatattaaaagagagatttgatactggattgtagaggagaaataacttttgtatttgggaggaaggttagatttgacttatagaaaacttccagaacttaaatttgtcaattgggagttttcaatatatactaaaatattatatttttataaaatcttttttgcatatatacaaaatacaaagaacaaaggttggctgggcacagtggctcacgcctgtaatcccagcaccttgggaggccgaggtgagcagatcaagaggtcaggagatcgagaccatcctggtcaacatggtgaaaccctgtctctactaaaaatacaaaaattagctgggcgtggtggcacgtgcctgtaatcccagctactcaggaggctgaggtaggagaatcccttgaaccagggagttggaggttgcagtgagccgagatctcaacactgcactccagtctggcgacagagtgagactccatctcaaaaaaaaagaataaaggtcatatacaattttacactggtaataaactgacatttgaatttctctgtattatcttattgatcttaaaaatgctattataattacgcaaatataattatatataattttctgttcattattcaacgagcattgtctagaagtattttaaatatgtcaactttcactgtaattctagctagcttaaaatttttgtagtagtaagtattcactctttcaaagatacacgaatctctaaaaagttatatgatttctttaaaatttaacacccttctaacataaaagttatgcaaaaccccagcaaactaccaaaacaaaccatgtatatgctaaactcaaattgcctaaaaatttaaataacagaataaagtagcaataagattcagtgaggacctgtttataccactccctggtagtttcaaacagtctcattgattaaacctaaccaagctgaaaatccttgcaactacctattatgcatactagacttttgcagaatattatcaacaaatatttattgagtggttgtatccctttccaatctattattcacactacaattacaaggatctttgttaaatgttaattgtatcaagtcatgcctcttctaaaaatcataaatggccccctgtctaccacaacattatatctaagttcttaaaatggctcttggagtattataacatgccctgctcacttctgtgacttttcctttctctagtctctctgaactaaactcttcaactacagggatccaacttcaactcctcttctgagcttttcagattctggctctaatcacaagctatcacctctgcctaccacactatatcctgtcctttctaacttccactcggccttcactattcagctgagacatgacattcacccagaatcctttcctggctcccggcgcacccagtgcttcactccttcagcaaccacatagtgtgtaatgtcccgtcttctccactatcagcaagagagggaccatttctctgtgtccctgctctatatacaatggcacttagtaaactcagtatctttttaatacatgagtgaaagatatcaatgccagccccatgctgagtccttgagacataacatagaataaaaatgtatttcctgcacagagaatttgatggtctaggtgttcatttacatttgaaaaggcagggtgaaacagaaagtaaccttgtgatcaccataaactcttcaagctttattttcctcttctgtaaagtgaggaaccttcaccaccccattttgtggtacaaccatcatttactgatcaaaacagaaaactgatcgtggtcattgtttcttctctctccctgaaacgctatttcccatacaacccaaaaagtctcggtatgaacctgcaaagggatattttgaatctgaccacttatctccattttttctatactcacagtaatccacttcccctctcttagacctctaaatgcattatttccattcttgccccatccaatttattttaatatagagctgtcaaactataaatagaagtcactttacttaaaatctctctcaatgacttcctaccatcctattaatgatctgatttctactgacctctccaaacatacctccaccagctttgtcctagtaaagctccagccacatggcctcctccagatcttgcaacatgccaagttttttccacctcagaacctttatacatgctgttcattctggctagcacattcttcccttcactttgtgtatgcctgcttccttttcttccttcagtttcaatgtaatacctcttgaaatagactttccttggacaccatatctaaactgaactctcaatctgtattcctgtttttctctattacccattcactgatctttccttctttgttcttcagcatattcccaatagatagagccatgtctggcatacagtagaaagactaaaaatgatttaggaaggaagcaaaaaggcagggaagctgtctataggtgtaatatatgcagactattttgatgtgaacacaaggttcttattttctctaaatttcaccttcaacagcctaacacccatcagtagagatggataaatgccttctgttttgaacactaccgttcatacataagttacctgagattaagtcatgtattaacatgtatcaatatagctgagtttttaaaagtagatcgctgttaccttaggaaggacaaacaggagaatggaggaaaagaagataaaacactggagaattttaataagagagaacaagtcgacaaagttctgaaaatgaagtggcacctaaaggcaccaggaagaggccacagtgataaatctctggaggagaatatgaggcaaaacaacatttaagtcccagaaacccagggactcaactcgggtataacagtagtaaaactgacagggcagaggtagtagtaaagataaaccctgagtaactcacatacagttttccttagagttttattgaacagatttattaagaatgaaaactggaaatttcatataatatcacataaaacattatccacattttaagattcaataaattcctttatcactcctgggcaaatctaatattactaaatgtgtaatattactaatttgaggtcaagtaaaaattccaagtagacagatttttacatcaaactattttagttgtgcttcattagaaagctcaacatgatcaggttcatttcctcttggtcacctgaggcacaatttgctacccaccactctgcaataagcagctgtttgcaataagccctatgttgcacacattggactgtctcctggggtttacaggatgttgattcctaaaggccagatttaacactttggggaaatataaaagacagcatgcaaatacagaagaagaaataatgtatggtatttgattatttgaggactgcaacatattacaggaattggttaccacagaaactgtgatctgtaaatggtccaggtggaatatgcttgaaaataacatgatatgcaaaaactgagttgactcatagaacatcagaggaggctagtgcaatggagattatctagtgggattctggctagtggctaacaagtctagctctgtattcaaagtactaatgtcccatttgacaatcctgactggtgaacatcaggcctccaccaaaatagctgctatactgtccaggtcattttaaggcagctctgttatggaattcttcatattgagtgaaaaacctacctaaactctttaatatacacccatgtggctatgctccttagagccaagagaataaactgaattcatcttccacatctccacaaatacttggaagcagctattgcatatcctcttgcctcagttttcttgtcttcagattaaatagctatagcttattcaatttcaaccattactgcaagacataacattgggttatttcaattacctaaccactctcttctaaatatgttgtcattgctatatttcaatgatcaaagacaaatacactaagtcaacgataagaaccatcatatgtagtaagtgctttgtatgtcttatttcagtaaagcctaatatggaagacattataatcaccaacttataaatgaagatactgaggattacagaaatagaaatacttgctagaggctatattgggagtaacaaagtcaggaattgaacccatgttgactccactatgccctaacccttgtcctgggctatttcaggagagacctaagcagagcagaggagagaagggggtaagagacactactgagcatctgttagatccagaatctgttattcaatatgtaagctgactcatatattcaaactatctatgcaatcaacataccaactacatttttctccaagtagtttggatggagccttccaaatgatccaggaaaaagtgtgaacttacctcacacttacaggcccactgagttttttaagtgataaaatttatactttcactatggtattttaaaagatccctctggaagtatacatggacagataaacagaaagccacactagagactgagagcttatagctctgaggtgagccaagacaagaagctgactagattacaggtgtgtagatggaacaatatttatgaattcaagagagatttttaaaagcagaactgacagtacttggtgatgctttagatttgtaagctgtggtatagcagtgacttagaatgtggctctggtcagactctgggctttaaattccagctacaccactttaatttgtgtgaatgaagctatactttggtttctgtaactgtgacataggcacaagagcacctaactcatagagatgctggcaaaattaactgtgataatagatggcagagggtttaaaaagtctctgtctcataagaaatgttcactaatcactaatgtgattgataaggagaagaaggaaaaaaaagaagagaggtgggaaaaggcagtctagaacgactgccaagtctctgcttaggtgaatgaataaactcagagagaacagaggcagaaaggctggcttgaggaagaagaattttgttctgaatgtgatgggcttgaggtatgtgacaggcatacagatagcaatagattgaagaatatggagtgtcagcagggtagtctagccttttaaagaagcttggttaagaaggaaagcagagaggatgtaagggccagaggagggaagtgacttatttttatgggtacacaagcaagttagagtttgaaagagaaatgccagaagacagggaggggttgaaggtaaaaacgattaagaagtggacgaaaccagtctccaagggacaaggtcaggaattaaactcatgttttgctccaaagcccctaccctaactcctgacctgactacttgagcagaaaccaagccagggcagaagagagaatggataaccagagaaacaggctaagagcacaagaataagcttcaagcaggactaagaggaacagtaggaaagagggaaggatggctacagagaggaagcctctctccggtgttcatatttcccaatcacctgagatcagctccaaggaggttggggagtagagggttgggcttgagtatgattatcagatttagaatatatgaaaaaaacaggagagaaagggacaaaagaaaagccattcctgcaatgagcttctactcaatctttcaaggcccaattccattgtgtgtcatctgtgacatagttccccacctttcctctttcataaatgaaatttatctctcacagaaaattttattttaaaaagttctatcaagactggattaagaaaatgtggcacatatacaccatggaatactatgcagccataaaaaaaaggatgagttcatgtcctttgtagggacatggatgcagctggaaaccatcactctgagcaaactatcgcaaggacagaaaaccaaatactgcatgttctcactcataggtgggaactgaacaatgagaacacttggacacagggtggggaacatcacacactggagcctgtcgtggggtggggggaggggggagggatagcattaggagatagacctaatgtaaatgatgagttgatgggtgcagcacaccaacatggcacatgtatacatacgtaacaaacctgcacattgtgcacatgtaccctagaacttaaagtataataaaaaaaaagttctatcaaagtatttatgaagatgaaatacttctaaagtgcttatataaaatctttatatgagaagattttatcttcataaatacgtctctccaactaggtcacattttgtttaatgctaaattctcatccactccctaaaacacagtagatgttcatgttttcttaaaaagactgagccagttttcggtccatctaactatactctaatacacttccttctccatttcagtatgttagaaaccaaatgatgcagtttttgagaataacaaataaagaaaacctgcaaaattgtcctaatagcaaacagttaacatgagtctgccctacgaataagatcattgcttccaaacgtttttaaaatactcccaatggtattattagtatcatttatagaactagacttgtgtgatagtctttagaaactgttaagatagcattaaaatatatctcataggtccctcgatgctctcctggtacaaaatgaacctgtgccatttacatattagctgactctgacatccaagggttctggtatctgaaagcaatgaatatgacttcttctgtccatcttatgtgtatctcataagctcctaaggactttcctggaaagattttagactagcaaagaaatattttcttcatcaaaaatcctttcaagtatttatttccttcccaagtagactgagttctgtgtgtactggttaatactttataagcttcagcttgcatgcagaacacatcagaggctgttttatttccagacatagttttcctgaaattttaattgtttgccatgaggaaaaaaatgatttcagagctcaaactacattacctacgaggagtctcccagagctctaattaccagaatcagaacataggattgctacttcaattccatttttcactaaaatattggcaaaataacaaattaaataaaattatggctaatgttaataacaataaattatttaacaaatatgaaggagcacctatgttgagcagctgctatgttaggcattgggatggtaaccaaaatgcatgaaacattgtttccactcccccaagaattttacaggcaagtgggatgcaatatacctcactatggaaaaaaaagtgagacagcaaaaaatagttttaaatttttgagcaaagtttaaccaaatgcaacccagttaatttacatcaggtgcctttctctttaaatttcaaatgataaaagtcagcttctccctctaaacttcaataaggcaaataaatatttcttggctttcatgaagccctaggagccttaactatgcaacagttcattcactaagaatgcctgtagaggaagaagggtagtcaggtggtaccagcaaggggagtagaatgaagtccctgctttaaagagagacaagagctagataaaacagccactgaaagaaaggaaaggaaggggaggccaaagaaaatacatggcttctcttagtagggccaaatcatgaggcccaatccagccttctagcttgacttcctctcctattgtctctcaggagccctctccctgttctagtcaaaataaatgtctcttctctgatgtagaataagagtccccgacccacacccaatatcatggctctcatctactgcatgtgagctcattactttatttatcaaaacaaagatggtccttttttttttttttgagacggagtttagctcttattgcctagactggagtgcagtggtgcgatctcagctcactgcaacctccatcttctgctttcaagggattctcctgcctcaccctcccaagtagcttggattacacgtgcacgccaccatgccaggctaatttttgtatttttagtagagagggggtttcaccatgttggccaggctggtctcgaaatcctgacctcgtgatccacctgcctcagcctcccaaagtgctgggattataggcgtgagccaccacacctggcccagatgttcccttcttaaaaggaatcctgatgttaactattaaaataataaactatattacatatcatcaagcttgcatatatacatatatatatatatatatagttggacttatctttattttttaaatattagtgtatattattataaattgttaggctatgaactcattgaacagggccatcttagtgtccccagatcctaaagcagtacacagtaggtgttcaacacactgtaatgttacaatattccttcctcagataggggggtctaggcatataataattatctgcattttatatgatcattcttcataaataatcatagccacaatagcagcttttatctgaagtcgtgtattgattcagagaaggtttcagcttgacctcaccatagaatatcaacttttcacttcctttctatagagtattttatactataggaaaagagactctaacacctcttccaaaaataatccataacatttaatagtttattcatagtcaccatgaggactttgacctctcatcttttgtatctatttttaattgtgttagaggccacattaccctaatttccttacaaagtttccacttagaccaaaaccgtgaatactgtaattgttggggatgatgaattagatgaaaaatagactatgcattttcaatcattgcatttagtattattagggtagatggccaactattacacagtaagagatgaaagtacaatgcaaattgatgaagaaatcataatcttaaaattttcaacaacaggctggtattgattttgatgtgaaagtaaaaagcttacttaatacattttttgctcaattcgctattgcgtgtacactgggaaaaatatcttgcattctataccaacccattaaatcaaaatgaatgaggggagcatttttattttatttatttatttatttatttttgagacggagtcttgctctgtcacccaggctggagtgcagtggcgcaatctctgctcaccgcaacctccgcctcctgggttcaagcgattctcctgcctcagcctctcgagtagctgagattacagacgcgtgccaccacgcccagctaatttttgtatttttagtagagacggggtttcaccatgttgaccaggctggtcttgaactcctgacctcgtgatctgcccacctcagcctcccaaagttctgggattacaggtgtgagccaccgcacccggcccatcttttttacttacactgcactgtgtaactcccaattcctgatgatagccagctacaggagcaattcatcaccaacatcattttatcatcaagttctttcatatctgataaaacctattcctttctgacatatgtaaatttcaaatgagtgctacagataaaaattgttaaataagtggctataatgtgattccaaaaacaaaaggcacccactcactgtactttgttatctaattacatgatcattctgttaaacttcaagcaatgtatttgaaataagaaagtgcagacatattgtccatctcaatttcataaatgttgtatcatatatccaatgcatatcactttaaattttttcaacctgcatatttcaagacagctgctacacagtactttaatttttcctgtttgatatattaacatgcagctgaatctgatttggttacaacttctcagtgaaaaagatgttcatctacttaaacatcagtttcaacagaatggcacttgacagagaatatttcctttttctgtactactttttccagttgcattttatatcagtatgcttcccattaacacaacaaatatatacataaaaccaagacatatgtgtaaaaggtataaatgcagtcaattagccagatgtttggaatcatggacacaaacatcagaagcattataaaacctacaggaatggtaatgcttgacaggatatgggagaagtattttttaagaaaaccttataaacatagtacaaagatgacaaagacacaattatagcccactgcagccctgaactcctgggttcaagcaatcccctggcttagcctcccaagtagctgggtaatgcaggtacatgccaccatgcacaactaactttttttttttttttttttttgatagagatggggtatcactgtgttgaccaggctgatctaaaactcctggccttgagtaatcattgtgcctcaaccttctaaagtactgagattataggcatgagccactgtgcctggtcatactgttttctgcaatagaacttacctcctctctctcatgcttctgtagcaccaagtatcagaaaacataatctagtcatttctagataagcttacatcattctgattttcctcagtaatttctgcatatgctcatcttaagaattcatgacttctcatccttctcttccctaaggtgagggttacgtggtgagggaagttcacacagcagccgcatggtatcggtgagaggcattggacctgtagcactctgatttggcacctgtcaagtctctagtcacagcatttgtgtgatcgggttttcagtgaactatctgtagtcttagtagactctaatcatgtattccatactaccattcctggcttcttctcaacattactgtgaggtcctttaaagcactggtcttgcatccagctcccttgttctgcccaaaagtgcatgaagtctcaactgccttcctgggcccataggagcctgctaactatcttctacctgctttatctacagacttctctcatatagttaaccatctccatctaagtgataccatgtcattcaatatgggacacacccatgacattgttgcttcacaaaattccagaagaagcaggctgtgcagccattccaactctgccaccagcacactatcatcagacaggggccttagataacgcttgccatcccctggctttcacctggagagtgaagcacaaatctccaatgctcaaatcttcaactaaagggagcttctatcattatccctggtctcaggctgtagaggaaagaaaggcagaacacagggctgccatgtctcctgaaccttgtttcaactccccttctaaccaaggcaacacttatttaataatgtgatgagatcatctcactctttggctaatttctttccaatctgttgttaaaagttaaaataaaaataaatttatgcactgatatcttcagagctttattttaaaaactcaaaacccttttctatttcatatagctcagctgcttgaaatacactatcttgtgtgtcaagattattaagccaactagaagtttcaggagcctacttagaactcagaaaaaagaaacttaacttttctttattgcattaacactcttctctgaaaaaacattgtaatggcaataaggttccgtccagttcagtgggaaaagggctatgggtattgaaaacatatacagactacatatatacataaatatacacatacacaaaaaaggactttctcagaatatacaacttaatatatcaaaagactatctttatacatttttatgatagacaccataaacatagtcagctatatatgttacataagttatgaatagaaaacactggttttatccacatatttcttctttctccttcttctgtgtcttctgaaaacatttgaaatatcaaccatagctgcctacatagggtcctctgacagaatattaggtgataaaatggtataaggagacatataattgaagtggtaagaccagatattactcagagagaatgtaaaatcaataaagagtagaacatcaagctttatatttaggaaaaatggggacagaataactctgataccaaaaaatgaaaaaagacatcaggaaaaaactacagaaccttatttataaatataggtacaaattttccaaataaaatcttgataaatccagctgaatagttaaaaatatgaccaaataagatttaatccaggaatgtaagacaggtaaatttaaagatacctattaaggtaacatatttaccacattaacagataaatagagaacatatatattaccatctttattgatacctagtatcaaaggccaaagtacttgaaaatctaatttccacctaaggtaaacaaacagcaaccgacaacgaaaataaagctcttgaccaactggaaatagacaggaaaaatcttatttgataacatatgaggagcctaagggaaatattacattaaatgataaatatcagaaggatgcccatgaaagtcaagagggacgagaggttctagtcaacaaagaaaaaaaattgagatgtataaggctttaaaaaaaaaagaaagaaaatgtgttattttgaataatatgactacctagaaacacacagacaataaacttaaaaatataaataagaatattctgaaatatggttggaatcaagatcaacattaatggccttcttatacacagaaataagcaactggaagacttattggaaagaatattttttaacaataacaaaaaaatatggaaaacctagaaataaacctaagaaggaatgtgcaaagtttatatgaagacaactataaaatttaaccaaaggaaatacaagaagttctgaaaaatgaagatacgccattcattcgacaaaaagttaaatccctaccctatcctggaccctaatctcaatagaataaacacagctatataggtactagaataaaatattagagaataaagagaaagtgaaggatctgaaaaggatactactggggaaacgtactaatgaatttagtttttcccaaggtaatctttagcagcagcatccatgaataacttttatgaatgtccaatttataatacagtactctaaaactgacagtttttattgaatataaagaacaatggttgcctgtgaaaagtgaaattaaattttcttcttaaaagttcctttattttttacaatgtacatcgaattttttaaaaatcaaaatgaataaatttttaaaagttaaaaatataatgtacataataatactaatgcatgacatcagtttggtgaaatatttttcttatataaattaattatgaaaattagcaatttatacactataaatctttaaccagatactgtataaataaaaagtgttattactcttcaaaacttcttcaatgtaaattgtaatattgggctttattacttaatgtatagaatctgtgtatatcctcttaattagtaatttcagatattttttcaaaatttctcttcttcagttattctcataaatacccaccagttttaagagcaattttgaaaacttctactcaaaacagaaaaacaataaaaaaacagggaaaaaatagaatagaaaaaccttctggtcactcataagatgtacagaaatgttgttcatgagtaatcttttaaatgttcacctctatatcaaatgtaatttattttctactctctgagcaatgatccaaacatatttgaagctatttttttaactaaggagaacatacaattagtctattttgattttgcttcatatttcaaaggtttgtgtttaagctttattaatagtgctctttaagttattttcctcccaataggtctttaattacatgtatctgaaaatacaaagtctaattctgttagaaaacttaatgattcttaaaatatttgctttcatgagtatatgattatctgaaaaacaaactccaaagggcaataattaagcgacatggggttccacataggcagaatttagaaaattaaactaattttctattttatttaatttaaacattaaatttaaatttagaaaattaaacatacaccatatatatatacacagaaaacttcatattgaataaaatacaatcagctataaagtagattaacagactcagattccttttaggctagtaaatttgactcattcaacatgttcagatgcagttggcccactgtatccatgggttcctcatctgtggattcaagcaaccaaggattgaaaatattcaaaaaaaaatttgcatctcttaacatgtatagactttttgttcttgtcattatcccccaaacaatatagtataataactatttatatagtatttacattctattaggaaatatatgtaatctagaggtgactttaagtataagaaaggatctacataggttataagcaaatactacactatgttatatcagggatttgagcatcctcggattctggtatcaagggaggtcctagaccagtccctcacagatacagaggaatgactgcaaccccttattcaacgttaaatcccaattgtacgctttttagtgtagcactgaaaagttttagaagaattctcatataaacaatgctataaagttaactttccagataaactgaaataaaactggtttttaaaaaaagaaagaattgacaattttatagttatttttattcataagattttaaaagcatatataggctgggctcagtggctcatgcctgtaatccctgcactttgggaggctgaggtaggcggatcacctaaggtcaagagttcaagactagcctggccaacacggtgaaaccctatctccactaaaaatacaaaaattagccaggcgttgtggtgggtgcctgtaattccaactactcaggaggctgaggcaggagaagcgcttgaaccaggaggttgcagtgagcccgagatggtgccattgcactccagcctgggcaacaagagtgaaactctgtctcaaaaaaaaagcacatatatgcaagctacaagattactatcaactggtacagtactttataaactacaaactcatctttgccctaggattaatcactaaccacttcaagaaggaatgtggacacagactggcccactgtagcatttaaagttttttggctaaatacacacatctgtgttgttcttttcaaaccgtcaagatataaaactcatttaaaacctatttttaaataccatgcagcaatgatcccttagaggcagcaactttagatgatgcttaaacaatgaattttttttccaacaataacaattttctttaaattcatttacaaaacctcaccacacagcatgaggtatactttcctggtaagcaactataaagtagaattaactatcctcaaatgaccatgaaattaagtcagccatatcagattaagatgaccataaatgcagttaaaaccatgctaatttacatagccccctaaccatgtttaattgccacattaaaaacccttcagatgctggtctgtccttttacaacttagaacagtgtcacctgaattaacttgttttgtctgaatgttgcactttgttttttcatttatatagctgggaacattcatgagctctagttattatgtctaaatatttttattaaacagaataaaataatcaaatctatcaaactggttttaatgaagtaagcaatgcatttttaaaaggaagtactctcttagccctaagcaacatgagtcatcatgaagaaattatatatatatatacttatccatttctatctggtacttttaaccatgtggggcatgccaatcttcccatgagcatggaaactgaaagtaacccaagggcactagccagctttggaattactgctataatgcctcctacaccacacccatcacactcccatactctgatttctgcaagccacagcaagccaaggttttcaccctagggcattctggactcttttgataccctatctcagagtagaaacccaatctttgtactgggctgtcaaccattcactttttagattcagagtacataatcatttggcttgtttttgctataccctctgggtgcctcacactctagaatgaactatttgatttgctgacatctagtatgtttagatttcccttcctttctggactactctttcacgtttcctcacctaccccacagcctcagatgcattatcttactaccctctattctcagctcctcaatgaccaggatataaccaggaactgaggataaatcatttattccacttgttacttaggcaaccccgaaacgttaatgaaagcatcttttgccatcatgtattatatagaatcttcagtaagcagcaatgcataacaagacaaaagtgactgattctgacctacctaaggaaaaaaaatcacattatcttgtgattatcttggcttcttccctaacacaataatctttggttaccataatgcctaagctcaattagaagtcagaaaccccaaagtatccacaccaggcagcaaagcaagaataatcaagattgacatatttcaacacacatatagttgcactgaaaggctcccttaaccaattcaccagacaaccccacccccaaaagaattatgcatgggtgaaatttctatagtttttgcactaaaagtaaagtcttcccatggctgccagaaatcaccaatatgaccgttctcattgttgatcttatgctgttatagcaaccaagggagacaactggaaatgggagaaagtctcttttagactgatgaaaattaacaagggacagaaatcaagatagtaaaggaaggagaaggtgctgtgatttagccagagataatcattgtcgacatactattatatttcattttagatctttttcctaggtgtgcagattagtgtactcaactccatttcagttgtgttctttcatgcacgctaagttagatagctagaacaaaagctaagctagaaagctaaagtttatttcctagacttcctgacagttagatgttggcacatcacctagctcttgccaagccgatacactggcattactttggaaggcaaggttaacacggtgagacagaggctggctgctgttgcctctgctgtttttactggcaaggtcagtgatacaaaaatttgatttttctgcaacgtagatctgaatgtccaaactctactttcatgaaaacaaaagctagggccagggcatccatgtgaggtggcctcctaattctccaggtttttgtttgtttgtttgttttaatgagacagagtctctctctgtcacccaggctggagtgcagtggcataatctcagctcactgcaacttccacctcccaggttcaacagattctcctgcctcagcctcctgagtagctgggattataggcacccgccaccactcctggctaatttttgtatttttagtagagacggggtttcaccatattggcccatctggtctggaactcctgaccccaagtaacccacctgcctcagcctcccaaagtgctggaattacagacgtaagtcaccgtgcccggcctctccaggttcataaacaccacagaaattgcagcttccttagccacctataaaatgagcagccactactccaagcagaaacatgctcattggttgttaagcaagaaataaactttcattgtgtttgaaccattatgcattttttaatctctttgttacataagctagtggttaccctaactgataaagagtccaataaatatttattgaatgaatgttaaagaagaggaaataaatgcaagaagtaggtggagggagggtgggaaagatggtgaaagataaatagatggttaaggatcttgattttttaaagaattaatgggataaatgttctcttggagtacagaattatttcatactattataattactaaattaataataacctatttgaatttcttttctattggtttttcagtataacatctgttcacaattcctatcctgttgaaatttatactctaatccactccataaattttaaaaaatggttttggtttctgattacaatttcgccataatgtgattacaatttcgccataatgtcattacaaatccaaaagtaagggaaagtcctccataatacatggagctaaaatcaaatacagacatcaacataatacatatgcaaaaactagatttccattttattacatgcatactaattattaaaatgtaacacttttgataatattttaaagcagtgtccccatagtgtgctctgaagacgccactctgatggtccccatgaaccttgcagggggtccataaggcctccctttcccaagtacatacctgtgtgagggaagattgttttcatacatactccaaatcaaataacattacacaacatattgaatgcaaaagcagatatgagaatccacctgtttgtattcggccagatattgaagagatttatgaaaatctaaaacaggcctggggcacagtggctcttgcctgtaatcccagcacttttggaagctgaggtagaaggattgcttgaacccaggagtttgagaccagcctgggcaacatagcaagacctcatctctacaaaaaataaaaaaattagtcaagcatggtggcacatatctatagtcccagatacttgggatgctgaggcaggagaatcacttgagcccaggaagtcaaggctgcagtgagctatgattatgctgctgcactatagcctgggcgacagagcgataccttgtttcaaaaaaacaaagaacaaagcaaaagtaaaatagtgccctcttctcactaaatatttttgttttgaaatatatagttatttttcataaaactgtcgtatttatgttgatacataataaatatttttatttttaaatgatgaatatatattttaaattttctcaatcttaatttccaatatgctaaatattgatgaaactaacccacagaacagaagctctttagggtcctaaatttttaagagtttaatgaaccataaataaactagtgaaatcctgtaacaatgccaggattccttttattaatagtaaacaataaactatatttaaatatagccaattttctatatgtacaaaatgctaggcagccttcctattgctgtagtagaaataacatggcattgaacacatgggtttaaataccagtttcataacttattaactgtgtgggcatctgttccctattattctcactgctaccattacaacaaactcaacgttatgcatatcaaaactaaaattgttgcattttgcaagcattcttgaagatttaattgtgcaggattatagagagtaatttatatataattatatacacttactaattcaattatctgggagtatattttagctaactcactattcagagttatactttctatagtagcagttgcagcataactgagtattcttaaagcaagcaattaataaactccaacataaaatttttccttgccaaattatatctgtcttgttctatcgaaactcaacaaaacatttacttgttcaagggactatgttgatccaaagatttcccttcaggaaaatgctggtgctgcctagggatactagtagctttccataaaaaaagtgttcaactaagagagctgtccaggccactcatctttgataacagaagttcagctttatcataacctgtatgtcaggcatccaaaacctaggaaactactcttcattactaacaagataataacctttcagtaggtattatctcaattctttttctcatctacattttacaaaatggtttgttgaagaaagttaggttctaaaaaggaagctctaaaacaatagtcttcattttttttctctcatattcctaaaagaattttctaaaaatacacaacatacattttcagttgacatgtaaaaattttcatcatgaatttaaatgattgcaaaggctataatttctagcatgttacaaatactgccatttttatataaaactgttataccagtcttttaagagtaccaaagaaatctaacttccacagtaatctgatatacaccagcaaccattttatcaaaaaaaaattcaagagttagaaaatttatacacacttttttgcttaaactcatttccagttatctccccataggattttaccctaatgtaatcgtttttatttctaaaagtttttaactgatcctctatcatacttctcttcaataaaaatgtaccttaaaattgaacttttaaattgtgtttaattttctaaaactgtaatgttcaaactaagaaatatatggaaatgtatttcttaatgagaagggctagatttttttcttttttaaaatagtttataggcctctgaatgaatgttactcattgctagtataaggtttcacatacattttttttctattttttattttctctgtttatgaaagaactgaaactgttcactaagtagatgagaaggatgttttgttatggcaatgttactaaatccttcaaaatcacatagcttattaaaaatatttgatgtgtgaaaactatcagctgttaactcaattacatctcccttaagtctgttgaaaccgaagaattagaaaccatatgagttgcaaaaggattttttaccttgagtttaggtcattcactttttcaataccaataccaataccaatacttctagctaatcctctgctatcatgatgcaagggaattttccatcctggagaagtgtacaatgagaagatctgggaggggcgagaagtctgccttgcttgttgtaacatgagtcaagagcaattctgaaaggggagttaggaaaggaaaagctgctttcactgtctttcacaggaggaccaattttaggacagactatggaaactgaggacttagattccttcaaaatcaactatgtgcaaccttggcaaacaatcatatacaaatttgaagacctcaaatctaagggacactattccttcactactccaagtgttttaaatcccttctctctgtctctttttttcatacacacatgaatgcaagccaaagcccattcacagaaaacaatcatataaggcacatctttgcatttattataaaattattgttggtgccacaataatcacaatactgaataagctctaaatccttgctactcaaagtatggacttcaggacaagagcataaagcatcataaccctgttagaaatgtggaatttggggccccattccaaacatactgaatcagaatctaattttaacaaaatctccaagtgatccctatgcagacaaaagtttgagaagcacggacctaagaagcagagaaataatttttaaaaatgtagtttgtaaaaaacatacctcttgtagaaataatatttcctcctttttgatcataataaagtaaccctcatgtttccatttttgtcaatcttactagcaccagccagtgtatttcctaagaccgttaaggcttgaagtaaaaaatatattggaaatgtatctcttcctcattatcctggatttctggagtgttagtctagctgatttgtctgcctacggtctttccccccttcaatccatcctctgcacagctgcaagagtagaatttatataacaaatctaatcataggactctcctgttttaaaaccttcaaggtatctccaaattaaaatacaagcatataaggacaagattacctgatccctattgacctctctagcctcatctcccaaccacctcccattttctcctgtacttactcttttagctccctgtacacaccacgtggttttatgcattacctttccatcatgttgtcccttaccagaatatccattccctatttattgcctagctgattatcacctgtgcctaaaggttcgattcagtaatcttcttttccagaaaactttcatgtaagatccccccccacacacacacatctacccctttatacacatacaatgggcaaaggttattttctttgtactgtcacagcacttaccattttgtatttaaataatatatttatatctctgtttctctatatagacagtaacctcttctaaggactaacaaaattaacagcacaaagcaggtgctaaacattaaaagtcaaattgaataaaacaaaacgtgattgttaatcataagaattgtaatagccagctcttataattagcatattcacttctctattcatatgcttttagtgttcttatgtcatctgctagttatcattttacttttattttggtttaaaaaaaatctacctcaattcttttttttgcaactaggcagagtatacatacgtatatagagcacagctctgtgactttggtgaaattacataatgtgtcttagtcacagttcctttattaataaaatggtaattacaggatcatattcagtaggtaggattaaatgaggatgctatagtcccagctactcggcaggctgagacacaagaatcacctgagccctggaggcagaggttgcagtgagtcaagattgcgccactgcactccagcttgggctacagagtgagactcggtctcaaaaaaaaaaaaaaaaggattcatgtgaaatattttatataaactataaacattggccaggcacggtgactcactcctgtaatcccagcactttgggacgccaaggcaggcgaatcacttgaggtcaggagatcaagaacagcctgggcaacatggtgaaaccccacctctattaaaaatacaaaaatcagccaggtgtggtggcaggcgctgtaatcccagctaccagggaggctgaggcaggagaatcgcttgaacccaggaggtggaggttgcagtgagccaagatcataccacttcactccaacctgggcgacagagtgagactctgtcaaaaaaaaaaaaaatctataaacattatatacataagtaataaaaattgcttattttattaaaatcatccattataacaaaaagtacagtggttagaactctaaacaacaggaaataccttaagaaataagataaactttaaataagaaggtcttaacctttctgctgctgaacttttaaaattgaattcagtataaaattaataccccgcagtggcctttgcacaatcctatatctccttagtttcctgtacttcacgaaagatgtaggagaaataagtgattatttgaaactgttcaggttttgaaacacaatctgctatcatgaatatttcatttcttgaaaatattttcatgcttatccttttcaataatgccacatcataatgctttatttcatctgcctgtgacagacatcattactaatcctatatagctgcttgtttcacgccacgctagagcagctattgaatttcctacaacatggcagccagtcctgacattcatatgaagaatactatgataaatatataaaggactataaataaggcaacaagaattaaaacatcataggttctgaaggtggcatcttgacttaattgaaagaaactcaatacataaccaaagctgaaggatgaaaaggagaaacaattaccaactagtttataaaccacaatttaatcaacttacagggcaaataaacctagcactcagatcttgttgaaaccgatttttatgaaacttggttttatgaaacttggtttttaatgccattcctcaccaaaaagaatcatggcttctggagaaatggctagcttcagggctagatagagaaggtacacaattatcctggagcaccttgctatgccaaaaagtaaggaaatgctcaaaaatgattttttaaaacctatcacaaagacttagaattataaaccaccagtaaaaaaattttctaataaaaagtagaaggaaatgaggaagaagggatgactggtagagcaggatgctgaagactgactagtaaatgaagaggaaatactggcactggtacatcatcattttgcaaccatgacaataaagcctggtccaggcaagaattattagtagatgctaaatcaagaagagaaatttacatgcacggtctctgagtatctccccatggattgctcattaatagcaaggggataagtagtaactaaaaaatagagaaactagacagtaccttgaccagataaatactgagagcttccagatgcgatgcctggaaaaggaaaatcatttatataatatcctggctaggaatgcaaaatctgaacttaactcatgagaaaacatcaaacagacctcaaatgagaagcattctattaaaaaaagaaagaaaaaaaaaaaaagaaagagcaagggcgctgtattcttcaaatatatcagtgttataaaagacaaaaaagcaagctgaagaattgttatagattaaagattaaaagagattaaagagacctgaaaaccaagtacaatacacggctccatgctggatcctgtactggagagaaacaaaaagcaaatgtttataaactacattactaggtacactgacaaaattcaaatatgaatggtaagttaggtaatggcaatatattaatgttaaatttactgacactggatattatactgtgattatataaataaaatgccttaatcttaggaaattgcattgcgatatttagaggtaaaggaaggcaataatatctgaaactttcggaagattctaaaaaaagaagaatatatacatatattcattctctctatacatatgcattctctctatatattatttcataaatacattcattgtctctgtatatatgtatacacacacgtatatatgtggagaggagagacagggagagagatcacatgataaaaccaatgggacaaaatactagcatgttaacacttgctaagtcctagctttagaagaatataggtattctttgtaccatctttgcaactttgatgtaagtttaaaatcatttccaaatacaaagcttgaggggaaaaaaagcaggcaaaagataaacacaaaattcaggtactgtgagagagaggaataggagagaggaggaacgcacagaagaatatgctgacagtgttctcggtgacacttgtggctgttcctcttattgttatgctttataactacctacatgctacatatattcctgtgtgggtaaaatattacgttaggaaatattacatcagaaagaagaataaagaaaaaaataatgttctgtaaattgttttaataatttcttcaaaactacaataagaatacgaagagccctcacaatgcaagcacaaaaggacatacgctaataggtatttccggagtaacaatcattaatttgtttttattcctactgggttaaaagcataatactatatttaggtccagttagttagttaccttcattcttcctcaatttggtagtacttgtttctctcagcaaaaaggctttttttttttaacacaacatgtagtacagttaacaagagttaatacacagaattatagctaacatttattgcttactaaatgccaggcactatgctaataagtacttgatattcattatatctttcaattttcacagttacttgagcaatatatatcctattattttccctcttttcgcatggggaaaaaacagaaatagaaaggttaagtaacctgtccaaagccacacagctagtgtgagtccaaatttgaacccagagactctcattctagacctcatacttgtaaacaacatgctccactgcacttgaacctgagattctgatctcaaatagttcttacattgaaaacagaggtaaaatgcccatatagtactttaaaaccagtggataagcaatagatgatagctattatttccattcactgagcaacaaacgctgtacataaaataaagactatcttagatttgaattctcctcttcgtttttccttttgaccactcattaaaaaaaggaaaaggtattattaagtaattaagatgccaccagagacaaaaggatagaaaaacttttaaaatattctcaatctatacacactagataatccacattttataaatattgaatatgcttatatggaaaatgctggttatattggatataggaaaaaagagttttccagcacaatagaattatcaggtgtattaagtggatatgtcattttacggcagcccagcatccagcccttttcctgacatcacccctacttcttttgggggaattttctctactatgcagtcctggtggaagcataaatccaaatacatgttctccattatggaaaccaaagatgtcttttaaaggctacttccagaaaactctctgctcagtccaatggtatagggaagtgaacatataacccaagttcagtcagtcagacacattctctcaagacttagtgtattaagcagaatcaatgcacataccaaagacgtggttagagtttatttacgccagcaacacagcctaacatttttgttgctgttgttcctgaaagttcttgctaccaagaccttccagatctgcctaattcttatctgtttcaagcataactctttagtctcccttcaatcctgtgagcttttcccatcccagataccagatatgtctaacaaactccttttttgcttttaagtcaatctgtttcctttactggcaacaagagtaacaacaacgacaaatctgtaaaataaaatataaaagcataaggggataaaattatataatcttatttagcagttctttgggtgacttttattcttttccaatggtttagtatactggaaaaagtactggccaaagtatttaaagagctaaaatctagtccaggctttccatcagctggcttcaacatctgaagtgtgaattcattctggtcctcattttttttaaatatgtaaaggaaaatggtttgaacttcaagttttgttatattcataaaatattatgttttatagaaaggaccaaagatttcaatgacaataccaataatacagaccttcttttaagaaattagcacatgaatgactgttacagtatttcctattcttttttaataatagttttcatagaaataaaatgttacagtagtttttcaatgacaaacaggaatcaaatactttcagaccatttccctaaagggatgacattacatatcttagaagatttagtggtaagaaaaaaattggtttgaaatattactctcagtaaatagcattacgtttgtaagatctacaggcaaaacaatgcatcttctataggtttttacattttgtaataccacaacattctcctgaaatgtaattcccttcatgttttcaaatgttttgctacagttgtataaaattcattggtataattactaaggaatatattcataatagtactaggatttcaattttcatgaaagggctaaaattactcgtgtcaaagtcaggcaaaattttgcaaactggcattaatcatggattggtgagagtctaaaaagccagtaggaaatcatagaataaggtcagaaggagttttaatgttgaaaccaatatatcaatagaaaagtattgctatcaattctttaaaaattaaaaaacaaagccattttcaaaagccaatcaagattaacatcattaaatcacatctccaagaataataattatttaattttaacacttatcaagcattaactgtatgcttgatttaaaaagcaatgagactttgttcttctcataaaagttttatctccctagacctaggcttagatatactatttgttaccacctctcacagcaattcaaaacacagaacaactatcatggcagtcattatgctaaattctagatggtaaagaggaagatgaattagtccttggtcttaagcactcaccgccatgaaatcaactcaatataatgtgatccatgctagaaaacaatggtatttagtataatctgttaaggaagcaattaattctgtttagggacagaggaaaacctataaagaaaaggtgacatattaaaattttataaaaaatatcaaaaactcttatccagacaaaggacttcattgtcggtcagatctgagtttaaaccccaactctaacctgtgttgtcatgtgaaactgagcaagttgtttggaaacctagaatctaggcctagttctgctgctcttaaaccatgccctcaggcaacatttaacatctctcagccccaatttcaatggagagagtcagtgagtcattctctatgatccttaatttcccctccagtaataacatgaatctacaccttatagtaaattagagaaattcctattgatattgaatgtgttcatttagcaaatacctctagaatatccaactaagtactactgggcttagcaagtggaatacatcattgaacaaaataagcaaaaatctctgttttcagggagattacacagaaaacgtctatggaaaaacttttaaaatactttattgcacccttgttcaaacgtaacttccctgtgcagttgacatagacgttaaaaatagttaacacttgaaaatttccaaataaccataaatattaacacagagaaagaaatctagatagtgatgaagcataattagtagcactaccatcaaaatcccgtttctctaaattcacactgagtcagtgagctttagtggcttgacaaaaaggcagcatgttaacgagattcccctaaaccagtttagtatatagccatattttttttctcatttaaattattccatagtttcttaagaactatgatacaaccaggtaagttttatttaaagataaataaaatctgcacatggtgagaaaatattaacacaaaaacctattatctcacttctttttcagacattccacttccatacctggtgtttttcagcctcattttaggctattttattatataagatttttatttgagttatatatcatcactgtttgaaaactgatttattattcaatagtcaagtgcaagacatccattcttaggcatctccaaagcagaaacacagtcagagtatgccaggtgatggaggggctacagaaaggatacatgatgaggtaaggaagaacagaatatagctgccctcaaaatacatagcaacttgaggagagtcgtggcaagtcttacaatcttccatgcttggactcttcttcactaatctactaatttctctgtacgacttttcccattctctcgtggtgatgtcttcttcatggctgctacagtatcctagattctgcagcctgccttctctcaaaatgtctgcatacttttgcatctttctattaattgcatccctttcttagaaaagaagatcttactggggttgtggtgactttccagtatggactataaagtcctcttgttcagcccccttaatggctgtgtgcttttgactgcctttggataatggggtcacaagatttttaaaaaacaaaatcttgttagcatatgcctaaggcatccatcaaaagaggactatagcataggagtaccagaaagtttctaagaaagacatgcaagtactttctgtggactgttcaccatgtaacgatacagtatcaccatagagactgtatgtacagagactgaacttaaaagtcactcccacaatgttaaggcattgcattaaaggcacaaaagtaaagtaaacactggcaaatatatatagcatatactaaaaatttaaaattctaaaaggtgtgaagaggtgggtgtagtcatatgtttatgtaatttaaataggctcagcttaggcaactattctttgaagcaaaacaaaacaaacatacaaataaaatattgtgaaaacactgtttttaaagctgagctggtcagcatcaaacacgcacttcaaagtagtgagtcttaagtttcataactggtattcttcaaactgtgaaactcagaatatattgacaaatggccacaattttgggtaagagaacaatcaccttgacaaacattttccaaagtttcagtattccaattttgtcaaggagaaacagccaggattacacaactgccagtctgaggttctgtgccaacatcatgcataaaaattgcaagcaatgaccaaacaaaatataaaatacaaaggacaaatgcttgaggaaatggataccccattttatatgatgtgattattatacattgcatacccgtatcaaaacatctcatgtatcccataaatatatacacttactatatatccacaaaaattaaaataaaaaatttgaaaaaaatacaaaacacaacaaagaaaactttggaataatacttcctttaagctgaatacttctataaaatactggagccacatgaaagaaaagaatacgtatctcttgttctccttccttctgtcagtgggcacatgataaatattccttcaccctccacctgccacccaccagatcccactggctactatcacacaaccacaaaatgagccaccttacaaggaagcagataccaaggaaggcagagaagagagatggagctgactgcctgtaaacattcaaatgatcacttgactttgtcacttcttctgatgagttctgttcttttttttttaacataagcaaattctgtttcataaaataaaggaaatgatgagcatggtacaggatggcagataagaaagggtatttaatctatctctttccctcctagtctacccaaaaggccatgaacataatgtatgagcaaggatgataagaaacactagttttgcactagcaaaacaaaacagggacagaataatatgagcagtcataattcctcatcagtttcatttttctatttcaagtgctgtagatcattgatcatgttcttgcaaatacccataaagtctacacattgaagatgaacaattagggtaaaagtgaacataaaacattgatgtaatctgttctgttacccactggaggaaggaacctataaaattatccaaagttttaattacggaggattaagagacttgcccctacaatatcttccaatgttttcattattgaggattaagaaactttccccaaaacactttaaagtagcattaagtggtgaaaaaaaaaaaactgtagagagaaagagatcacatgcctcccacagggtagttgttaaatgagtatttcttaaatttaactgaaaatatataaaaggaaagaaaaaaataagttttctatgaaaaggaaaaagaattcgagatgatcaaaaaggttaacatactggaagacagtgtggcatctgaggaataaaggttggtatcatctactgggcagaattgttttgaaaactggatgagatgtttgcaaatatactcagcaaatgtcacacagtaaatacattgaaattgagaaaaaacactgaataaaagagagaaacctgcttttcactgctactaagtaaggtgaagtggaaaagaggccatgcagttaggatcctctttcttggtcctttcatgatccaggagctgctgcttgtaaagctgctctggggcagacatttcaatttgtctgttttcttgacaacttcagttataagctttgctaatgtttataagttcccattggagaaaaattggttagtgaggattatgaactgaaggaaaatgccttcaaggatgggttggtaagattaggataaattctaatattatacaaaaatagtaagattatactctacatattttataccaaatttatttctcctgtgctgagtacagtaactcataaatcccactcactctgtccccaagcatgaatgaagaacacgagaaaatacatcagggatttaaatgaatgcatttttaagttaaggaactcatatttgacaagaatggcttatgttttaggaaatactattttgaatcaaatcgaagttgaggtgggtttttttcccctacttttttaatcgtggaggaaaaaaaaagccaaacatcaatttctaatggtaggtttgctctgacccttcccattttactctgcagcaaagacctcattcagttcctgaaaaaagccaagccttcatcatggtcacttcagattatataatgggagctgctctgaactatccaagcacaaagcaggtctccaaaaattgctcacatgctaaagcttgatattgtcaggtgtctataaatgcatactgaataatgtaaattggtaacctgctgacaatgcatttgcataaatcaagtcaatattcatgtaataaaatcaccactgagccttttatctttcctagtactgatcattctgtagctagtaaagtcctagactaggctggtaacttaaagttaatgaatggaaagactggcatcctagaagaacaactaagaaaaacctaatagaacttagtgatgagaagctagttctcaagaggaaaaaaaccaaaattaggaaaaagaaaatgacaagactcaacaattccacaaagtgagcttttcaaagtccattctttctcccacattattattgtccttatgtctaacaagtactctgatgaacaacatatcataaggctccttgcatttttcacagtataaaggggaaaaagccatatagctcttacaaagttaaacccaaaagacagtcagaccctgagagtcaaacaagtaaaatggctttggccttaaatcaaaagctaatagggcctgaccacataagtctgaccctttaatagtattctctcctagcttggcaacccaagtgagaaaacaaagtgttgaggttatctaagcctgtgtgaagacactggatgctgcattcaatgttagctacagctatcacattgctgagggaaagttacattaaatcagggaaaaaactattgtcactaagtctagacttttgttttcagagacaagaaaatgtgaaatttaagcatcaaatatgatatcacgatgtatcaagaagacttgaatatttttggtaaatatttacagttcctaccacagttttagctccttcatagcggggggtcttatactttagtgttgtctcccactatttaggaggtgctcagaaagagagtcttcactgattattaactcagcagaactctcaggatgtaaactatagactaaaagtactcacacactgatgccgtatttgccaaacattaaaaggaacaggcttgttgagtgttgctacaaagagtagaggcaggtcaaaagacaaaaactaccaggaaacagatgaaaagccatctaaagtaataataatagtagtcttatgagacagtaaaatatctgccaccaaaaaaaaaagtggtttttaatccaatccacttgcttaaattatgatgtcaaggtctggtactcaactggctcgttcataatatctgagtgaagcctggaaatgtgcattttcaacaaacacagttctcatgtaggtagaaaacaacatgtaatcctggctaagcaactgtaccttagcaaacctgtgaacagatttcctgagtttggtaaaagcgacttttttttttcaagatggagtcttgctctttcacccaggatggagtgcagtggtgccaactcagctcactgcaacctccacttcccgggtcaagcaattctcctgcctcagcctcccgagtagctaggattacaggtgtgcgccaccatgcctgactagttttatatttctagtagagatggggattcaccatgttggccaggctcatcttgaactcttcacctcaagtgattcatctgccttggcctcccaaagtgctaggcttacaggcatgagccaccaggcccggccaaaagtgacatttttgaactgagggtcatgtgaaatttaagtctttgtctctatgagattatgtagttgggtaaaataaagtaacaaccagagcaaaaacaataacaatagtaatacaagaaacctaaaaacatatattacttgagacatgttatagtaccatttttaaagaactcaggctctggatttaaaatgacctggattcaaatcctacacaatttactagctctgtgaccttgaacaaataacttaccttctctcagtcccaatttcttacaacagttagctaacagagaaattatgtagagtaacactgtgttacataacgcacactcaaaattataaacaatgaagagtaatggtacaaatatctaaacaaatctgacaagttttttggtaaaaaaaataaattccaaaagtaaaaaagccccataatctcattaacttaaaatacatatgtggccaataaacacataaaaagatgttccacatcattagttatcagggaaatgcaaatcaaaaccacgagatactacctcacatctactaggatggctacaatcaaagaaatagataataacagtgttgatgaagatacggaggaagtgaaccccatacactgctggtgagaatgtgaaatggagcagcagcttccgaaaacagtttggcatttcctcaaatgcttaaacacagagttaccatataatccatcaattctactcctagctatatatatatgagaattgaaaacagttattcaaaaatttgcaaacaaatgttcataaaagcattattcataatagctaaaaggtggaaacaatctaaatgttcatcaactgatgactggacacataaaatggggtctatccatacagtgaatattattaagacataaaagggaataaaaagtagtgatacatacaacatgatgaaccttgaagacatcatgctaagtgaaagaagtcggtcacaaagaaccacatatcatgtaattccatttatatgaaatgttcagaataggaaaatctatagagacataaagcatattagtggttgctagggacagagtgaatggaggtggcatggtggtgacagctaagggatgtggggttttctttgagggtaatacaaatgttctaaaattattctgatgaatgtacaactctgtgaatatactagaagtcattgaattgtatacttcaaatgggtgaatcatatggtatatgaattaaatttcagtaaaggtgtttttaaaataaatatatgtaatatatatttgcacaataaaaaatatagtatatatagttattttcttctaatattggattttccccctagaagtagctccttatcaccaagttgtataggtttttcttagtcattcttctataatgttactctttcctttccatttcatatgtaaatatatatatgtgtgtatgtgtatgtgtgtatgcgttcatatatataaagaaggaaaacatccctctatagtacagctctatagtatagtatccttctatagtacagctctatagtatagtatccctctatactacagctctgtagtatagcatccctctatagtacagctctatagtatagtatccctctataatacagctctatgatactcttcatgcccagcacctgttcctgtggtaaactgcttttccctccattctatgtcattctagtacggctgtcagtcacatgaaatccccaaatcccactcctgccacagaaactgcacaggaatttctgccaatgaactgtctcagctgtttatagttccatgcttccaggggcctatttattcggcttggcttttgattctgtgatataaccacattttatctaataaatcctcttcttattttgcttagataatctctgagtttaggctgcttgcaattacaaaactccatttgatatatactctaaactgttttaatctcttcacccgaagtaatgctatgaacaatttgctgttaatcctaccacagtattttctatgcatatacaactacacatccacatatatatcttatcataatactatacatagtattaatgtaccataattgattttagcatccttccattaataattctaacttaacttagttttacttattcatttttcttttaaaatcaaggggaatacggagaatccattaaaaaaaatcatgttaaaatccaagaaatatttatggaatagacttggtagctgaagatcgtgttttttaacacaactttagataatataaaaaaaactgaaatataatctctaatcaatttttgtttacaatgtagtttggcaggtaatatagaaaaattataaaacaattatatgtcaggatgtaagcaaaattgcatgataatcatcttataccagttgaagccatgaaaattcaattcaattttattaaatgtcaactgtataatgttttctgatatgtggattgtattggcactcaaaggaccacccaaaaagtttatagcttagcatacttataatccagttagtcaacattttataattgtcacaaatataaaaattgataaaacttccagcaaatttaaatatatttaagacaaaaatgttcatgacttttataataatacttcacatttattagtacttactaaatcttattatctaaattatttttcaaagcaattctatgaagcaggtattgttataatcacccaagggcaccgctgtagttgtaactggcaaatcagagaactgaagtcaagtctttctatctctaaaatccctttcttaatcaatatctgttatatcaaaattattttaatgactaaacagttgaactgaagagtgtttataatatccaattgcattctcacatcagtattaacaaaaaagctgttagcaacaaatccattgtctgaatcagctcaaagacttattaaacttgagatcttcttgttacatgataagttgcagtatcaatttcttcagctctatcatgaaggtgaattcagattaattcaagccacctagctgacttgcagtctttacaaacataaaaacaggttagtatactctcttaagggtgtagttattctgcatgagaaacaggtatacaattccataagaatacaagataatttgaaacatataataaccatgttgttacacagtagaccttcccatatttatgcatatttaattataatatttattaaaaggctaatgagaccattttgaaacacatttactgaaaggctaatccagtagtagaatacaatctgtttatcaactgaagaacacaatacgtgacatttgtacactgtaagagaagaccagaattgccaataaaatatcattgaaaacttcaagtaacccttatggtaaaaaaaaaaaaaaaaaaagtcctattaaagataagaaacatcatgtacagtatcacttcctctctcctacaacataattcaaacttaaactgatatgtaaatgaaaatttatattccagtcaaggaacgtacccaatgagagtacataaattatatatgtattatgcaagataatagttgttacagacatttcatcaaaagccattttaaaaactgcaaaatatgtcaagatgtttacatggtgaaatgaaatttcataatatggcaccttaaaacaatctcacattagattgctgcacctcagaaaagcactattgatatttcactgagccaaagaataatcataattcccttatcaagtgaatatagtggaaaggaaccaggctgaaagtcaaatagaaacaccattttctcaaataataatatattattaataatgatacatatctgaaggcttaagtttcaagatccgaaaattccagaagtataaaatgccacatattatcaaactctaaataacaaaattgtctaacatgtaactgcctactatttgctcatcaagtaaataagaactcattttaagattaagaaaactagcaagtcagttcgagtctgcaatttttagacgaaataacattcatgaacaactttattttctaacattaataacagatttcatacatccacgtaagtttaggtaaaaataaaatccatgtatacattgcaagtggcaactgttctccatagccaattcagtattatgaactatctaaataaaaatcaaaagtaagttactagaaaatagtaaaatagctccatcgaaaactcttctgtgcatattctgcaacattaattaacttaaaatgattaaatcactgctaatttatttgtcaggaaaaaataatattttattataatatctaaaaaatttgaaggcacttcacagtattacgtctttttgttaacaccatccaatggtatatttattagttgtcatatgaaggccccgccatgagagtttttaaacatttattaagaaataccctctatattcaaagttagatatttaatatctttaaggaatctgaaatagattatatattcattgactcctacaacatgcttcagccagataatgatcgtttgtcaaaatatgagcaagctaatcgtgtgatcctccacacacagactgataacaacactcagaatgcaatagaagcaaaactattcacctaaatggacatgaaaggactagtgctagggttcagattttttttctttaaaattttagtcccttgaaatttaacttcttgaattaacatgcagctattgaaaaagcagcagatatgtaacaatatttttactaacagctattccctagggttccttaattataagcagcagaggtatgcaagatggaaatacccaattaggttttcctggaccaatttagcttgtccagctattgaatattttcacaataaatagtcacagttgagtttgagagagaaaaattagccctttagttagcactaaaactagtctaaaattggccatctggcttgtctctgatatactctgatatcatattgtatcatcagacattgtaaaaagaaataccaggcataaactgctaaccttagaatacaatttaacctcagtattctccacaaaaaagtaacagaatctgtttctctaaggtacctgagttgattctaagtgaaaaatatcaggttattctcactactatctattttccatgtttccagaatgagagtgcaaatctgagcaccgtatttaaaaataaatagatctgagaataaagaaaaccatgttttcacccagatgcctgcatttccatcaacaagtgctgaaacaccacgcgaactgttgtagctgattaacccagcatatttctaggaagtacattagtttggtattagtagggtgcaaagtacaaaggtcagagagggaagtagagaagggccagaccacatcacaccttacagcagatactactaagctgagatttttttgacctgtaagacatgggagtcactgaaaaagtgaaaacagaggagcaatgtaagcagagactggatgagattttcactctgctagcagcgtagagctactttagtgaatatggtattccctagccacgtgtctactgagcatttgaaatgtgaccatgaccacaagttgaaagaatattctggataaactagatcaaataaactatattattataatcaataccacctgtttatttttatttttaaatgtagccactagaataggtaaaactgtatatatgccttgtataatacatctcaattggacagtacttgtatagatgaaaaactgtgaggaggaaaatacactaacaatgatgagaacaaggtagactattgcaatcgccaaggtgagagaggacagtctcagccagaatattaagaatggagaagaacaaaagagaaaagctcaaaagaagaaagaaaagatgcaggacttggtgactgactgagtataaggagtcagagagaaggcatttgttcattcattcattcattcaaacacatcattattgcatgcctaggatatgcaggtaccatgatggttatactataatgagctaaatggaagtcggaaatgcttaccaactctctggtttgagaaactgaggaaaggctgttatcacccattgaaatagcaaacaggaaagaggaacacttttattatcatcaaatgtatcaagtatgaagtgtgtgtaggttatttaagtggaaatgtctgggaagcaattggatgtcatgatctgaagtgtaacagaaatgcctacgctgaagctagagaatatggaaatagcagcagacccataaaagggtttgctccaggagaggttgtagagtgataaggtcaagggtccaagacagaacagtgacacaaaaattctgaaaaggagagagaggacagacagcaagttcactaacaaatagccatgtatgaacaagaaaaattcataaagagtagaatcacaaaaaccaaaacagaagaactttttaaggaagtaacattcaatagaatcaaatacaaaagaaaagtacataatttcagagaagcattgaaaagtatacacaatgccagaaaaaaaatcaaaaagtatttggcaagtcagagatcactgatgaccttcatgaaggcgatcccaatggtaagaacaagcaggactgccaaagactccaaaaggcgaaagagcaaaggagaggcaagaaagaccaagtataaacaactgtttctaaaatcttaactataataaaaaaataataaagtagtgagcacagaatcaagggatggtttggggtattgtcattttttattttggacatgagagagacctgagcatgttcaaaagctcagaaaagcaatcagtacagaaaagctgattaaaggggcaagaaatggaataactaatggagcaagagcctgaggaactgggagagaagacctagaacacagatggacaggcaaacctgaacagaagaaagaacacctcttcgtccagaaatgaaagtgaaggtggctcaagaggcaaagataaattcagaagcaggtaagaactctaggttctgtattaaaatattactcaggttatacagtaattaccgggcacctttagctaacagtagctgcaaatgtggttccatacttccaaggatttaatatttatagcaaatattcgaaagccaaggacacagattcatccaggtaggggagagtcatctttaatctactctgtggccagtcatctatactctactacacaaaaaataaacctgtgagaaatgattgccattagtcatggaggaagaaaatgtagactagagtgattggggacagggaacccacatatctctctacggtttctatctatgcacatggaagtagagagactgaagagaataaagagggtttctctcctgtctatataaccctaattagttccttcccaaggcaagagtcatagttatcatactttgccacagtttaaaccttttagatgaagttattgtgctttaaagaaatgagcccagattccccggacttctactctgcctgtttctgggagtggtaggcatgcctaggcaggatctggtcctccaggctgagtggtcataattattttgtgtgattaaaaagaatctcttggcctgcccatcctcatctctactctgcttcagtgtctccacctacaattgaatgagtgaagagtattgggcttcactggaccagaaaaccgagctacgcctacaaaaccaagactcatggttcaacactcctcattgaaaaagtcagacattgagggctatccagcctttgtccaccttttaaacagtactttatttccctgttggcttctatacatttttataaataatgcatcagtccagaatcccagaaggcaggaggggtaggtggaggattcaataatcaaaatctcaccttgaacctccaaaaaccctagtgacaaactaaaatgtgcactaagtttttctgcctctttctttttcatttttctttttctcactctgcccctcctgaaatccccctccttccacttttatatgttcaagcccatgaatattcagtttatatgtcaccttatcaaggaagttttctctgacctgtccagttacatttcagtatcactgcctcatctatgctcttgtgtcttatttatatctcaattaagcacttggttataattagttatttaattgtatctcccagccaggtgaggtggctcacatcttcaaccccagctacacaggacactgaggtgggggaaacatttgagatcaggagtttgaggttgtaatgagccataactataccagtgcactccagcccgcgtggcagagtgagagcccccatctctaaatgatgaagaagaaggaggagaaaggaggagaaggagaaggagaaaggagaaaggagagaagagagaggagagaggagaaaggagagaggagaaaggagagaggagaaaggagaaaggagagaggagaaaggagaaaggagagaggagaaaggaggaggagggaaaaggagaaggaggagggaggaggaggatgaggaagagaagagggggaggagggggaattgtatctccactaggaaatcaggtagagattgctgaattcagctttgtatctcaggccttgagtacattgtcaaggttggtccccactccaagtcacaattcattcctacttctcccaaactcctaaagcactttgtagggcagaaactgggccttgctgcactctatcagcactgcccctctattattgaaagaagacagaaagaaggagatcctgaaggcctttgtataataggtaaaaatcttttgactcttcagccaatcactgctccatttggcctctagctaaggaatctcttaagcagcaagcaaaaaatatgattcataaacaagtgaaaatgagtcacgtagcagtaaacagaactggggccagaaaggcagctttggagttgtccccattcatttcaaaaagagcattttacatactttttacatatttacattttatgtatttttttaactggataaagttaggaaatacataaattgtactaaatttagaatttctaacttgattaataatgacaaaacaccttataaagtatattacagcacacaaagtacttcctaacacttccattttatagttgaggaaatgaatttttagaaaaattaggtgggttctgtaaggccttattcatcaaccaataatgaacaaatgcctattttgtgcaatgcactgggatttcagcagccctgccctcatgcacctctttcttatagggaagacgtgtaataaataaaatgtatatgtcaaatggtactactgggaaaataaggcaaggtggaggtgggggggcaagggtacagttttgaataagatagccaaagaaggcctcactgacaagtggcatttgagcaaaaagggggtaagaaagtcaagtggttggtaccctaacctgaactattaaccaaatcttggatttgcattgcttacactcctttcaatacagcaatttgccctttataagagaaaaagatgctgacattcaggaaagcagcaggggaagcagtatcctgttctctacattttgggcacattagaaaagtggttcagaaaatcctgtacaagacccatagcgctaccctaggccgaagtgagtccacaaccacacattcggatactccaaaaagatgccaagtggtccttttcattgacaggactagcagtatcactccaaatggtaaaatgttaaagttgtaactagagaatgtttgatctttttattgctgtttttaaaggcagatgtcctgagtggttcattgtggtttctaccatataaacgtcattttactctactggttacttggctgtcataagacagaaaatgagctgccataagaaaagctgatggaaaaggaaaaaaattacaaatatctgatcccatacccaggtcactgtcttcatctaaggcataatttatcttttccaatgaaatatgtgtacatctcaattaattatccacttaccctctactaatcagaaataagatttggttcagtaaggcggggtgaaggaataaactcaacctaccaattgctccacatgaatttttttttttaatagaggcagggtcttactctgtcacccaggctggactgtgcagcctccaactcctgggcttaagcctcccgagtagctaggactacaaccacatgccaccactcccagctaattttttttttttaagaaacagggtctcgctctgttgtccaggctggtcttgaactcctggcctcagacaaacctcccaccacagcctcccaaagcagtgggataataggcataaaccaccactcccagcctgctccacatgattgataaataacctgatataataatctagacaagtcaatctttgctgaataaataacttccccatgagtaatccttcctatgcccagttttccccaatccttaatatcattgctctttttagactcatacattcattcacttaacaaacataaactgaatgtttaagataaggcaaatactttgtatgactggttttctatttgaaaatagagtgtgtgactatacaaatacatatatacataaaggtacatcaatttatatacattggccctatgtaacccccatttgagaatatttctaagcatgccagctactcaaattcaagtgtgaaggtatgtgtatttgggtgtgtgtgaatgaatgtatgtgagagacaaaggcagacagagagagggaatggataagaagcaagtaaagttacagcagacaaggacatgaaaactcataaaagactcatgataaactgtaaatacatttaaagaaaaagaataacacaagccttcactccccttccctgtgcgatcataatcactgcccatcaacttctctgtccatatcatgtgtgctccctgtgttccttgaaggttatgtataaccaagatctacctttaatgtgtttggcaaaaatatctgtgccataaactattagctgacaagcaattatattctaccttgtaaaagaaaattaggcataaaataaccccacaaaaagaagagaatgactgtttcacaaaagaggcaaaagagatttaaacaagataataccataagtttctatctcaccatccattaattttaaatttgattttgcttcttatatcacatagcacttattcaaaaatagcagaagaatacttctatctatctgttgtcctgtaaaaagaaaagaaaatactattatttgtatttcttgttcaaacactctaaggataaaagtactgttttcaaaaatgatgaggttcctgcagataacatttacccacaggatttgaggcttttttgtgacataaagtgcagagtactttgaggatggttacagatgcaatggcacagaaaaggcttttaactttggctcatttcctctgaccaccatgtctccattctaaattacaacctctcaagctacagatcctttaaaactagcttttaaaccagctttctgtggtatcatcacaaaataagaacactttgttacttgaaaataaaagcacaaaattattggactcaataactgttctcattattgcaaaccaataaacaaggttcaacaagaactcgttttagctattgcttatcaagctgccaaaaaataaatccaaaagaaaccaaagaaaaacctgccttaacaatatagatggtttcttattcataaactatctttaacatcaaaaatggctagcatgtatgccagtgttattgccttgcataacagaatcttaagctaagcactaaagttctgtcattcacatctagaataataattttttttacaaaaactaaaatacggccaggcgcagtggctcacacctataattccaacactttgggaggccaaggtgggcagacaacgaggtcaggagatcaagatcaccctggccaacatgatgaaacctcatctctactaaaatacaaaaaattagccaggcatggtggcgcgtgcctgcagttccaactactcaggaggttgaggcaggggaatcacctgaaaccaggaggcagaggttgcagtgagccaacatcacaccactgcactccagcctggagacagagcaagactctgtctttaaaaaaaaaaaaaaaaaaaaaaaactaaaatactaaataaccccatttttaatagaaatttgttttatgatataacccataccaaatgctacctgctcagccaaatcacttttagagtccacacagccctttatatctaaaagaaaataataaaagtgctaggaaacaagaagtatctgggccagttacccttggttaggactgagaaattagctggcacagacagcaagaccgggaccaaatattcaaccagttggctggggatagtgggttgaggtcaaggagatgacccatacagctgtaaaattaagtataaaaaggggaaattgggcaaacaaataaatatactgaggataatgggagccaggttttctaatgttggagaaggaacctacaagtacaaaaaggggaaggaagaataaaccctgtcgtttggaatcgaggagatcagtgggaacatatatttttagataatcactgatcaatagatagatagatggagatgtatatgtatatatgtacgtacatatatacatgtaatgtacatatgtattagtccgttttcatgctgctgataaagacatacccaaaactgggaacaaacagaggtttaattggacttacagttccacatggctgaggaggcctcagtatcatggcaggaagcgaaaagtacttcttacatggcagtggcaagagaaaaatgaggaggaagcaaaagcagaaaccccggataaacacatcagatctcgtgagacttattcactaccacgagaatagcacaggaaagaccggcccccatgattcaattacctccccctgggtccctcccacaacacatgggaattctgggagatacaactcaagttgagatttgggtggggacacagccaagccatatcaatatatgtatgtacatgcatatatgtacatacatatatacatataatgtgcaaatctgtatttcctaggtttgttcactgaaaagatctagaagcaaagacacctcagtagtaaagagcaatcttagacccagtagcaaagagcaaccttagcatccactaaaagaaaccagaagtctttggtagcgccagggctggggcaagaaaagtacaagataagcttgaaccacaccttttaacatgaggaactgagaacatagcatcgcttttgtggtaataatgcccaaaataacaacttattcataaggaaacatcagataaacccaagtagagaaacaaaacatagctgtactcttcagaaatgtcaaaatcattaaagataaggcaagattaatgaagattccagattgaaggagagcaaagagccagggcagctaaatacaaggcttagattctggacatataaagaacatcattgggacagttagtgaattatgaattgaatctgtgtaatagacggtaatattgtatcaatactagtttcctattttggtggttatactgagattatgtagggaaatgtccttatttttagaaaatagtcactgaagtactaagggagtactggggcatcatgtctccaatgtactctcaagccaaaaaaaaacttcaaaataataataatgtgtaatggtaagaggagagggagggcagattgagagagagagagagaatatgataaagcaactataataaaattttaatattgaaaatttgagtgaaaatcatatcagttctttgtactattcttgcaatgtttctacaagcttgaaatcattgtcaaatgattaaaaaacaaagacatgtttggccttaaatgcccatataactattaagaaaaaccttaactctctatgaagggccacaatctgctctgaattttgaatataaaaaagtatgcttgtgctagaggctaatacagcctatataattctaagggcactaaacaaataaaataaggatgttaaaaggtgtcttgaacgtgtctaaaatctgtaaaatgttaattctcacagaatacttggcttagaaagatgatgtacattggggaattataaatataaggataaaattgcaaaatttccctgatagtcacaaaataagacctatgtagacaacagtatgcatcacccagatcccccttcaaagaagcactcactcatggcccatatatgggcagtgcagtcagtagacagccgccaggtcagtagacttcaacatcgccacagctgcagagaaccgccctcccttggggtattcgacatcctcagacagggcaggggtaacttgagacaactctgaaggccacactgtctgagggccccactggcttgtctagggttctgtcaggcctgcctcacagtttggcttcctcccctgctcaatcctgtatctttcttcttcctttccccagggatgatccctaaaatacatctcacaccccaaactccatctcaatgtctgcttctagggaacccaacctgccacaggacctcttttgtgacttgacaaaacatagcttgatataggcacattttataattttgtcttgtgagtaggtaactttatttcctcaaaagacaggtataaatttttttcaggtaaattctgtctctaaatctcatccatttaccttctcatgcggtgtgacagaaaaagtgtactttccccttttcatgttagccaaatataaaagataatcattgtttaaacaacaaatttccctcttatggtccattagctcctgctgcttgttcctgtagtgaaatagaaatacaacaaacgatttccatggcaataggtaataatctagcaaatgtgaatttccgacttagcaacagaacaaagcaagaagaaattatggaactgcagtggggctaaatttcaatttctgtgtatttttagtatcacattttaaaacaaaaaagcacaaatgcagacacattaacacgtaactatgaagaataaaattctaattataggataaattcaagagacctcaataatcaacctgtaatatcactccttacttcactactaaaatatattcaactaacataaaacaccttaccttacaaatttgagaattcttacacttatttgaaagcctattatctactataatagcagtcccaattactgatatatcctgttattttcatttttagtaataattataaacatggcttattgctaatatgtaaacgaaagatgttcaaaggactaaagaatctctaggaagcacaggaatagaggaactggaaagactgcaagcatcaggagcagctctcttgctgatactccattagtcaaggctctccactcccttgtggaacatgcagcaccctgtacaggctactctctagtctgcacctgctcttcttcccacccctgagcttcacactcaccaagaggggttgttttgttcccacacttattaccatttcttcttgttatagtaattatatagtttaattatattattcacaatctgatgaaatatgagtgcagaaaggattatcgtatccaagaaagtaagtacaacgctttgcaaagatttgataaagatgaatcactaaaactatgaacaaattagatatgggcaatgttagactgtggacagttacagaaaaaataattcaaatctaggattctacactcagattgctttgtaagtgtcttaaatttctgcacttttaaataacccaacgtgaaaattataggtaatgcactgccttcgttttatacagaatgactatccaaagatgcaaattttttaaaataaaaagcttcagccttatacaatcagaaaaatggcaaaaagacaaacaactacgataagagtatgagttcaaggaaacctgaatagaggtccttaatatatgacaacacgaccatacctctctttcagttgcctccactctccagatgggattcctgccctctgttctaaaggatgacattgagcactgcccgccttgtccttgacctcagatatgcacttcttcaatcttaggctaactcttctcggttggcaacagaggttcagaaagtgtctccttgcttcaatgtcctctcctacctttgtatatgcaaattcttcattaccagcttgattgcatttatatccagcatacagcaatgtgcaaactatattttctctttggctattagcgacccaaggaggacctcagacaacaacatacttttagccccaaagtcacatgggcaatcacatttccaatcttttaagcacccttccaatggatatactgtctaaccaggaaaaagattaactggaccagtcaagtctctttttcctattctagccacatataaatgatcaatgcccccacccactggaaatgtacagaagctacaataaaaagaatttcctgcccagggccaagaatttatagatttagattctaaagcatctgatgtgactacttttttattttattgccttaacttccttagctacaactgaacacacttcccatcaacctattacttctttacctccctccagttttcctggcctttaactcaatgcctctcctaagtatgcttgagctgtgtttactcaagccacctctgacatcaagtgagaagtgtttttccttctaacaccaaccaattctgacacaaactcgaagtcccataattcaattaattctgataataacaaccaggagttagcatcagaatttttagtgctcagtcccacaaatcaaggtccctaggttacacacacttctgtccaacttggctataaagtctgaggtgggagggtcctcccctcacttcaggttcagtaatttgctagagtggtcataaaactccaaaaaacactttacttaccattactggtgcattaaaagtaccacaaatgaagagccagatgaggaggtaaatctagtgaggtctggaagggtccagagcatagtagcttttgtccccatggagctggggggtcccacccacctggcatgtggatgtgttcgccaattataaaagtctcagaacccaagcatttaggggtttttgtggaggctgcattacataagcgttattcattaaatcactggccatcagtgattagctcaatctccagcccctttgccctccccagaggttgtcacatgagattaaaagtcccaagctgctaatcaaggcttggtctgttgggcaaccagcctgcaacctgaagctttttaagggcccaccaagaataacctcactagaacaaaagatgctctcatcaccctaataactcaggaaattccaaggatttctgaagctctctgctgggaactggaaacaaaaaaagaaatatctttctacactactataatgctttaatctcttttttccactttttcacagatcttacaagtgaatagccagttacttgttccctggctctgcaacagctctcctcccattaccttttgtaaaaaacttgtcccatttctctttcccttccttcctccttcctcaagttttgcaccaaacaatgtgcagaatttagaacactgcatattttcaattaaattactctattgtctgctgtgctcagggaatatctgcagtctgtaaactctgcatgctaggaagagctatttaatcttgctcctgacattttacgtaggagggaatggtttacaggctcagtgtctctagaaagaacactccccaaggaacaacgtatttatttctcaatgttctttttctgttttactcttaaaatctttcctaccaccatccctcacgcccaagagtacaactttgaaatctaatgtataaaactagcagaaattaaagtttatcctatacttacattaaaagctactcctacttgaagatatgcagacccctccaaatccttcttttgattctctgctcacataagtgggttttatgtacgtgtgtttttttccacaaaggagaggcccaaagatagccaagagatcaggattggaacagtttcttaacatcatattctcacattttcaaaatttcctcctttattagtgataaactttttaaaaactgatttcaaaataggaaacagttgttcatcagtctgctagtctcactttcaccaatcaacatatttcattgatgataatataatttttaaaatattttatcatctctggaatcaagatatatcttacagtcgataatatcatagtttaactgacaatatttttgataaagtacatgaagaaatactttatcataaatacataagacaaagataaaataaatgacacaaagatgaatcttaggtttgataaatatattaagttcctctctcaacagtttctggcttacctcagatataacctatgtaaagcatttagcattaaatgtagtataacagattttcattgctgccatcattgatgacatcaacatcatcaacatcatcatcatttctaaacaaataacaaaagtctcagaaacaaatatgaatcaagttagggttctgatgtgttctccttattctatttcttttctgagtgccatttttgtttgtttgttttctatcctaattttctaaatttttcatttgtccccatattaaaaaactgtaaacactctgatggggttatgtaaggttgtgctaaatgacttagctcagagtattcaagccgaaataagttagttctttcatctcaaagaaataagtaaataaataaagtaataaagttctttcatctcaaagaactttaaatatccgtccctgtcactagctaccaaatcaaaaacctaggaatctcattggaaaatagactataagacaattccatggttatgagttttaaaagataactctaatcgatcatcctttttttgtacttattttttgtatatttgtaaaatagtagttacatgaagcaaatagtatcagtgtaaggcccattcacttttcaggctactcgacatgcagaaatggtggccattgatcaggtccttgattggtgtcatcgaagtggcaagggtctttctgaagtatttgaacacactgttatatgtcactgtggagctgtgcattatgtgtgcagctgttcgccacctgatgagtatcctttgacttcatgagttaatgtcttgtaccattcatgtgaacatgagagtggccaaacatatagcgcagcaggaagcagagggcagctgtgacgggactggccagcagtggttaggatggtgaaaacactaagaagccaaaggagtcaagagtagtcagacagagcaggtgtggccaattgcctcaatcatctttttctttcaaccaaaagtatcaagttatattttctattttttcttccacatcactcttctaccctctgccatttttttctttctccataaatggaaacctaaaatgtatttctaccataattagaaagcaatcaataaaaaattttagtccaattttgttcgtgtctccacacattactacatgaactcagttttactttatactgtattataatcatttgagcaaaatttctttatttcttgtaaatgaatgtgctagtataagaaatatctacattttaatgaaaatcatagtacaggtacaaaatttctaaaagtgagaaaatgaagcaaacacaatacagctttttggtacttttacatatgtaatctttctttattctgctgttgatagtttttgcctttcgcccatttaagtaagttaattgaaagcatagtataatttaatctctattgtactaaaaatacacaactatctatagtaatattattctgccacattctcaaaaaaactattgggcattaattccatctggactctccactaaataagcattagtaaacaaatttacttaaactataaaattcatattactgaatttgcatatatccagagtgtctgaagaagagaaaacaaacatatgagaaaaagctcatcatcactggtcattagagaaatgcaaatcaaaaccacaatgagatgccatctcatgccagttagaatggcgattattaaaaagtcaggaaacaacagatgctggtgaggctgtggagaaacaggaatacttttacagtgttggtgggagtgtaaattagttcaaccattgtggaagatagtgtggcaattcctcaaggatctagaactagaaataccatttgacccagcaaacccattactgggtatatacccaaaggattataaatcattttactataaagacacatggatatgtatgtttataaagacacatggacacgtatgtttactgcagcactatttacaatagcaaagacttggaaccaacctaaatgcccatcaatgataaaccggataaagaaaatgtggcacatatataccacggaatactatgcagccataaaaagaataagttcatgtcctttgcagggacatggataaagctggaagccatcattctcagcaaaccaacaaaggaacagaaaaccacatgttctcactcataagtggcagttgaacaatgagaacacatggatacagggaggggaacatcacacaccagggcctgtggaggctgtggggcaaggggagatatagcattaggacaaatacctaatgcatgcagggcttgaaacctagatgatgggttgacaggtgcagcaaaccaccatggcacatgtatacctatttaacaaacccgtacgttttgcatatgtatcccagaacttaaagtaaaataaaaatgaaaaagaatagataaatatagttagcaaattatatgtatatatacaatactatcataacaatatacaatgctagtctgtagtttgtaactttttctcataaaataaatgaagctttagaaaacatttttcactgggtgcggtggctcacgcctgtaatcccagcactttgggaggccgaggagggcggatcacaaggtcaggagattgagaccatcctggctaacacggtgaaaccccatctctactaaaaatacaaaaacaaaattagctaggcatcgtggcaggcgcctgtaatcccagctactcaggaggctgacgcaggagaatggtatgaaccagggaggcagagcttgcagtgagctgagatcgcgccactgcactccagcctgggcaacagagcgagactctatctcaaaaaaaaaaagaaaacatttttcactataagaaaataaaatcacttataatagacatatttccaatatttacattctctgtagtcctctagtcctttatctagacatatatactatatttttcaaatactggaattatagtatacatcattttgtaacttgcttttttgtttgacaatattataggagcactttcaatattcatagtcttcgaaaacatgatttttgaatggctgtatgaatattccatcatttgtaaatattgtagttgattttgctaacccaccactattggacagttactaccataataatgcagtagcgaacatccctttatctttgctctggtctctgatttatgtcttggaaaaaaattctaaaagttgaaagtaccaagtaaagacatgtaaatactgtcaagccttttgatgcctaccaccaaactgttctttctccaatatctataaaagtacagtttaaagaaaccatcaatattgtgttgctggtatgatggatgaaaaagtatgtctcatttaatttcatgccatttcatttacaagtaagattaatcactttaataaattcatttttcattttcttttttgaactatctgttcatgacctttgcctattatccttcggatgtatttgctttttattactattttgtggctgttttttatacaggagtgatatgtttgatgttgcaaatacttttccaggttctcattcactttatcatttcatgtttttttgacatataagagactttcattttgcataatcaaatttgttaaacttttccttcattatatgtccctttggttttatatcgaggaaggcctttctgggcctactatgaaataattcatttatactttcttctaagtattttatgacttacatttaatattatttctatatttaacccatctgaaatgcattttgtatacagaattggagagagctaatcatgtttttttcagacaaaagtattttaacacgtcaagtttaaaccataaacacttttcggattaatttttttccataagtttttggggtggaggtggtatttggttacatgagtaaaagaaaactactgactgatatccttgatcaacacagatgctaaactccttaacaaaacactagctaacctaatccaacaacatatcaaaaagatagtccaccatgatcaagtgggtttcataccagggatgcaggagtagtttaacatacacaagtcaataactgtgatacaccatataaacagaattaaaaataaaaatcacatgatcatctcagtaggtaagaagtattcgacaaaatccagcatccgtttatgattaaaactttcagcaaaaatcgacatacaagggacatacctcaatgtaataaaagccatttatgacaaacccacagccaacataatactaaatggggaaaagttgaaagcattccttctgagtactggaacaagacaaggatgccccctcccaccacttctcttcagcatagtactggaagtcctagacagagcaaacagacaagagacagaaataaagggcatccaaatcggtaaagaggaattcaaactgtcactgtttgctgaaaacatgatcatttaccttgaaaaccctaaagactcctacagaaagctcctagaactgataaaagaattcagcaaaatttccagatataagattaatgtacacaaatcagtagttcttctatacaccaacagtgaccaagcagagaatcaaataaagaactcaaccccttttacaatagctgcaaaaaaaaaaaaaaaatacttaggaatacagctaaacaaggagttgaaagacctctacaaggaaaactacaaaatgctgctgaaagaaatcacagatgacacaaacaaatagaaacacatcccatgctcatggatgggtagaatcaatattgtgaaaatgaccatactgccaaaagcagtctacaaattcaaagcaatctccaccaaaataccaccattattcttcttcacagaattagaaaaaacaattctaaaattcatatggaaccaaaaaagagcctgcatagccaaagcaagactaagcaaaaagaacaaatctggaggcatcacactacctgatttcaaactatactgtaaggccatagtcatcaaaacagcgtggtactggtttaaaaataggcacatagaccaatggaacacaatagagaacccagaaataaacccaaatacatacagccaattggtcttcaacaaagcaaacagattaatttttttttgacccagtatctctttctgttgcccaggctgcagtgcaatggcataatctcagctcactgcaacctccacctcccagattcaagtgtgcttcagccacctgaatgcctgggattacaggcatgcaccaccatgcctgcctaatttttttatttttattagagacagggtttcatcatattgcccaggctgatctccaactcctggtctcaagttatccatcagcctcagcctcccaaagtgctgggattacaggcatgagcctctgcacccggcctagatgtattattaatgcattattattaatgtatcctttcatactaacaacacctaagttgtttttaacatgtactaacatttcctaccttttaaacatgtagtagtatatcctatcatttaaacatgtactagcatatcctatctttaggctcctttaatatagagtcaaggttctccttctccttgcttcccatgctaccagcactataaagtaagagaatcaacaaaacatcctatattataaagagtagtttgacgttttggctctatgtagaacacatcaattatatctataatatattaatttaaaaagtgaactcaattcctctagctattgaaaaagatttgccccagaagtcttttctgagtccttagtcccactctccatctgaatgtgatacctctcctgtgtgttttccaagacctctcaacgtatctgatcacagcccttatcaccttatatttctgacttactagtcagtcccccaactaaaccaaaagaatttcagaagaactatgtctcagatattttatcactatcacctagctcatagtaagcagtctgtaaatatttgttaaataaatgaatgagtacaagactacaagacttttaattcctttcaggcctgccagtgactaacgattgcaacagtgaataagtcacttaacattttagactgtggtgaacaattcagaaatcagtaatttcttagcacaaagatctcttaagatttttcaatctcaaaattctatgatgacatgacctgtatccccagaaaccaattttacacaccctgctgctacatctcttgcttggtaatattcccctatccccaccagtctgacccttccagacttccttgaccttctccagcctaccccactgtccatttaaaatgttctcaccttgtgctccttaaggcttttctatggatcagccatctatatctgtagtctgaacaacagtgcattttactgtaccttccccatgttaaatttgtgtgtagatatactgcatggcttattcagaagatatcggtgatgtgaaatgcttaggtgtgaggttaaaaaggagctctcaatctcttgcttaccccatagacttatctttggaaatgcgtatgacattagatcaatgactgcatcctactctaaaacaaaatgcctcaagagtattagtattattttataattttacaacttttcttgtttccataatgatcaacagaagtgacatgattttgcagtcatgccaaaaaagaaaaaaaaaaggattatactgataatctcttcccaaatatattctggtgaggaaaggtttattttgttgctttttgctttttgtcatttccttgctctagtttagttgtttttaatatttccataaatgttgggagtaagtttactttggacagaacagatttgcttctatttttaagaatttgagagcatgtggtgagattgtttatcttgttgaaataccccaaaaactcagcctcttgatctaaaatgcaatccaataagttataacatgagttaaggttaatctgtaaataaaatacaattccaatttgctagtgaatacttacctgtaaatactaaagacagtattttaactcaaacattttctgattgccaacctattctaagtgttatgggggagcaaaggcaattaaagtcaattttctgcctccaaggagtgtattctgattaagacagacctgtgcttaactaacaataacacaaggcagaatatggttctttaaagaaaaacaaatcctgtagtagcaaaagaattttagcattaaaataatatatagataagtaggattaaaactgcagttctaatacctttccaaatttcaatgtacttctttgaataagagaaaaattaaccagtcatgtcctttccaaagaaacactacagattacacatcctgtagcactctggaattatgggctctgactggtagtagactactacttctgttcaagaggttctttaaatattcacgaagtctgattgagaaaaatgttaagcaagtcatggtcatactgagcaattcaactggtaaaccacggactgcatagctacgttcaacatcagatggaaggaataacttgagaggctattaaggaatagaattaggaagactataggctcattattaaaccattatttatttagcactgccaacattccaaacacagtggtaaatgcaagactggtgaatacaatccataaaaatattctctgagagactgtttatcatgttataaattcaaggttttaaaaaaataatagaagccaggtagggtggcatgcatctctagtcccatctactcaggaggttgaggcaagaggactgcttgagcccaggagttcaaggctgtagtgagctacgactgtgcttgtgaattgccactgcactccaggctggaccacatagcaagaccccatctcaaaaataataataataataataataataataataataataataataataatattaagttaggaaaaagcaatcctccattcattcacaatgtacatgtcctatatattcaaattaaaaccaagcaaaagccttctgttctgaaactaactttctatgaaacgcccaacttgtattcccagcaatatcaagtttccttattcatctctatagattacctcatataatgaaatggaatcatccttttccagaattaagatgctgcttttatcactttacttgctcaaaaaccttaaaagctttcatttacagatgggcacggtggctcacgcatgcaatcccagcactttgggaggctgaggcaggcagatcacctgaagtcaagagttcaagaccagcccaggcaacacagtgaaaccccgtctctaataaaaatacgaaaattagccaggcgcagtagcatgcaccagaagtcccagctactcgagaggctaaggcaggagaattacttgaattaccaggaggcagaggttacagtgagccaagatcgcaccactgcaatccagcctgggtgacagagtgagattctgtctcaaaacaaaacaaaaaaagcttcaatttactataaaatcaaattaaaaatcctcaaggtggcattcaagaatctgcatatctgtatattaaaactatttcctaataccttcacaatggaaattttctgttccagacacattgccttcatagtccacgaacacattatatatatttatgtctatttacatctattctttcttttctttctctgagacagggtttcactctgtcacccagtctggagtgctgtggtgcaatctcggctcactgcagccttgaccccccccccccaccccgccaggctcaggtgatcctcccacctcagcctcccaggcagctgggactacaggtgcaagctaccacgaccgtgatatggtttggctctgtgtccccacccaaatctcatctcaaattgtaatccccacatgttgaggaagggacctggtgggaggtgactgtatcacagggcggtttccccatgctattctcgtgatagtgagtactcacgagatctcatggtttaaaattgtttaataggtcctcccccctcactctctctctctctctcctgccaccacataagacatccactttgccttccaccatgattgtaagtttcctgaggcatttccagccatgtagaactgtaagtcaattgaacctcttttctttataaattacccagtctcaggtagttctttatagcagtgtaaaaacagaataatacagcccaggtatatatatatatatatatttttaaacagggtctcactttgtcacccaggttggtgcaatcacacctgcaatgttggtgcaatgtaccaggttggtacaatcactgcagcctcaagtagtaagtattcaaaatatatgttttgtttaaagggggtcaataaaataatctaagtcaactattttatttattacacatgaagaatcacaggaaaaaagttaagcagctattccaaattacatagtttgaaagctacatcccaaacacaaaacccaatattttttgggttgtaaagaatcctgcagaggattgtgaaagggtagaagtgaggatccctttctgtgtaatattgttaaagttgggatcctttgattacatgatagcttgaattctaaatacagagatgccatcagttaaatataaaataatattggggcaaaattagccatgccacttggaagtcttttgaaaggtttgtgtttatttttctaacctatatattactgtaagaggcatacttggaacaacccccccacaaacacatatactaattaactaatccagcagcggcataacacacagggagttttatcctttatgaaggcctggcatatgcatcacatttaacacagccctagctcacagtactttatctacttggctagaaaacaaatggccacagaaattcatgctagtcaatccattttttatatattttggagtaaaaaggatgtaaattcatctgagtagataactagcatacaaagaattcaggttgagtgtgctacaattaaaaatggtcaccacaagaagctgaaatattaggagtgttcaggggcattactgagagtcttcaagcaaaaagggttttcccagctgtcactgtaattacaatgaaaaaattttacttcctaaggatttcatctagaacacattatacataacagaatatacatgcattcaaatgtaatagacacataaggaataccaattttgactaccttcttcccacaaatcacaagcgacctctgagcacaactctcaagacttttaaatgctttctggaactctttttccatttagaaataagtaactacatacaacagttcacggaaaactcaaccacttaactatttcagtgaaaacaggtagaaagaaagtctataaactatactttttatccatttgaaaaaatttaaatttggaaaggaatcacttcattcttaaggtcccaacaccctaaaaataaagtttattctaaattttcacatttgtcaaagacaataatatcaagcagtagcccacaattccctaaaggaatgatgtcaattggtatttcttaaattaattcagtgacctacagtaatgtgagttcttggtacataatgtctgtcagtaggcaatacaaaaatttcagaatcacttctggtgtctgaactccaaaatgcaacccaaaaaatgtgtctaaagtagttccttaattcctacttcaccttgcatctgttacttatagcaacgtcagaaaaataaaaattacaccaggtgtagattgctagaactacagttctacaaattaaatacagtacaaatttaaccaagacttctggtaacatacaatcagttatctttctgagctaagacattacaagtctgtaactccttttaccgactatggtttagtgagtttcacatgtgcttacacagctcatttttagttacttactagacaatgtgcaatggtgtacttttataaaaatttcaaaggtctcaagaaatggaaatactcaaatttaaaggatttatctgttatctctgaactctctttctctgcttttactgctcccaagtatacaggcaccacgaacacagagaccagctaaaagttcaggaacagaaaattccaactacatcatcttaacaaataaccccacacattatagtttaaaaatagcatatttgaaaaaaatgcactaaaaattattattagaacttcacactcaaatctctaaaaagttatgaacattttatattgtaatacacataaattctaaagaatatcaaagtataatatcagagaaacaatatgtgtaagattataaaagattagagtattatctgtttggatttttacatgaattatttatgcacttaaaaacatagttgaagtgaggagaaacataaatgataacctaatcacattctctgagtttccctcctaggtcactggctgctccttctcattttcctgactcccattattcctaacctctaagtgttggactaccctaggaggggtataggacttttgtctttctctattcactgtctaggtcacaggtcagtaaactctacctgcagaccaaatgtagcttaccacctattaatttttataaataaagttttattggaacgcagccacacccattttcttaattattgtctacagctcctttcacaatacaaggtaaaaattgaatagctgcaacaaggactagatagtgcttctgatcctttacagaagaaaaattgccaatctctgtctaggtgatctcactaaggtgcatagctttaaatataatgtatatcctgaaaattacccaaattctatcttcagtcctgactcagatatgaatgacaacttctctacattatatttggatgtcttataggcatacaaatttaacatgtctaaaaggtaaaatttgctttctaccacccctgccactcctttgcctcttgtatctcaatacacaatttccattcatccaattgcttaggccaaaaacttcagaatcctccttgattcctctatttctctcatactccatatcccagccatcaaaaaagtacatctttaaaatatatccagaatctggccacttctcagccactccaatgctaccaccctaactcaagtcacaaccattttcacctggactattgtagtagcctccttactgggtccctatttctgttcttggtcccttacactcaatttttacagagcatctagagtgatcatggaattccattactgaaaacacttcaaaagccatgcaaggtgtggcctcttgttatattctacctttcctccctcttactgactctggtcactccccacatggtcttttactgtcaagcatggtcctgccttagatctttgcatttgctcttctgtctggaaaagtttcccccaacttatctaggtggtttaattcctcattttattcaggtctctgatcaaagattacctcaagttagaggtcttccttaatcactctctctaaattagtgactcctatcaattctatatccctgttaataggtggattccctagaaaacaggctctaagattctgggatttgcatgcattttggggagtgcccttaggaacaacatctgaaagggagtgaaggaagcaggacaggcagagaaagaagctgaattgcagtgtggttctaacagaggtttaagccacaggaacctctgcagtgggtatagtttttgaaaattatcccacatgaggaaaagagacagggtctttgagccgacatatacataatgaaattcccagtatccccagagttggggtgtaaccttgagtaagacacataaatatgtgttttagggaaatgcaaattaaatccaaaataagatactactttacacacactaggatagctaaaatcaaaaaagataaaaaataacaaatgttggtgaggttgtggggaaaatagaaccctcatacactgctcatgggaatgtaacatggtacacacagcagctccggaaaacaggtttggcagtctcttcaaaagttaaacataaatatatcacacaactcagcaataccatacctagaaatctgcctaagagacatgaaaacatatatctacggaaagaattataaaagcatattcatggtattattcataatacctaaaagcaacacaacataaaagtctagcaaatggtgtgtggattaacaaaatgaggtgcatctaaacaaaaaataatattcagcaaaaaaaagaacaaaatacagatacatactgtaacatggatgaacctcagaaacattacactcagggaaagaagccaacacaaaagaccatttattgtgtgattctttttaaatgaaatatccagaaggggaaaatcaatagaaatacaaaatagattactggttgcctggaggtaggggtaagaaataacagtaagtgcaaatggccatggggagtattttcaggatgattaaaacattccaaaattggattacagtgatggctgtacaaccctatacattcactatatcatcaatttctatacttagcatgagtgaattttatgaaatgtaaattacatataaataaagacataaaaaagaaaaataaatattactggctgattcttaaattgactaataataatggtgacaataactactactcactgaaaatttgcttaggttcaagaattgttctgagtgcttcatttgtattaactcatttaatcttcaacacaatcctacgaagcaggaactattttattcctatttcagagatgagataactcaggcatgggaaaattaaatagcatgctcaaggtcatagaactaaatatatattaattaacttataaaaataaaacattctaccttaaatgctaagcaacagcacttatctaaaacaaaccaaaaaagtagaagataataccatatgtgtacatacatggtaagttccctgtaagtagcgtatttaagattttccaataagtgaccaacttgcaacacttctgattatctgtatagccattgaaacaagtaataagtataatatttattataagacagcttggccagtacttggtgcatattcagtgagagacttaattactgtagacaaatataaagaatgctcatgatctaatctactgaatcactatgttcatacagacacagaaatatcactatgggtacacataaatacaactttattctgcaacagtcacgcataaacacacacacaaactctaagtcacacaatctctataataaagatttttctagtgcatcatatcacagaactgcaagcatatcattttgttcctgtaactgaaatgtacaatgggacaagatgagatgacagtgtgttttatctttttcatatgaaagttcagtaataaatttcacatggcagtaagccaatatgaatgaaatacttggagatactaacttctcatgtatctaccaataaaacactctcaaatttacagatacccctagaaaagacagctgataaccacattgtatgtagttaatattttttttaaatatgaaggcatataaatgatcagcaagcctgacatttagatatttgacaacaatgtattttaagcagtctaataaaacacaaagcacagatgtagaggaaggaagatatgtaactaaaaccacattcaccttcaattcctttgcagactagcactgaaaaacctacatcagcactttctgtctagatgatatattgatacaaagctagaataaaaatggtgataaaaagtaccatttgtaattgaaaataaatgttgctaagtgctgacaagcttctgtcagttaaattgtttttatttagaaatattttgcatttcctctattattcttaagaaactttgtaattaatttttgttccaaataatgtttttgtgtattgattacacaaactagtaatatttacatttaagacatccatttaaagttgaagaaaccatttcataatagaaagccaattcctacccttaattctcttaaaatttaacgtccacctagaaagcaatgcatcagtaataaatttatgattcaatatggttatcagcccacagctaaaaatttgcagatctgtataaccaagcatattaaaagtccccatggataacatataaccatgagtaactctcataattcaacatgcactacagtaagaaccattacaactgcatgttttcattgttaggtcccaatccatttttaaaagaagctgtacatgtacatcaccaacttgcacatacatgcaagtaaaattaaattacctaaagggtatcttctgaaaaacctgagagttttttttaagacatcagtataaccttggttaaataatcttatggtctctatataaagatttgaaatttctgaaaataaaaacatacagtaacataaagcttgcttctaagagtagccagattcaatattcagatttagaaaaattacattcattaaatttaagtgaaacaaataattatgctgaacttctacaggattgccctcaaaatcctatacataactagaaaagtggacaaaatatataaagctatttcagatagtggaccaatggcagaagaggcatgtgattattaacaaaagggaaacaaatcaggtgatatctaagactgcccctattccaacctagatgcaaagtccaaactgtggtataagaatggggaactcagagcctcatggtccaaataagttgagaaacagattagagtttgaagacactgggatggctggaatttgtgggacatattaaagataaaaagaacgctatgcagagattggcataagaatactcatgaggctttgaataggaatctgtgctgcatagggtgaaactccaagcagccaagtgaaaaatagcaggaaaagatcaatttcaggggagttataaagtgaacaattccaagaatgaagagcccttgttgttgaatacccagagtattctgtagagactccagaaagctcatgccttagtagtgagtctaaactagctctaaagattaccctagatcatccttgaaaagcacaaaaatagccttgaaatgagcaggctgatctgcaaataatttaaatgcctaccaaaaaagtggagggtggtggggagagagaccatttaaaagaaaaaccaaaatgtaattagtactacattagtaaccaaaaagaaaaaccaatgtaaattagtatgtacattgttcaaattcagctgaacaatgtaaatactaatattcaatgcctaacagtgaaaaaaaaaattagagacagacaaataaaagggaggaaaatgttgcccacaactaggagaaaaatcagtcaataaaaacagatccaattaacaaagataacaaaattaacattaaaaggccttaaaacagctattaaaataagttcaataagattaaagacttaaaggaaatatgaacataacgagaagacaaagagaacatattgagaatcaccaaattaagtgtctaaatatttaaaaatatttttgatacgaaaatgttgcagataagacactacagaaaatatcagtgaagctggaaacatagcaacataaattattttaaacaaagtatgaaggaagaaaatattttaaaaataaacagtcttggtaacatgtgagggcaacaacaatctaacatttttataattcaagcactaaaataagaggaaagaggtcaagaaaatatttaaagaaaacatgcccccaatttttctgaatttaataaacaatatcagcctacaaatccaagaagttcaacaaagcccaggaagaataaagaaaaaccatgacatgatataatcaaattgctaaaaaaaaaaaaaaaaagtaacaaagaaaaaaatcttaaaagtacccagaaaaaaaggcacataatataggagtaaatataataacacatgtcttgtcagaaattatgcaagctggaaggaaatggaatgacattcttagagtgctgttagaaaaaaactgtgagactaaaaatcatacagccagatcaaatatttttcaaaaatgaacacaaaggcaaagatgtcattaccgatatacccaggacctagccaaagcccacaacacccctgaaattctcaagatcaagttcaaaaaaaggggtccccgtgaaagtgaccatcaagatggcaccacctcaccagacctccttggagctcttcgtgtacctgaacgaagtcacgggcaagcacggcatgggctgtattgacattatggagaactgcttcattagaataaagtccagaggtatctacaagaccccagcaggcaccatccttcaacaggctgatttagacatcgaggacttcactatggatcgggaagtgcacaaaatcaaccctgagtgtaaatctgtccaccattgcatcaccaagtcccaggagcaaatggaaggaaaagtgcaggtgcccatcttcaagggccaggtgcacatcctcagccaggagtctctactctctctctacaaggaggagctggtgagcgtcaacgtgcaggggaattatgagccaatcgatgccaccggtttcatcaacatcaattacctcagactgaaggaatatcattatttccagagtaaggtcactgtcaaatagacccatgtacaatggagacctggggcctcctcactttgcagctctcccaactacaggtgctaattgttgtgacgatttgtaattgtgacttgttctccccagctggcagaatagtggggctgccaggccccaactttgttccctgatctccctgaagcctgcaaaattggtcatcaaagggaagggtggaggacaaatgcaggagtaagctataaaatgacaattaaaaaataacaattctaaatatttatgcacctaataatgaagcttcaaaacacatgaagtaaaaactagaactgaaaggaaaaaaaagaaacccataataatagctggagatttcaacactactctctaggtaattgacagaacaaagagaccagaaacagtaaggatataaaatacttcagtggcaccatcaacaagttgacctatttgatatttacagaacactcacccaacaatagcagaatacacataatttgctaatgcacgtaaaaaaattaactaaaatagggcatattccaggccttaaaaaaatggattgaaatcactcaaagtactttctttgatcacaaaggagttaaaacggaaatcaattaaggaacaagtcctgaaatatctggaagtcaaacaatataattctaaataatcaatggaaaaaagaaaccacaagggaaatttaaaaacatcttgaataaaatgaaaacataatataccaaaatttgtgggagaaaactaaagtactgctcagaacagtgtttccccaaatgtgctacacactaaaaatcacatagggagtttttaaaaatcccattgtacctcatatcaatttaatcaattaaataaaaatatctggggatgggagacagaattattaatttttaaggattccccagacaattccaattggcaacaaaatttgagagccactggtttagaagaaattttttttttaaataaacttctacgttaacaaggtagaaaaagaaaagcaaattaaaatcaaagtacatagaagggaagaaataataacaagcaaataatcgaagaaataaaaaacaaacccaaagctgctttttggaaaacatttttaaatgataaatagctagatgaccatgggaataaaatagaaaagacacaaattaacaaatatcagaaataaaaaaggagatattatccagatacttcagacatcgaaacaaaaacagaggactattgtgaacaattttataccataacttggataaattaaatgaaccaattgattaaaagacacaaattataaaactgaatcaaaataaacccctcatcaatctcaaaagtttaactcataattaacaatcttcccaaaaagaaaattcctggaccagatggtttcactggtcaattctatcaaatatttaaggaagaattaaaccctatacaaactttttttagaaaagaaaaaaagaagaaatacttcccagcttgtttatgaagccaccaagcctccaaatccagatagagattacaaaaaaaaaataaaagacagaccaatgtatctcatacatatagacataaagaaagatctttaacaaaatattaccaaatcaaacccagcaatataaaaaaaaaatacatcatgatgaggtttggcttatccaggaatgtgagatgggtttagcatccaaaaatccaatcaatgtaatttaccatattaacagattaaaaaacaaaactatatgacaatatcaatagttacagaaaagcatgtggcaataatccctcagtcctaatttaagaaaaaaaaaaaatctcagcaaagttgaaacagaaagtgtgccagttatcaacctcttgcctgtcagctccaaatttacccttccctgtcctgctttgtgatgtgggagctagaccctgtatcttttctttgccagctgctgtaacactaaattttgttagcagagggtgctggagagaacaatgcaagatgaaggagcttctctttctgcttccgatatgctttgttctcctgtttttcttatggcaatcagcatcacaaagatacccagtgatactcacatcccagcaagttgcagcagcacctccataagcaacttcccagccagttccactagcatcccaagtggtttcctggcaagtcgcaagatgttccaaccagcagtttcccggaaagtttcaaaaacacccccatgagaatctttgcagtgaacttgaccccctcctcaggggctggctcacttccaccacataccacagaagcaagaagagaataaagtacactagaaccagaaagagaagccccttcctcctgttcccctgcaggaagattccgagtgaatttcaatgtcacctctgcaggcaatttcccagcaagtctcaaaaagacccagagggtagcttcctgaatcaacaaactagggtgcatccatgtaatcaaatattagtgagtgatttaaaaaatcataacctataaagccatggaaagacatgaaagagtcttagccagcatactgctgaaagaagccagtatgaaaaagctacatattgtatgatcccaattaaatgacattctaaaaaagacaaaattgtataaacagtaaaaagaacagtagtaggagtaatgggcaggaggaagatagagatgaataggtaggagcatgggatttttagggaagtgaaactattctgtatgatatcacaatgatggaagcatgacatgcatttgtcaaaatccatagagctgtacaacacaaagaatgaaccctaatgtatagactttagttaataatattgtatcaatattggttcatcagttttaacaaatgtacattaatgtaagactatcataataggtgaaactgtgtacagggaaaaagggattatatgagagctctctacaaaaatataaaactgcactaaaaaatacagtctattaatttttaaaaaaacacattttcaaattttcccatagcttcctgtagtgggcagaattctaaggtggcatcccagattcctgcccactggtgcacacactctgaagattcccttccccttgggggtgggtagggctttaagtatgatagttttcactcccagtatgatgttacattatatgacaagcatgaaaagattgtattaacgtaattaaagtcccaaagcagttgtcttcgagtttgtcaaaacagagatgattctgggagtccttaaaagggagtgggtcctccttgaaggataagcctcaaagcttgagagagcttttcctgttggtcttaaagaagggggcctgtataggagccatgtagcaaggacttacaggaggggacctctagagaccgagagcagtctccagacaagagctagcaagaaaatgtggacttcagtcacacaatccccaaaaactggattatgccaacaaccacatgaacatgaaaaaggatcctatgagatcccagatgagattatagcccaggggagaccttgactttagtatataagaacttgagcacaaaattcagctatgcccagacttttgccctacaaaaagtctgagataattaatttatatttttacaagccactaagtttgtggcttattaaacagcaatagaaaactaatacagtctgttaccttcaggttgacaaatcaccaacgtcaacaaaataggctaaaagaagacattttggaattttgtacattttgacaattgaagtgaatttcatagtcataaaaatttacttattttgcatatagttggcatttgatattttgaaaagccaaattataactagtatatatgacacaaccacagcctatagaaaaaaattacacacctgagaataaaatgcaacaacaaatctatcaggaagtaatttaggaataaaattctcaatttcaaagaaatttcacataacaacttaaaattctacttaggattttacaaattgctaccaagtgataattaaatgtttttaatttttaaacatatacaggttttaaacaacaacaacaacaaaaaaacagaaaaaaaattttgaaacctgcaaataaaacatatcatgagtcctaaatttctgaaaagagatttgcataattttccttaattgtacactttaaaatggttcataatattatgtgaacttcatctcagttttaaaaagttaatctgagcattctaaatattaattataattattacatgtagatctacggagaacatctattcccagtttttgtcaacacccaactacgcaaataaaatcaacagcacataaacagaaaatcatcagctatcccattaaagtacatattgaaactttatatacgatgcttgaaaggtcacctgttcactgcattaaaaatttcttccccgtgctaggcatacaatgaataaaatatgcagtctttcagaaaactgtatgtaatgatatgtcatagcagttcacacaattgtactaaacaatatgcatgctttctgtttttctatcaattaaatattcaggaattactgtcaaatgccatgtcatagcatgacagagatttagcccagattttgaaatctggtttgaaccactagaattagcaaactaagcagcaacataaaatattaagcatgtcaaccaaataatccactttccctctgtctttggagatgccttattaaatttcctaagagaaaaataaaagtacttcatgtaaaaagttttaacccctgctttgaaaacacatattttagcccatcatataaggttttttaatatgattggttctaataatcatatttttaaaatcccaaccagaagaagcactttaaaagtattttttcagtttaatatgcacaggtctgccagcataatatttgtccataattaagaaaattgcttacttgctcagtaggcaatacatgaatcatatgtagtataaaattagaccacaattgagagtttaatccctaaacaacatccaaagttaagcagaatatggtatgatacataatacctttaatataattaaatgagccttaattttacataaatatattaataaattagatatatactatccaatacagtaaccataaactacatgtatctatttaaactgaaaataatttaaagtacataaaattaaagattcactttcttagttgcactcaccacatctcaagtattcaacaaactaccatattaggtagcacagatatagaagatttctatcattgaagaaacagtacttatttgacagagttgagtttaccataaaactcatcataaagcttaagcttcaggcctcctcatttgaaaatgtccctgcaggtaccctagcaatgtgtccatgattatatattttagtaaaatttgtaaaagtaagatactttgccaatgaaatatctttctccacttcctcttcttctccaccaatctcctgttgtcgggtggagggcgtcacagtgagcaacctggggatcatgcaaagggtgatatattcagtttgggtgatacattcagaattggtagcacattgtttttagtgggatatatgtaagtggttcttggtcatttctatgtgtaattagtttaccatctgttccagtataggaatggcttctaggaatacatccctttcccaactgtgctaactcacatggggtcctgatatgaaggttcgtagtcagaggtctatgaagacccctcaatgtgtaacctctgtcacgaatgtgtcccatggcaacgagaactaaagatttgtggcaaatgggagagaagcagagactgaaatttatacagccagaagctactctgtggaaaattcttccaataaggagacatgaaatagaataagcagataattccatttgtaatcaatgcctagtcaagttttctcttattaggaatagagttgatagtgcatatacaattataaatgtagcagacatttcttttttctttttgatgggactcacaatgaaatagaacttttcagacactgcgtttgcaaagcccaaatctgcagctgttctataaatactatgtctgtgagtgaagctgcacagtttatacagctcaattatcaataataaaaacaaaatcttcctaaccatagtacaggaaagtccaatttatctttctaaatctataaaaaattatattataaagtcattgtcatctgagaggggctcaaacattatgtatcctatagatgtggaaaaggtagtttaaaagtgtgatcagcagctatttttccaaatattattatgataatgtcactgaccatcttttacgaaattgtaatcagttgtgatttcttttctcattctaaatacatattgacttgtatataaatttgcatctgtaattttgtattttttttaggagggctgcctccaaatggtctgcctcctttcaggtccccaataaaaccttgatctgaccctgatgctagaaaattatgtcttgattaaaatatatattcactaattagtaatctctatgtattcctttcttcatcctagatgtactgcaatatcaataacccagtcacatcattgtcactgaattctaggatttaaaagggtaaatttgaaatacgtcccttctgctcactctggacctaatctgatatcttttcagccttcggtacaaaaagctcacacctcactagcactaatacaaatgtcattcctagtaattaggttacactgagtgcctttgagctttgcagtgctactgccagtgaagttcttaatacatttacagtcatggttatttaaaccactaaggcttttctttgagtaaacaatatattgatcaaatcaaatgctagcctgacaataccaattaatttaagaaaataaaaaatacacaaaaatttctgttatctaattatattgaagagattgctcctaaaacaaacatttgtaaaaccacctttttgtactatgaaaattatatttgtacacatacaaatataaaaatgcccaatagctaaatgccacttatgcaaatagtccctaagttttctttgatttacagtttatttcatactctttatatttcattaagccatccttcaataaactattttttcaatattgtgttgcgaagatattctcagcctgaaattacatcaaataaattacaaatcaaatttctgaaagccactgccataggtggaaatcaaatcaaatgcctagcttcacataaatggttaaagctttaaataaattgcatttatataattgccttacttgctgctgcctcctacagctgtagaataatgttattccaatatatgaagaatatattggcagacaagactaaaaaattttgaattattaattaaaaatgggaagttttattaaatacattaaagaactgaatttagacttggaatacatatattcctgtagctctgtttctctgattaggccctgactgttacacttttactaaagattttttttaaaaggaagaaaaaatttcttacctaagaggatttggagctgtgaaaggaaatgggccccaaaatcactaagctaaagggaaaagtcgatctgggaactgcttaggacaaacctgtctcccgtgctattcaaagtcactcctctgctcactgaaataaatgtgtatctgattgcctcctttggagaggctaatcagaaactcaaaagaaggcaatcatttgtctcttatctacctatgacctggaagtcccctccctgctttgagttgtcctgcctttctggacagaaccaatgtttatcttacatatgtttattatgtctcatgtctccctaaaatgcatgaaaccaaactgtgttctgaccaccatgggcacatatcgtcaggaccaccggagaccttgtcacaggcacgtgtcctcagccttggcaaaataaactttctaaattaactgagacctgtctcagattttcagggttcacagaacaaaatgataatttactgcccttactcaaaaaatattgtcctattcatagaaaaagaaaatgataaggtggtttccagacactggaagtagtggagaagtgttacatagttattgcttaatggatacacggcttcagtttgagactatgaaaacattctggaaatggatagtgaggatggctgcacctgcaccacaataagaatgtatttaatgtcattgaactgtacacttaaagatggttaaaatggtacattacatgttatatatattctatcacaataaaaatgtttcaattgttctaattatatttacatttttatattcattttttctgagattcagcctgaattgaaaagtgcttcattataaataatagaaattaaatacttaagttggtcattcaaactcacaataaaatggagaaaagaaatcaagttttctaagttgtgactctgtgagcactttactaccacacaaattgagagatcacaaaagaaattccgaacttctctgaccaaggacagttgttttgaaacaaataaaaaaactatctgtacaataaaggtacaggtgaaactttcttttttttaaacttcaagttctagggtacatgtgcacaatgtttgcaggtttgatacataactatgcatgtgccatcttggtttgctgcatccatcaactcatcttttacattaggtatttctcctaacgctatccctcccccagccccccaccccccgatagtcccccgtgtgtgatgttccccgccctgtgtccaggcgatctcattgttcaattcccacctatgagtgagaacatgcggtgtctggttttctgtccttgtgataatttactgagaatgatggtttccagcttcagccacatccctgccaataacatgaaatcatccttttttatgactacatagtattccatggtgtataagtgccacattttcttaatccagtctatcaatgatggacatttgggttggttccaagtctttgctattgtgaatagtgctgcaataaacatacgtgtgcatgtgcctttatagtagcatgatttataatcctttgggtatatacccagtaatgggaccgctgggtcaaatggtaattctagttctagatccttgaggaatcaccacactgtcttccacaatggcagaactaatttacagtcccaccaacagtgtaaaagcattcctatttctccacatcctctccagcatctgttgttccctgagtttttaatgattgccattctaactggcatgagatggttatctcattgtggttttgatttgcatttctctgatgaccagtgatgatgaccattttttcatgtgtctgttggctgcatagatgtcttcttttgagaagtgtctgtttatatcctttgcccactttttgatggggttgtttgtttttttcttttttttttttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcatgcccggctaatttttttttgtatttttagtagagacggggtttcaccgtgttagccaggatggtctcgatctcctgaccttgatccacccgcctcggcctcccaaagtgctgggattacaagcgtgagccaccgcgcccggcctgtttttttcttgtaaattggtttgagtactttgtagattctggatattagccctttgtcagacgggtagattgcaaaaattttctcccattctgtagattgcctgttcactctgatggtagtttcttttgccatgcagaagctctttagtttaattagatcccatttgtctattttggcttttgttgccattgcttatggtgttttagtcatgaagtccttgtccatgcctatgtcctgaatggtattgcctaggtttccttctagggtttttatggttttaggtctagcatagaagtctttaatccatcttgaattaatttttgtataaggggttaggaagggatccagtttcagctttctacatacagctagccagttttcccagcaccatttattaaacagagaatcctttccccatttcttgttgtttttgtcacgtttgtcaaagaacagatggctgtagatgtgtggtgttatttctgagccctctgttctgttccattggtctatatctctgttttggtaccagtaccatgctgttttggttactgtagcattgtagtctagtttgaaatcaggtagcatgatgcctccagctttgttcttttggcttaggagtgtcttggcaatgagggctcttttttggttccatagaactttaaggtaccttttccaattctgtaaagaaagtcattggtagcttgatggggatggcattgaatcaataaattactttgggcagtatggccattttcatgatattgattcttcctatccatgagcaagggatattcttccacttgtttctgtcctcttctatttcattgagcagtggtttgtagttctccttgaagaggtcaccacatcccttggaagttggattcctaggtattttactctctttgtagcaattgtgaatgggagatcattcatgatttggctctctgtttgttaatggggtatagaaatgcttgtgatttttgcacattggttttgcatcctgagactttgctgaagttgcttatcagcttaaggagattttgggttgagacgatagtcttttctacaaatacaatcatgtcatctgcaaacaggaaaaatttgacttcctcttttcctaactgaataccctttatttctttctcttgcctgattgccctggccagaacttccaacactacgttgaataggagtggtgagagagggcatccttgtcttgtgtcggttttcaaagggaatgcttccagtttttgcccattcagtgtgatattggctgtgggtttgtcatagatagctcttttaattttgagatatgtttcatcaatacctagtttattgaaagtttttagcatgaaggggtgttgaattttgtcaaaggccttttctgcatctattgagataatcatgtggtttttgtcattggttctgtttaagtgatggattacgtttattgatttgcatatattgaaccagccttgcatcccagggatgaagcccacttgatcatggtggataagcttcttgatgtgctgctggatttggtttgccagtattttattgaggatttctgcatcgattttcatcagggatattggtctaaaattcttttttgttgtgtctctgccaggctttggtatcaggatgatgctggcctcataaaatgagttaaggaggattccctctttttctattgaatggaatagtttcagaaggaatggtaccagctaatctttgtacctctggtagaattcggctgtgaatccatctggtcctggactttttttgtttggtagcctattaattattgcctcaatttcagagcctgttattggtctatttagagattcaacttcttcctggtttagtcttgggaggctgtatgtttccaggaatttatccacttcttctagattttctagtttatttgcgtaaaggtgtttatagtattctctgatggtagtttgtatttctgtgggataggtggttataccccctttatcattttttattgtgtctatttgattcttctctcttttcttctttattaaacttgctagaggtgtatctttgggacacatttaaagcagtgtgtagagggaaatttatagcactaaatgcccacaagagaaagcaggaaagatctaaaatcgacactctaacatcacaattaaaagaactagagaagcaaaagcaaacaaattcaaaagccagcagaaggcaagaaataactaagatcagtgcagaagtgaaagacacaaaaaatccttcaaaaaaatcaatgaatccaggaactggttttttgaaaacatcaacaaaattgacagtgaaacttttttaagtaaaaagatagttaactatactaatggctacactgagcatgataattattgcagatggtcaatggtaaagcaagtgtagttgtttcagctgtagagataacgtaattaaatgaacagtatagacatctgatcaactttgaataatcaatcttatcacgtataccaacatgccctgttcttcacaaaatccattcacaaattctaggatgtatgattttttaagtgaattctgattcgttagaggttaatgtttacgaatgcaaacagcatctgtagaacctgatttacggtaaggtactttctactcatcacagtatctccaccgtttaacactgttacaacgcaagtgcacaacaaatatctgtttaagtagccaggaaggaaggagagaaggaagaagagaatgagggagagaaggaagatagatgggtggtttcggtagattcttaaaacccatccgttaatactcagtgtttggctgtggtatgaataaaagagagaggctagagactacaagtaattaacagactgcgagggccagtgtcccagactaagccatgctaatttttagatattactcgtgacttttttctctactgacaaaagctcagcatttaaatatattaggtgacacatatatcacaaggtacctgaataacagctgggattcattacatctgtataatcatctatgcatgatgtatagccatgctacttaaaactatatcttaaatatgaagactcttaacagagtaatttcatacattccaaaatatttctcttcattgtacattaattaaaactatattttcaacattttataataaatcattctaaaagccaaatattaagcaattctaccacaaaaccaaaacatttgaaacaatcaccatattttgactttgcaacttttgtaaaatatgtggttatttgggtcacagaattgtatcacatttgttgactaccaggcaaaattctttgacaagtgactttcaggtttacacagtctgctgccattatagcaattatatggcataatggaatgctagccatgtgtacttctgacattcctctaaatccaggtcattagtcattacatgaagtcattttaagtttccttcatcaattgccctctgtagttttccagctgtcatttcatttgttagtttcaactgaaatgtaaatgtaatagatgtaaatgtttatttagggattgcttcccctttctgtttttcacataaacacttacatacttcgattccttaaacacaacatgttttggcaaaactaatctatagtaaagggggaaaagtgagaaatgtggttccctgtgaggtgtgggagcagaaggtgactgagaaggaccatgagaggactttctgggatgatgttaatgttctgtatcttgatagagattagggttacacaacataggcatatgttaaaactagcaaatgttcacttaagatttatatacactattgtatttaaattttacctcaaaagaaaaaaaaactgtaaactattcttgaactctagttaacaatacgcatgttgaaagtatttagggggaagtgcctatagtttactttgaaatgcattataaataaataagatggactgatggatgaatagagggattaaaatatagatagataagataacagaaaagtgataagatatgagtggtgagtatactggtgttcactgtaattgtcttttgacttctctgtatgtttgaaaatttccataataaaatacattttcaaatttaaaaagtcatttctccaaaatccttttaattttcaaattcactcagtaaagaaagaggaatcagcaagtgttcccaaacattttgaaccataatcttagttacccacctgctggatcattcttagatcatttcttagtagtcagaaaaactggtccaaataattaagactcgataaaaatcttgctaaattaatcaaacatataatttattcatctactccttcatttattccacaaatacatgtcaaagacctctaagaagcagatgtctcttctaaatgctacagaaaaagagaactgaattgtaatacaacgtgatatacattaactgctataaaaacacgacagggagggcattttcgggaccatgaagggtgagtaaaattttgccagattgggtacagggagcagaaagttcatcccagggtatggactatcatgtaggtaaccttataatacataaactttgttttacagctaaaaaaggtaaattatatatttctggtagttgcttctcaaatatgtcaaaataatttaaaataaatatatgtacattaatccctcctttttgtatcttacatactgattttagaagattctgcaatcttttcaatcaccagtataatttaggttttgcttattcaccactaaatcacagcaacatgtatttcatttataataattaaaggtatgttcgttcacatttgatggtattaccactgagaggttttttgcaataacatgttttccctggaactcactttgggaaacaattctctaaagtcttgaaatcccaagagtgcatactcagggattagaaaggtttccctagaccaggatgcaaataaaaatgcaaatctttcacacagcaactctgcccccaaaaaactgacaaaggacaaatatcaaagtactgtgtaaattgtctacaatctatttagagactttaaatatgttatgttgtcctttttaaggcatgtggctggtcacatttcctttgatgagtagtttgcctttctaagcaacctaaccaaaattctggcatatgtgagtttactgcaatattatttctttatgatctgcaagatgtggatatcactgtctatctcacatgcttaacgtgaaggttatatgagatttttttaaataatgaaagtcagtgtttggtgtttaataaatagtagtaattaacaataaaaaatatttacccatatacctattcaggcaattgtacaaccatgcttttaaatttgagccaggaactgaggtgagccagaattcatcttattttatgagtatagttacaaagtcctaactcatagtctcattgcattactgatcactttaatgtcatgataatttttcatttgctccctttcagatccaaactccttacttcactgatcacccaagactggtactctttacggagttcgctagcgaagaccttagaattcttttatcatttatctgttagtggctgaggatagaaatatcagtggaccttcacctcaaataatcctctaaaaaaattcccagcgactgagttgggccagaagttcagactcaagatactttgtaatttgtttcaaattattttctgtaggtactatcaaatgatccctaagccaaatgaaatgctttgttctaatgactgaaaaaatcagttaagaaaggcaggattaatattagggcacttcttaggactggacagtgcattataaaagaaaatgaagaacattcagagatccaagagaaaagagacttctagaacaaaaaataaatagaaaacctgatttcatttgttagtacaaataataatgactgtcactatttaacagaaaactacattaccatattgaaatagaaagaagtgagaattcgaagctataactttgagatgcaattaagtgatccaactcaataaaccttaaacagaagactgtttctattcagagtgccagaacagtgtgaatctgggaacaaccttggaaaaggatcttgactatggatcagatattaatctccatgctatgtttccattatgccaaaaaattaagcactcttaatatttacgacagtattaaattataaatctagccccacatatcaaaaaattttaaaatagttacatctttaatgtcattaagagcaaatacagagcctcaggctcagttctattaggtaagttcatatcactgacattttcttcccatgaaacacattggacttaagatatagctatgaatataattttgctggaatactaatgatattcattttaaaatctgagtgctattagtacccactttcaatttttcatctttcatgatacgctcctggtacaagtgtagtctgtgtagcaacacactcatgctgtacacctcattggctcagtcctgtcagcagattgagtgcatttgaatctttatgttcctttttttagaatttgcaatattctaggagagtgattttctttattgttcccttatattgtatttcacccttacagaaaatgatagagtaattagaatcttattttccaaataagtcactctgtcttctttgtctaaaaaatatattttctgtttcacatatagatgataaagactaaagcagtagaaaaatgaataccaaaaatgtcaagagaaatagggggtttcaattgtaattttttaaagtaataaggactggaaaaaaattctatataaaaattgaatgattaaaaatactaaaatggttccttactgccctaaataaaacctttacaagatgcttcatatgtgaaataaattaagaatcaattcaaaagaagagaaacttttttcagtaaaatgggtaaaatcttttaaaaaccttttaaaattttctttgatacagtaactttctaaagaaatgttcaagtgtctatcaattttactttcacgaaagaaatctaactctgctttactgacaatgcagtttattttaaaactagagcagtacaaaaaggtcacaaaaagactttctgaaatataaaatcagtctaagataagcaaagctgaaatgactatctataccacctttccaaacctattaatgcttcaaactatattattatacaaccacaaacaaatatgtacatactctctactagaacatctccatagttgccgtgaatcattctttcattttccataagtacttacaaagctccataagtacttacaaagcagtatagtattcaattttaaaagtgtaaaaataaaatacacagagttttgacaaatagaaagtatcagataaaacgcgaatgaaggctagatggctaggtggatgggaggtgggtggatggacagatacataagtagttggatgaataggtgctcaggacatatgaatggatgaatatggtgctttctatcaaataaaagaacatgcaatccttttttcttctttcattaagtaacacttgtatattaatctaggtgttgcccatgagcttcaagagcagcttcatgaatctctgggaactgcatgtagggaaatgcatgttgatataggtacacacatgtggggcctggggaagggggtaagcatgcctataggcatcaacacaaaaaaaggccccttcttctaatctccagaaacaattaacctactcttttcaaaaactctactttgccagtctttcatctttcagcagaagaggcaaggcctgagtgaaaagtatgatgcctcctctggcttggcagcctaaacaaacaagctttccacacatagaccagggaagcttccacacccacatctggtgctaggcatggttcctgaattcaacagcaggataatacctgtccactatgtaataaaggcactaaaagttagctttaaaaaaaaaaatcaacatagaattcctgatttcatatttatgaaatagcatcctttcacaatagcacagaagaattaagtaaacaatttaaagattcacatctaattgagctccaactcagataaaatagcctgtgtttcttaaattgagactcccacaactaaattttgcctttcaaaggcaaaagaattttgaagaaatggtatcttcctagagatccctttggggaacatttttacaaacacttttcatgtgggcaaaataatttcactagtttgtttattggacatattggcctgtactttcacaaatgcagacccaaaaatcaaaatcagagatggaaaagggcaaacagtattatatagcaagtatgcttggataagaatcaaagtagaaggcttagggtttggctctaaaattagccaactagacatgagtttctgagcaagaatgatcataatgtagtttagttccctttcagtggctattgccacatgtatacaaaacaaacataaggaaatgcatcatattcttaagatactcatcctctcatccatctggttttatctcataaattacaaagtcctatttgaaattcttattataatattaaaattgggaaaagagcaaaattagagaatacataaggtaaggaatattgaaaattaataacaaagtaaagaaatacgtttgaattttttcacaatttctacaatatgcctcctgaataacctaactgaaatatgtctgacaactacagctatggaatctaaaagtaacagaatattattattttccttcctggtaaaaaaataaaaagcatataaatttatacatttttaggaaaagctaaaaatgtcatcaagtatgccttttagccttctttaacttcttttcaaaaatctaaatttataatagatctatagttctgagactatataatcctgttagcctaaaaagagataaataattataaataaaattattgtatttccttgatttatcagactctccatcctcaaaccaaaatccttacttaattaagcagggcaaatataagcaatcacttagaaaagtggtgtgataactattttaaactattaatctttttaaaagtaagcctttttaggagatctaagtagtacactcaaatattgtcttggatgctgggtgcacaaaataagaacctataccagttcatgaatatttttattgttttctcttttacccagggagagaaatagacaaaagacactattaaagttaaatataggctgggcatggtggctgacatctgtaatcccataactttggaagcccaagggaggtggatcacttgaggtcagcagttcgagaccagcctggacaacatggcaaaaccccatttctactaaaaatacaaaaattagtcagacgtggtggtgagtgcctgtagggccagctactcgggaggctgaggcatgagaatcgcttgaacctaggagacagagattgcagtgagccaagatcacgccactgcactccagcctaggcaaaagagtgagactctgtctcacaaaaaagttaaatacactgtgcccttttttatcttgaccacaaaaggtctccatctcagtaataggtatcatacttgcagtacctccgtggcatatgcccaggatttatagatcttttgttagataacaaaatccagataaattaagagagaaaatgcaacctgtggtacaataatacccatcattaatgaacttcggactttcccagtatttcactagtcagtgtaaagagaaattgttgtacgctcatgagcaagtcagtttgcttggtctcagttttctcatacataataaagtattttacacattccttttattaatctataaactctataagcaaggatcatggtaccctaacacccgcccaacataggcagccaaaaaatatgcatgtgcagaatgcaagatcacacaggttttttccagccaactttatcttcaattatataattttttaagtctaatatttgggtggataggtccataatgcatattaaaacaaaaaagagggtggttagggccacaaaaatgtggtagaaataattgaagatcacaaaagaagaaacaatttcctagagttcaagtggcctccatcaaactttaccaaaaccctaccaaaagctctaattctaaactttataaaaaagtcatagaagtataatttctctttcagaagtaatggcttttgttgttgttgctgttgttgttgtttctagttgagacctttgctgaatgtctaagaattggaaaaacaatgaagtcaaacctttcctaatttctattttaagatatttatactttttccaaactttcctcagatttaaaaaaaaaattgtattctttggaaaacaaaaagttagtactcagaaattcatatttggtaaaccactccagtaaattaattgaacccaaagagggggtcatgggaactgcaacttgaagccagttcatcagaagttccagagacctagacttgagactggtagaggaggaatagggaaaggtgcagtcttgggaactatgccctaaacctgtgggatctgacactatctccaggtaggtagtgtcaggactgaattagaggacacccagctggtgtctgctgcttggagtgtgggggaaaaaaaaccccacacatatggtcacagcagtcttctgtgttgatgattgttgtggtgttagagtagaggaaaaacacagttagagagagttttccttaaacaaatggtgtcagtgaagcaagattagctggaacaccatgatcaggtgggatttatcctagggaagcaaggatggttcaaaagacacaaattaataaatgtgatacattgcataaacagaattaaggacaaaacccatatgatcatctcaacagatgcagaaaatgccttcagtaaaattcagcatggcttcgtgataaaaatcctcaacaaactaggtatagaaggaacatacttcaacataataaaggccatatatgacaaacccacagccaacattttacttaatatggaaaagttgaaagcatttcctctgagaactggaaaaggacaagaattcccactttcaccactcttactcaatatcatactggaagttctcactagagcaatcaggcaagagaaaatattcaaaggcatccaaattggatgcctcttcactgatgataagatctagtatctagagaaccctaaagattccaccaaaaaaaccttagatttgataaatgaattcagtaaagtttcaggatacaaaattaatatacagaaatcagtagcatttctatacaccagtaacgacctagccaagaaccaaatcaaggaggcaatcccacttccaacagctacaaaaaaaaagaaaaaaaaaaacacacctgggaatatatttaacaaagaaggtgaactatctgttgtattagtcaattctcatgctgctatgaagaaacctgacactgggtaatttataaagaaaagaggttcaattggctcacagttctgcatgtctggggaggcctcaggatacttacaatcatggcagaagacacctcttcacatggcagcaggagacagaatgagtgccagaaggggaaatgccagatgcttatctcatgagaactcactcactatcacgagaacagcatgggggaaaccaccccagtattagtccgttttcacactgctgataaagacataccctagactgggcaatttacaaaagaaagagatttaattggacttacaggtcaacatggctggggaagcctcacaatcatggtggaaggcaaggaagaacaagtcccatcttacacggatggcagcaggcaaggagagaaatgatgaggaagacatgaaagcagaaaccccttatcaaaccatcagatcctgtgagagttattcactacaatgagaactgaatcatgagtgaaactgctcccataattcaattgtctcccaccatgtccttcctacaacacatgggaattatgggagtacaattcaagatgagatttgggtggggacacagagccaaaccatatcagaccccacgattcaattagctccacctgtcttgcccttgaaacgtgaggatattataattcaaggtgagatttgggtggggacacagaacaaaaccatatcatctctttaagaagaactacaaaatactgatgaaagaaagtgtagatgacacaaccaaatttttaaaaatcccataaccatagaatggaagaaataatattgttaaaaatgaccatactacatggagcaatctacaggttcaacacaatccctattaaattactaacatcatttttcacagaattagagaaaacaatcctaaaattcatatggaaacaaaaaagaccccaaatagccacagcaatcctaagcagaaagaacaatgttggaggcatcacattacctgactttaaattatactacgaggctacaggaaccaaaacagcatggtacaggtataaaagtagacaggtccatggtatagaatagagaacccagaaacaatgccacatacatataactaactaatcttcaacaaagtcaacaaaaatatacactgaaaaagttctatcctatttaatacatagtgctgtgaaaactgaatagcctagccatatgcagaagaatgaaagtggacccatacctgtcacaaagtcttatgttctggtctttggattaggcaatgattttatgaccaagtcctcaaaagccaatgcaacaaaaacaaaaatagacaaatgaggattaaatacagtaaaaagcttctgcacagcaaaagaatcacaatcagcagagtaaacagacaaactacagaatgttttccacaagaaaaaaaaaaaataaccccattaaaaagtgggcaaaggacatgaacagtcatttttctttttgtttttttgtcttgtttgttttttgtttttttgttttattgtttttgagacagactctcactctgttgcacaggatggagtgcagtggcgcaatcttggctcactgcaacctccacctcttggattcaagagattctcctgcctcagcctcccacccaggattacagctgggattacaggcgccttccaccatgcccagctaatttttgtatttttagtagagacagggttttaacatgttggtcaggctggtctcaaactcttgacctccggtgatccacccgcctcggcctcccaaagtgctgggatttacaagcatgagccactgtgcctggctgaacagccatttttcaaaagaagacaaacaagcagccaacaagcagccagtcatgacacaaggtgaaaaatgctcaccatcactattcatcagagaaattcaaattagaagcacaatcatacatttctcataccatctttcaccagtcagaatggctactattaaaaatcctaaaaacaatagatgttggcaaggatgcagataagtgaacacttataaactattggtaaaaatgtaaattagtacaagctctatagaaaactgtatggagatttctcaaagaattaaaagtgaaactaccattagatatactgatcacacttctgggtatctatccaaagggaagaaatcatcatattaaaaagatgcttgaaattatatctttatcactgcactagtcacaatagcaaaggtatggaatcaacctaaatgtccatcaatggaggatttcataaagaaaatgtggtatatatacaacttagaatactatgcagtcataaaaaagaatgaaataatgtccttggcagcaacatggatagaactggaggccattaccttagtaaaataactcacaaagtcaaatacttcatattctcacttataaatggaggctaaacaatgagtacacatggacatacagagtggaacaatggacactgcagactccaaaaggtgggagggtgggaggtgggtaagggtttaaaaattacctattgggtgcaatgttcactattcaggtgatgggcacactaaatgccaagactacaccactatgtaatatacacatgtaagaaacctgcacttgtccccactaaatatatttttaaagaaattcacaattggacaagcgattttaatatcccaaaatacaggaaaaaaaactatgagctacaaattatagaagcagccagccaatcacagctgccacagcttgggcatctcactttcatttagttagatccaccccgggcaacagttcttccagacccttcagtgttttgggggcatccctatactcctgcagtgggccccattcatcaaggatagcagctatcagaccccctatagatgtagacagccagcctagaatttcctccgcatacttcctctctcccaatcccatcatcttggcactcatgggattttcttcaacttattgccatgcataccaggtgtcctgccagacctctgtggacttcaattagatggcactatgtttgagaggccaaagaagagacccagaattagtaaaagagacaacagagtttattaagggaacatatgtactgggcagtccaatggcggaggctggacaggagaacctgtccagtaagactccagaaaaagcaaaaaatattaaaataaaggatttattacataaattatgtcatatccacttggccctctatttaaaatccattaggatattaaacataaaaaccaacaggcaacatggaaaagctttgtttacaaaaaaaaatgacattgggctggaaggaaatacactacactctaaaaaggtatacttttaaccaaacaatgtataaatacaaaaacaaaatttctcagcataatatttcataaactagaaaacttacataaaaatgtattcttaagtaagacagtacggacttgtctcccaagtctttttttcttacacacacacatacacacacacacacacaccccacacatatatgaatactttttaaacattttttctcattatgtaaaaaatcaaaataaagtaacccaaaaatttttaagccctaaatattttattatacttgtaatactgtcactaagttaaactcaaagaatctaacattaggtcattagacaaaactgcactgtgttaatctgtttgcactgctataaagcaatacctcagactgggtaatttataaagaagaggtttattttggcttacagttctacaggctgtacaggaagcagattgctagcatctgctcctggtgagggcctgaggaagtttccagtcatggcagaaggtgaagggggtgcaggtatggcaagagagcaagcaagagtggagaggtgccacactcttttagacaaacagattttgcatgaacttagagcaagaactcactcattatcatgaggaacgcaataagcttttcattagggatccgcccccatgacccaaccacctcccctaccttcatcattgggggttatatttcaacatgagatttggagcagacaaacatccaaactgtatataacgcacttattcttttttaatgaaaatcagtcaaaatatatctttaaaaaaatacatccacagccagacacggtggctcgtgcctgtaatcccagcactttgggaggccaaggcgggtggatcacctgaggtcatgagttcgagaccagcctgaccaacgtggaaaaaccccatctctactaaaaatacaaaattaaccaggcaacatgccacatgcctgtaatcccagctactcaggaggctgaggcaagagaatcgcttgaacccgggagacagaggttgcactgagccgagatcacgcccattgccccacagactgggcaacaagagcgaaactacatctcaaaaaaaataaattaatgcatcccactgctatcacagtttttaaaaacccaaagtgaaaacaaataactgtgtcagactatctttagcaacaaaacgcaaaaacgataacgtctagaaatatatgtaaaataattttaattataccatttataaaagattttattttttaaattaccagttcttttcattttactatttcttctaaaccagccatctggccgctttcaccttacaatgtatggtatctatttttatctgatatattcctatcttatttattgattatctgtctggcccactggaatgtaaactccttaagaaatttttttatcttgttcaaaacccagagtcactacatacaaatgtgtaggttttacacatgtgaatatcattacagttatgcagtgcacaacctgcagaactgaatatggtaggtctggctgtgaacaaataattatcagacatgtaataaaacgccagagatcttaacagttctgtgtcctccctagtggtgatgcaaaccctctctaggcatgcatgccaggaaaagctgttcctcaacattttcaattcctaaatattctttaacattatgttacacaagcatgtacaaattatttgctctttgctattccatgaaatctataacagcaaaatatttctgaggcagaaaccaactcaacggagttacctattaaaggccaatatgaatgaattataatagcagtaaatttttaaagtatttttcaccaaaaatactaaattgtttactattagacacatatcaattatttttaaaataacatgctgacagtctcaaagaatactgtaaatctatatatcattaatgtaatccatttttatgttcttaaacatctaaaattatagaactacatttttttataaactgtcatctcttttttattaaaaaaagaagatttttatgaaaaacctctgagtttaaattactattatattcaggagtcccacacccactgtttccaaacatagctctttttataacaacttctgacaatcctctagagaacaaaaattcacttttaatcaaagttaaatgctagaactgtttcctgggaaatttaattcaaggtaaacaatctacttgatattgtcttattcacacaaagctgtgttgttagaagaaatgataatgaaatataaaacctttctcttctaggttattgtttacaatctggacaaagctgataggcaaaagaaagcagagaaagccaatgtgaaaggaatgtgtaggattagtcacgcttcttcccagaagatagatgttgaccagtaagactatcagttactaaacacagccctctcattctacacccctaacacaatctcttaaaaaagaaattacaacttccaatctccatttgtcaagtatcttgaatttaaatatacaggtcttcacaaatatgaactaaaattcaacaaagttttgtctactatgtgctggacactaataggataaaaatgactaggaaacacttcttgcctcagaggaactttgcatgcaaatgacaacattacttggcaacaaaagaatgtggacacaatgtgaaatcaagccggggtccagcagttagaatcagcccttccttgactacaccagggacatactactacaaatcattctgtcttataccccagcatccagctatcctctggaaatgcttctccctgaagtttacatccttgcttagctatttcactcatctactccacggctaatcccttcatctctgcttctcagaaatggctctttccaatcctcccttccaatctctactccacaattctagtggcccagtctcaagcttcccctccagtgctctcataccttctcaaagctgcaattctagtcctgaagatctaggcaggggaaactggtactcacacattacatcaaggaaagacctcagaggtacacacaccagtggagataccataggttcagttccagatcacctcaataaagtgagtcacacgaattttttggtttcacagtgtatataaaagttacatttacactgaactgtaatctattagatgtgcaattgcattatggaaaaaaaagtacacactttatttttaaaatacttcattgctaaaaaaatgctaatgatcatctgagcctttggcaagttgtaatcttttagctgtggaagtgtcttgcctcaatgttgatggctgctgactgaccagggtggtggttgctgaagagtgaggtagttgtggcaatttcttaaaacaagacaatgaagcttgctgcatcaattggctcttctcttcatgaaagatttctctgtagcatgcattgctgtttgattgcattttacccacagtaaaacttctttcaaaattagggtcagtcctttaaaaccctgtcactgctttaccacctaagtttatgggatattccaaatcctttgtggttgtttcaacaatgttcatagcatcttcaccaggcatagattccatctcaagaaactactttctttgctgatccataagaagcacctcctcatccgttcaagatttatcacaagattgtagcaattcaatcaaatcttctgactccacttctaattcaaactgttttactgtttccaccacatctgcagttacttcttcccctgaagtcttaaaaccctcaaaggatcaacttcttccaaactgctgttcatgttggtattttgacctcctcccatgaatcatgaatcacaaatcccatgaatcagttcttaatggcatctagaatggtgaatccttttcaggaaattttcaacttaatttgactagatccatcagaggaatcgttatctatggcagctatagcctaacaaatgtacttcttaagtaataagactagaaagccaaaattattccgtgatccttgagcaacaggatggatattgttagcaagcaggaaaacactgatcgccttgtacatctccatcagagctcttgggtgaccaggtgcattatcaatgagcagtaatattttggaaggattctttgcttctgagcagtaggtctcaagaatgagcctaaaatattccacaatctatgctatgaacagatgtgctatcatctaggctttgttgttccatttatagagcacagtcagagcatattcagcataatgcttaaggggcctaggattttcagagtggtcaaggaccattggcttcaacttaaagtgaacagctacattagcccctaacaacaaagtcagactgtccttcaaaactttgaagccatgcactgacctctcctctgtagctagagaactcctagatggtatcttcttcctatataaagctgtttcgtctagcttaaaaatctgctgtgtagtgtaggcgcctttgtcaattatcttagctggatcttctaggtaacttgctgcagcttctacatcagcacttgctgcttcactttgtacttacatgttatgaaagtggtttctttccttaagcctcatgaactcagctctgctagcttcaaacttttcttctgaagcttcctcacctttctcaaccttcatagaattgaaggaagtcaggcccttgctctacattaagctttggcttaagagaattttgtggcttaatcttctgtccaaccactaaaactttctccataacagcaataaggctatttcactttctcatcatccatttattcactggagtagcatttttcacttcattcaaatacttttgctttgcattcacaacctggctaactgttcagcacaagaggcctacctttcagcctatctaggctttcaacacgccctcctcactaagctgaataatttctagcttttgatttaaagtgagagacatgcaactcttccttttacttgcacacttgccattgtagggttattaattggccgaatttcaatattgttgtgtctcagggaataggtaagcccaaggggagggagagagatggaggaactgcaggtcggtggaggtgaagtcaagtcagaacctagcacttactgattaggtcgggcatgttatatgagtgtgggtcatggtgcctcaaaacagttacaatggtgacatcaaaaatcactgattatgataatcatagcagatataataacaaaaaagtttgaaatattgtgaaaattaccaatgtaacacagagacatgaagtgagcacatggtgttgaaaaaatggtcccaacggacttccttgacacagagctggcacaaaccttcaacttgttaaaaaaaaaaaaaaaagaaaacacagtatctgcaaagtgcaatgagatgaaacacaattttttaaaaaagtgttcttgtatacaactaactggaaaataagacagtgtaaaactcacatgaaaagctctgcaagtagtccgggcactgtggctcacacctgtaatcccagcactttgggaggccaaggcgggcagatcacaaggtcagtagatcgagaccaccctggccaacatggtgaaaccctgtctctactaaaaatacaaaaattagctgggtgtggtggtgcgtgcctgttatcccagcttctcaggaggctgaggcaagagaatcgcttgaacccaggaagcggagattgcagtgagcagagatcatgccagtggtactccagcctgctgacagagcgagactccatctcaaaaaaaaaagctctgcaggtaatatagtctgaaatatttatcagaggaatgtccaaagccatacagttaagcgttcactgcaaagtagggattcctttttgggagccacttaccatgctccacaaatcaatctcacaatagtctcagtgtaactacactaagtatagttctacttccttagtggaactgtaggaagttatagccaaaaactattccaggttatttgccatttcaatcattggaagtagctatagagacatgtacttgagaacttcatcatttacagttgaatgattttctagaccttccaaatactggattttacccctttcatgaccctttgctccctatataaactttcatcaatgccagaatattgaatgaaatcaccctgaaatcagccatcatatcaaagatggctacaagatacatctcaaaccttcagaaaatggtctgtgctaatgagaaggccgaagtgtcaaccgcaatatgtctgtataggtacctcaaatgtgacaacaactaacaaaaaaaacactctggtacaaataaactagtactggatgcagctaataaagcacatgatactataatgttaaatacatacactaatagaattttctacaattctctgttacgaggtcctttgtaaatcacaggagagtaagtggttttaagattaaatttgcccatatagttaattgccacttcacagcaagtactgtgaataaaaaatccaaattgagctggtttggacctagttacaaataccatttaaacagaacagaaaaaaagcctctatgttgacagggataacaccaaagtggaacacaggcctcatacaaccatctagaatctctcagtttcaccttcgcttcagacatactgaggatttttcatttgagtttttctttccagagcatgtatcacaaacttcaaagataaattagtaaaaatacacacacataatagcataggttgattttatgttttttaagatgaaggttttaaggttatctcattcaatccccttcattttaaaaatgagaaaataaagctccaaaaaggtaattcacacatggctacatgatatatcagagacaataatttctctgttaattacttatacctctgttcaatacagtaatccaaattttcaaatgcaataagttattttacaagcctatcaaaggaacttgctactttaaagacaactggagtactacgaccactgtcttaagagaaggaaaactgagtgggctggttaaggatgcagaggaggataaaatcacagtcactctttgacccaaaatcaacttaatttccagaatgcctagtaagcttgaagcagcttggtgcagctaagcacaaagagctcaaacatttatcaagtctcctctgaagagttctaaatatggggacatcctagtgtgctgctttacatttcttcccagtccagactgcacagaacagaactctcctcaaaatatcccagaaggacttcagaatccattttttcaaatgttttgacacaacactgaaaaggtgcaattattaaaatatcggaaactattatattaattcaaatatgttcagctaccactcattcttcttcctatttttaaatgtggggatcactaagtatctttaaacttagtgtattttcaattttttttctctacagccacagtgaaaggggtggaaagttaaaaaagaaggaatttgattttttatctattagaaggaaggaaaagtttaggtggcattattatatgtgaaaactgaactgtaaagcatacagtatgtgcatcttcacagggtatataatttcaaaaggtgaaaaatgtttaaatagattttaaaattatttctctgcaaatatcacaaaatattaaaagtataggcttgctatgaaagtatctttaaatgttgtgtttctatttttaaaaaatcactttgtcacttgagagaaataaggttgttactttttttctattttccccattctcatatccttcatgtttttcttcattaattacattgtcctttttctgagggtttaaaatattgtgcatattcatgtatccgctgatacatatatttatggtctagctcagctaatgcattggtgaatatgttcacatagatgtatatgtatatgcacacacatgcacataacaagaaagatggcacagtggctaaggctctttctagagtaagactgcttggttcaaattctgcttccaccacttacaagcttggacaagtttcttaacctctcagtgccataattttcttatctataaaatggggataataacagtaagtgcctctaggggtacaaataggactaaataaagatttaatatttatagtgattataacagcgtctagcattgttaagtgcctgcaaataagtgttgaatttttttaaattattttttacttttcttcattctccttctcttcattttcctcatcgcttctactgctacatctttatcaagtatttaaccatcaaatccagccatacagacaaaatttatatacttcctacactcagaaaataaacaacaggacactgttaaccctgatgataatgaatatacctaaaacaaagaagtaagagagcaaaaatgataagcaagaacagaaactatatggcataatgcagtggtcttcaaattggagtagatatgcccctctaattacagtaggaaggtctgtcccttcctactgtccttcagcataatatctattggagacattacattattcagtgatacatgaaatactttagacttacgtttttcttgtaacagttatatattaatcaagatgcaggtttatagtctaatgttgagccttagaagatttttctaagaaacagctaggcatataaatatatttaaggaaatcaattgctagatctaaacgtccataaaaatttttcctaaaaatgacctatgtgagaaagtgcctctcaagtatgatatcctttcccatctctcttctcacaattatccttctctagatttatagggaaaaaaaagtcgtgctcttacacatccccaagaacactgcaggacattgttttgggcagacaaactgtggggagccaaaaaaaaatgaaatctcatatatttttccactacaggtgctctcagcttaagtgaggaccagctccccaagtcagaaaacatcttaccatctttactccttcctagcaatttattccccctttcctagaagaatgaaaaaaaaatagacacaaacatacatacatacatacatacatacataagtttaaactggtttggccttcaaaggaacaaaatcatacaagatcatgatgaataataaagaagtataaatgtgaagactgagaataacgaaactttaaaggactaatggagaattagaattcaagcacgttctctaagacatgggcattctcaaatatattctaacgttctaggtttcagattacatgatcccttttatggagtgctaaaagggcggagattgggaaatgggattaattaaagaacagggaagaggaggagccaagatggccgaataggaacagctccggtctacagctcccagcgtgagtgacgcagaagacgggtgatttctgcatttccatctgaggtaccgggttcatctcactagggagtgccagacagtgggcgcaggccagtgggtgcgcgcaccgtgcgtgagccgaagcagggcgaggcattgcctcacctgggaagcgcaaggggtcagggagttccctttcctagtcaaagaaaggggtgatggacgcacctggaaaatcgggtcactcccacccgaatattgcgcttttcagaccggcttaagaaacggcgcaccacgagactgtatcccacacctggctcggagggtcctacgcccacggaatctcgctgattgctagcacagcagtctgagatcaaactgcaaggcggcagcaaggctgggggaggggcgcccgccattgcccaggcttgcttaggtaaacaaagcagcctggaagctcaaactgggtggagcccgccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaacaggcagactgcctcctcaagtgggtccctgacccctgacccccgagcagcctaactgggaggcagcccccagcaggggcacactgacacctcacacggcagggtattccaacagacctgcagctgagggtcctgtctgttagaagaaaaactaacaaacagaaaggacatccacaccgaaaacccatctgtacatcaccatcatcaaagaccaaaagtagataaaaccacaaagatggagaaaaaacagaacagaaaaactggaaactctaaaacacagagcgcctctcctcctccaaaggaacgcagttcctcaccagcaacggaacaaaactggatggagaatgatttcgatgagctaagagaggaacgcttcagacgatcaaattactctgagctacgggaggacattcaaagcaaaggcaaagaagttgaaaactttgaaaaaaatttagaagaatgtataactagaataaccaatacagagaaatgcttaaaggagctgatggagctgaaaaccaaggctcgagaactacgtgaagaatgcagaagcctcaggagccgatgcgatcaactggaagaaagggtatcagcaatggaagatgaaacgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccgacgttcagattcaggaaatacagagaacgccacaaagatactcctcgagaagagcaactccaagacacataattgtcagattcaccaaagttgaaatgaaggaaaaaatgttaagggcagccagagagaaaggtcggattaccctcaaagggaagcccatcagactaacagcggatctctcgacagaaaccctacaagccagaagagagtgggggccaatattcaacattcttaaagaaaagaattttcaactcagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaaggaacgaaatcaccagctaacatcataatgacaggatcaaattcacacataacaatattaactttaaatgtaaatggactaaattctccaattaaaagacacagactggcaagttggataaagagtcaagacccatcagtgtgctgcattcaggaaacccatctcacgtgcagagacacacataggctcaaaataaaaggatggaagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcgtgagtgacctacaaagagacttagactcccacacattaataatgggagactttaacaccccactgtcaacattagacagatgaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaacctcactaaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactcaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacagacacctctacgcaaataaactagaaaatctagaagaaatggatacattcctcgacacatacactctcccaagactaaaccaggaagaagttgaatctctgaatagaccaataacaggagctaaaattgtggcaataatcaatagtttaccaaccaaaaagagtccaggaccagatggattcacagccgaattctaccagaggtacaaggaggaactggtaccattccttctgaaactatcccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaccgaattcagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaacacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaagaatcacaagcattcctatacaccaacaacagacaaacagagagccaaatcatgagtgaactcccattcacaattgcttcaaagagaataaaatacctaggaatccaacttacaagggatgtgaagcacctcttcaaggagaactacaaaccactgctcaaggaaataaaggaggatacaaacaaatggaagaacattccatgctcatgggtaggaagaatcaatattgtgaaaatggccatactgcccaaggtaatttacagattcaatgccacccccatcaagctaccaatgactttcttcacagaattggaaaaaactactttaaagttcatatggaaccaaaaaagagcccgcatcgccaggtcaatcctaagccaaaagaacaaagctggaggcatcacactacatgacttcaaactatactacaaggctacagtaaccaaaacagcatggtactggtaccaaaacagagatatagatcaatggaacagaacagagccctcaaataacgccgcatacctacaactatctgatctttgacaaacctgacaaaaacaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagactgaacaggcaacctacaacatgggagaaaattttcacaacctactcatctgacaaagggctaatatccagaatctacaatgaactcaaacaaatttacaagaaaaaaacaaacaaccccatcaaaaagtgggcgagggacatgaacaggcacttctcaaaagaagacatttatgcagccaaaaaacacatgaaaaaatgctcatcatcactggccatcagagaaatgcaaatcaaaaccaccatgagatatcatctcacaccagttagaatggcgatcattaaaaagtcaggaaacaacaggtgctggagaggatgtggagaaataggaacacttttacactgttggtgggactgtaaactagttcaaccattgtggaagtcagtgtggcgatttctcagggatctagaactagaaataccatttgacccagccatcccattactgggtatatacccccaaatgactataaatcatgctgctataaagacacatgcacacgtatgtttattgcggcattattcacaatagcaaagacttggaaccaacccaaatgtccaagaatgatagactagattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacactgcatattctcactcataggtgggaattgaacaatgagatcacatggacacaggaaggggaatatcacactctggggactgtggtggggaggggggaggggggagggatagcattgggagatatacctaatgctagatgacgagttagggggtgcagcgcaccagcatggcacatgtatacatatgtaactaacctgcacaatgtgcacatgtaccctaaaacttaaagtataattaaaaaaaaaaaaaaagaacagggaagaacaagagaataaaggaaaaaagcagagagaaggcaaggcaaaatgatttattaggaaaggaagaaaccctttcaaacaaagaaatcctacgttttctctcgatatatcactagaagcatatgcaagaaatcaatatatacttttttaaaagaaaggattaagtagaagataagagaagatacacaggtcatagggaataaaaaattaatagtgcctttccacacagacttgaaacaattctggtcactgaagggcagtaaggctggggaaggtatctcccttcctactgtccttcagtgtagtatctattggagacattacattattcagtgatacatgaaatactttagacttatgtttttctagtaacagttacatattaatcaagatgcaggtttatagtctaattttgagccttactttagtttttatcagcaacaatcttgtataatctaccatgactatacatatgcatcaggtttagtaaagcaatttatgatacagtctccatatgtgaaattgaaagccagaagctaactattattttaacaagctgtcaagatatatagagttttgccaaagaaacattgattacactggtcttttgaaaagtagataaaacttagaattccctaagcaaaccatagttacacaaaattgtcctgagattcctatgaagcacatgactcaaatgctaccaaaatccttcataagtaagatttatttccaataaattatatatctctgttttagaactctgataatttgcagcccattttccagtaacatgtttttatcattttctactgctgaataaaaaagaaattaaaggacaaagagaagatcatgagtgaactatccaaattttattacaatcttgaaaaatacacatccgttgacttcctgttcctctgccactaaatctctgtggggaggtccaacttccaattctctgaagtcgcaaggtagaggaaataaaactaaggagcaggttgctatagctctccaattcaaaagcaaattattactctatttaatacagcaatctactataatctcctccaacactcctgatcctctttacagtactcttttctatagtacttatctcctaacaaaaaaatgtacatatttactatacctattatgtcacttgttgctagaaagtaagcttcaaaagggcagggatctacatcattttgttcactggccaatctcaaatacctagaacagtgtctgacacatagtaggagctctactgaataaataaactattactttaccagtatcaaactccccacctgaggtagcactacctaaactacatgttgttccgattctaattgcatgtgatttttctaatcttcgtgtcattatcatagataagtgtccattgctacaactggaagtaatctgtgcacactgcagccttcattgaaacccagataatacttctgttcgtagctgacctcatttttatggcatcccactgtatagcttgcttcttcactcttatttaggcagtgtcttcgcagtttcctgccttgaatacctcttgtatacatttaccaccttaattatttgctgtgtacattttccttgatgccttctccccactatgacagcagattccctcttctgattttccactgatcagcacggcccttcaaaaaccttcacaaaagcccgttagaaacagattgagagacgcatttgtgaagctatttaacaaatttaagtgtcatttttaaagtattcattgtaaattggagcattgtttcatatcggtatcattggagcattgtttgatatcggtaacttgctttaaactgattaagcacatgtaaagatacatgctaccaatagaagaggatgaaaccgagagatcatctttatggttaatagggagtcagtgacaggaaagtaaaaagactgaaggatgattttgggaagtccaggtaattgtctggttatccctcaccaatgtcttgatccaacccaagaatcactctaacacggcaaaactcaatccttcctgttattttatttgtggcaagagaaagatccctaaaataaaatgcatttataaaatgattgccttataataagcactcaataaatatttgctgaataagttaatggatcaatgagtatttccctatggtttgggaagtttagccaaattaaataccagactttcaaatgtaaagggttacgtctcaaaaatatacctcacccagctgatacacataacacttaaataactgtatctgcatgctcagtaagaacttcatgcattcatatatttaatacatcatcaaagcattgtgagacaactttctaacagtgaattgaaaccatataaaaaactttggactttttgagggtttttggtttttgttttttattagagatggggtcttgctttgtcagctaggctggagtgcagtgatgcgatcgcaactaactgaagcctcaacttgaaggtctcaagtaatcctccatctctgcctccagaatagctgggaccacaggtgcaggccaccacacgtggctcatcaagtgacaacttattctcagtcaaaattcatgggtaaaaataaagttaaaattttttattttaattttgaaaaagtatatattttgtgatcatagctttgattctgctctccatcaaatacatttaattttccatttctccatatttaagcgattaaccccattaaaaaatgggaaactattcattctcaactcactaaaggaagtataaaaggaattaaatacaaagacccactcaaatatagctaatttcattaatatttcctgtgtatcatttcaaaaaaaattactaaaaaatattcctaagattcttcttataatttttatagtttcattattaagaattattgagataatttattttaattagatgggcttttataaagtatataatcaataagtgtttgtagatcccttagttttaaagcttttttttaagtttctctttacccaaaaatataatctggattaaattcaatttactgacccaaagatataaatgagaaattcaaaaccattaacactctaacacagctagatggaatgatgaatgattaagggagaaaccataagaaaacatcaggtaatcatctttctagcatggtctgaatgaaatccttcccatgaaattaaaatttgatacaaagtctatcaggaaaacttctaaactttaagatttgtcaggaaaattgtgaaacactgaaatatgcaaaatattagtggatgtcctatctagtatacccttccagattatctgagtcagtcagaatatgagcctcacattgtctttctgctactttacaaccatgcagttgtaagacacagaataatacaaacaattcttttccataaaaatgcaaataaattgtgtccagtgaaatgaaatggataattggcctgtggctattaaccagttttgcgtctgtttcacattcatttcagcatccttgattgcccatatatgtgtgctcttaaaattctcctttgaattatttgtaacatcttactgatcccctcattaattaatgagcttaataaagtctttgatacccattctttttacatttgaataaaagacatgattttaacctttctttaaaagtatcccttgacagaatctatcactaaaagtatgacttttgatccaccttccataaacaggctttcttaaaatttccattaagtcataagtcatcccattcaaattactcaaaataaaatactgcagcatcaatattttgaatccaaatatgaatgaatccaaagcaccatcattatatgatataagtttactatttatatatccctagaagcaaaaaggctgccaattaaactaagacataatgcttttttatcaattagatttcattttttggatatctgtatcatatattccactgttctgccccatgcctctcatgtagatagatgagtatatattacttatccttctaagcctaaatcataggatttgggaatcatcagaatacctgaagtgcatataactcaattaaactttgacattatgaccacattcacacatgcacagataacaactccatcaaaaccaccacctacccaacatggattttgagtccatcaattcaaagaagcatcccagtttcaggtatgttcaaatatgaaaaaatagacatcttagaatgcataaaacaccacaaatataagtgcaaaaacatatagcaggattataaatggcaaatagcttacaatcagaaaacctgtcactagagggtcatcatttccttaaatagtaacactagaataatccacacagactgctagaaatttatgaatcttaaaactgatagtcaaaatctcaatgaagccaaataactctttagggcaagaaaaggtgagatccttgactgaactaaggttattcaatctcttgtttactaaaacagtggtaggggtggtttggtctctagcagaagggcaaacaagatggtatcacataatggagctggcttaaagcaaaataataaaaatgaaaaaacactcattcctctacttctaagaaaattatattcttcctttttgatgtactgctgacattcctttcctctcttcaatcctagattagttaacagcttgtaaaactgctgttattataatgacaatctcaatcaactacatcataaggctttttgcctaaaggatcatctctccaagttgtaatctctttgaagactaaggagacaaaagtctctcttgaacactaaggtcttttccaaattaaaaacaaaatattctaaatatttatgaacgatatcaatcagacttcctgctaaatattacttcttagtttttagccttttgtaatatgttataaaagtttccattgtctttgtattgttgaaggctacaatattgcctagcacatagtaacagcaaataaatgttggtaaactagaaactgactctcacagtggccttgattctcacagttaacctagaagtaagtaccgcaacaatgtttattcccatttcatatataaagaaactgaaggttggagaatttagggttttgctctaaaatcacagttaataagtggcattgtcaaaactgaatcccaggccctttgtctccaagaccagagcaattcttacagtaacagactgaacatcccatgcctagatttccttccctctctcttctcttacctactacatgatacttgactcaggattctggtttgctgaattactgaaaccacatcaacagtgagtcaatggtaattctctacctggttacatttacattttagcacagatattgtaagataaggtgcagcagagattattggaaatacacatattgacagtcagatagctcacttctagtggaactagaatatttaattttcctgtgtctcaagtcctttatctgcaaaagcaggtgaaatgcagatgatcaataaggtcttttcctaactaaaaacctaacattctaaatatttatcaattatacaaaatcagatcacctgctacattttacttaatactggccttgaaaaaaaaaagaaaactataaaaacctgtctgttagattctgcagtgggccaaaaacagaatatataaacaaaaatttaaatatattccaaccatactacttgactaaggacactgtctgtaccaatttaaaactagaaggttttaaggataaatgagatctatacaggcacaattgtcacagcagtccttctaggtatacaagatactgaaacattttactgacctataacttactttttcatacatggcaaaactatatttttctcattacaaatgccctagctctccccacaaagttattgtgaagtctccaaatattgctaatttgtcccttaaagcaaaaatataaaacactttgtgacatatgaaaaatgttcaccatgtcctttagttgcttcaagatatagcatataaatctttgagtttctaaacagaaccatactatctagatatttttgtctaaaagatttaaagcttaaatgtgctacctttttttctctcttgcagctttcaagtcacttagcctgctccagtctccaagatatacattatttttccaataaatcaataaataaaattggtatttttgactacttcttagtataaatcttgtctttgtatcaacaaatgttcgagtgcattttcattgtatgactaaatttctattaaaaatgtaaataatttctgcttactctatcgagtctttaattaaaagtggtttttaaagagtcaaaagactttgatcaatttttatagaatgcaccagggcacggtggttcacgcctgtaatcccagcactctgggaggctgaggcaggtgggtcactggaggtcaggagtttgtgactagcctgggcaacatggtgaaaccccatctccaccaaaaaatacaatttagctgggcgtgatggcgtgcgcctgtactccccagctactcaggaggctgaggcaggagaatcacttgaacttgggaggcagaggttgcagtgagccaagatcatgccactgcactccagcttgggcatcagaacaagacaccatctcaagaaaaaaaaaaacttatggaatgctatcattctgtcaaaaataaacataatatgctttctgttttaacaaatgaataacttaccattgtaccaccctaagttaccaggaaaactaccctaaattaccaataaaattgttcctcctatctttctcctctgcctctgctctacttcccttcaaaaagttctttactccacaatttccccaaacagaaaattttcctgattctcctatccctctgttctttctgtcactctcttcaagatccttttcctcttctatcccaccagcatccccctttgattctctgcctatattctccttcatcttgattcactccttcacagctcatctgcttccacaagatcaactaacatttccatactgatgaatccccaaagaacatttttagcctttatttttaaccagtctctgattctgtatttccagtttccttcaggatatgtctccttgaatgactggatacactattagaattcaaaacttctagtttctctacatcctcctaatctccttgtatataaactcaatacttggggacatataattatcctatgtaatcctaacaatctaaaatcttcaccatttgctagtccttacacccagaatgaactatgttatctgctttatgtcaccacaggatgctaaaatgttattgaaaatagccactaaaaaatgtagcaaatgtttctaatacaaactgatgagttcacaatattctatgagtaaatataatagagttccctctattttcctactagacatctgtttctgatttttcaatattacaaagaaaactgttatcttatcattatacatattttcatatttaataatatctccttagtgtagcagtccagaagtgaaattaatggggaaaaaagataaaagaattgttaaggttcttgataaatactgacaagcttatttccaaaacaatattatcacaacgttagctccatgagtgcaggaatcttgtcccttgtgcatatgataggcactagtaatacaacaatgataaacagtaagcattcaataaattttatttaaataaactaatcaatcaaccaatcagatctatgaaagtacttacaaatgataaacaaacattcctttatatctttattatatcattatactatatttacttactccccctttaagagtaaacatgtcactgctttgagcaatgaaatacaagcaaaagtggtatgtgatacttctagtcaaaagtttcaagtgccatttatcatgtcctttccctctgtcacagcaacctaaatgacaggcaaaagtttctgttactattatatatcatcgataatttcttatagtaaaatatagcttttcccttaaaacatatcctttttactgatcagaaattcaccgggaactccctcttcagtgcagggggatcctatggtaggaggattacaagtgtgcactgtcattcctaagaaagaatatggagcaataaaggaaattgctaaagtctggaaagcattcttggctttctgctttgaaatgaagctgacttggaaaatcagagaatttgaataaagttatcttagatttcaatgaaagaaaaatgcttcatggagtagctctttgtattactgcacctctagaggccccagaagacaactaaaaaccaggcaatatgctttattttgaaattcagctgtgtgggctgagatgtcaccttagcatgagggtcaaaggagtacagggagagagggtagccagagcctcagtcacaaattgtaactcacacttaaactcatttgaaatgcaataaacaaactaaacagaataagcacacaactacttgggcactcgaattgagttttttaagaaattttaactgttattatctaaatgctattagataaggaatatttctttcacaaatacagctgaacacattgatgtttaagagttttagtgcaaattccaagaactaaaagaaaatagaggaagacaaattagaaatgagaagctaacttaatgccaacaaattaacctttcagaaagttagaaagaaagaacaaaagagtcaggctattttattattgttttgtttatacttcataagcaaaggtattcgtgggagattttttaataaatgttttccttgtctttttttttaagtggttaaagaagaaaagttaactaggagaagataggaatgacagcagttatttgcaaatttttccacaaggaaaatcctatcaaaatccttctttgatattatttgtccttataatttgttcccacaattgccaaaaaaaaagattacagtcaggttgcatgattatctaaagcccaacatgatgttctatgtttttatcacaattcaagattactgcatttttcctaccataatattaattaatggtcaatataaaaatatggactatattgaaccccaggcaaaaggaaaaaatacacccacaaaactgtaagactatgacactagtaaatcattattcagcattttagtatagttccttctcatatttttccaagccatgtttttgcttgcttatttgattctatatacatgcttaaccatcttattcatttatttatttaacagcataatctttttccatgttaccataaactcttcacaggcttcactttaggtatggtattccatcaagtgtacattccacaatttatattttgacttagtgctggatagttgctttcaatttttgtaccattacaaataattctgttaggaacttattaaacataagcctttccaatatttcaaattcttttcctaaaatacgttcctcacaactgaattactatatatcaaaaacaataatcaaaattaaaagccaatatggtatctgggatttggtacaaaataatacagattggggaagcagatgggagttccaagtgaagcacatttaatttttttcaaaataaaacattcaaacaaaaaattaaaagcaaaaaaaatcatcctgaaatacacacacacatacacgcacacgcacaggaacacacattctagcaaagatgaaagtatttttatggctcttgctacacattgccaagttgcttccctaaagagttgtaatcatttttattcccaatatatagcttaaggtttatagtgaaggcttttttaactcctcttttctttgaagtctttgtttgtacattgactttggcatgtctctgcaacctactgcaaatttttcctattgagatatgttcctgagttttcactttattctggagactggaaatcgctcttatgatgctctttgctcatcatgcaaacttgattccatgtagaataatagttggataacagtacaatgatttacctacaggaatgtttttcatattgtttacaaggcaaaaatacatttaacataatgtttagtaaaaactggaaacaactgtttctgtatcacttgcaacgtcacagcattccttcaaaatgtatttactgtcatggaaaaaaataatttgccactataatgttgagtttttaaaagtaggctataagattgtttgtatgaacaattccattttatatagatcatacacacacacgtgcacaaacacagagataaaaaaaacctggatgtgtatgtactatagtatcttcttggggagttgataagtgatttttacaaacatctttatacttatttatatatttttattttaataataaatattctaaatgtataatttttaaatcatcaaccaaagtaagactcaaagtataaccagtaattgtttgagcaacttattatgtacacatgtcaatttccagcttgcttacataaatagtctcccaattggatacatcttagtgaatttataatcattaaacaaagtaatgaataacatgatcatcacctgaataagattatttttcttctaaattttcaaaacacagctttgtgcccaatggttttccaaaactgcctcatattaacaagaaaattttggttcaaagtagagattaggaaattaatgaaccaatgaaacacagttaattacatccagaaattaatgatcaggatattaaaacttggaaaatatagaaataatggttttcctttattaaaaattttttttgaattattgtgaatacataatagttgtatttatgaggtacgggtgacaatacaagcatacaatgtgcaatcatcaaatcagggtaactgggatatccatcatctcaaacatttatcatttctttgtgtgatagagcttttcttaactagaagttcaacgataaaatgtgcttacagacctaactaaaaccctatcatgtccacctctaagaattctaatacagttcgtctatagggccctagctctgcccctgccattaagtttgtgtgaccgatggcaaggtctgcatctccaaaatcagtattttacatcagttgatttctaaggtcttcgtggctctgtggctatatatacacttaaaaagaaactgaaaacaaatctgatcaataaagaactttttcatgacatatggtatgttattctgcagggttgccataacataataccaaacacgaggtggcttacaacaacataaaggtattctcacagttccggaggccagaaatctgaaattgaggtgccaggaaggctatgtccctctgaaggcagtaaggaaggatctgttccatgcctttctcctagtttctggcagcctcaggtgttccttgacttgcacatggccatcttctgcctatatctcttcacatcatcttccgtgtgtgtgtgtgtgtgtgtgtcccaatttcccctgtttataaagataccattcatattggattaggacccatacaaatgacacctcattttaacttgattacttctgtaaagacccagatcttcaacttttctgggggggatccaactcaacccataacatgtgacatgctggttaatctctgttgccctctaaatccattccctgctcctttctgctccacatcccagaggctaacctctgtgaactgcatcatccatgcttctttaatttctagcttcaagttggcaaatgggaggcacctgttcaagatcacaagacaacagaagagagaagggagggtatttgttgccactccatacccccaccaggccacttttttggtagcaactacattcagctatccacagtcctatttccctgtccactagccccgctcccataattctagctctcaccagaatgggtaattccattcccacctctttttccttctgccatcaggctatgatgacatcccactgttgctagtccctgggcacttcactattgttcaatggttgcattctgcactaccacccatccctctataatgaagtccattcattaaactctcttcattgtccccattgaatgtaccgtctgtttctcaccaaggccctatctggtacacagggataagtcaattctttagagtatttacataatttgtttatcaaaattctaaaaagtagtttagcctcagcatggctgccacaaattgagatttgaaataattggtagtaaagacatcactttctgtcatatatacatttgctactgttttgctcctttcctccttcacacttatatcttaatctagaaggatatggcagaggtcaggagcatggattgtgaaggcagactgcttcactttgaatctagcctctaccacgtactagattacataagtccagttaatttacctctctgtacactaataaaatgggcataaaggtaataatatacaaggccaggattacaggtatagcttacacctgtaatcccaatactttgggaagccgaggtgggagaatcgtttgaagtcaggaattcaagaccagcctgagaaaaatagcaattaccttgcctctgcaaaatatttaaaaatgaaaacattagccatgcatggtagtgttgacctgcagtcacagctacttgggaagctaaggcaggaggattacttgagcccaggagctgaatattacagtgagctatgaccatgccactgcactctgcctgggcaacacggcaaaaccatgcctcataagtaaataaataagtaaagtttacaagtcacaggacagctatgtgaaatatatgccaaattacttacattaattttttaactattaaatcaattaatctatataaagtgcttagaacaatacctggcttgtagtaagtgttctatgagcattagctgctattattatgattaatttttcctctgatgtttttcccttgacctacacattaagtcactctagcctcaatcatttttacacggaccctacccaaccaatcaaatgtatgctgggaatatacaaaaaacacagccaactcttttttattttattttattttttcccgaaacggagcctagcttgtcacccaggctggagtgcagtggtgcgacctcgcctcactgcaagctccgcctcccgggttcacgccattctctcgcctcagcctcccaagtagctgggactacaggcgcccgccaccaggcccggctaattttgttcttgtatttttagtagagacaaggtttcaccgtgttagccaggatggtctcaatcatcttctgaccttgtgatccacccgccttggcctcccaaagtgctgggattacaggtgtgagccaccgcgtccggccaacacagccaactctttaaattttcctatgtaaactacccattgtccaaaagatcagtaacacctgtcactcctgccataatgggctctctgacccctatatggtgtacatcctaagtcctcaagtgttttatttgcttacgacgtatttttgataattctgctctcagtcaagattctgataaatcatcaatcccctacctgggctatttcagctatatgtcaaacactacactcccactcacttcctggggtctattccggcttttaaaagacagttttcaaacccctacttcagccaaagaaatggtccttaatagtgattttcctcccaaaatatgtgtacttagttttgtttaattgtttggggatggggaggggtagtagtgtttgagaccaggtgtcactaaaaaaaaaaaaaaaaaaaaaaaattaaaaattaaaagaagacatttatgcagccaaaagacacatgaaaaaatgctcatcatcactggccatcagagaaatgcaaatcaaaaccacaatgagataccatctcacaccagttaaaatggcaatcattaaaaagtcaggaaacaacaggtgctggagaggatgtggagaaataggaacacttttacactgttggtgggactgtaaactagttcaaccattgtggaagtcagtgtggtgatttctcagggatctagaactagaaataccatttgacccagcaatcccattactgggtatatacccaaaggattataaatcatgctgctataaagacacatgcacacgtatgtttattgcggcactattcacaatagcaaagacttggaaccaggccaaatgtccaagaatgatagactggattaagaaaatgtggcacatatacaccatggaatactatgcagccataaaaatgatgaggtcatgtcctttgtagggacatggatgaagctggaaaccatcattctcagcaaactatcgcaaggacaaaaaaaccaaacaccacttgttctcactcacagatgggaattgaacaatgagaacacatggacacaggaaggggaacatcacacactgtggcctgttgtggggtggagggagcggggagggatagcattaggagatacacctaatgttaaatgacaagttaacgttaaatgacaagttaatgggtgcagcacaccaacatggcacatgtatacatatgtaactaacctgcacattgtgcacatgtaccctaaaacttaaagtataataaaaaaaattatcaaatttagtcgctttttaggaaagggtaaggagttggggagagaacatgggaaaagaaatcctcattgatctttgcaaattataaaccatctttttaaagtaaaaataaacacacacaaaacttatttaaaaaattcccttacttggcttagcagaaatatacctcagttacgataactataatgaacaaaaagtgattactgttactgtataaaatggccctgagatgtagttatgtactatatctgtgtatttatataagtacatttatcaatacatcagaaataactagatctcaagaaaggttcaacttagaaataagagtacagtaggccatccatatctgtgggttccacatccatggattcagccaaaagcagatcaaacatatttgggaaaaaactgtctgtactaaacatgtacagacattttttccctcttattattccctaaaaaatacagtgtaacaactatttacatagcatttacattgtattaggtgtcctaagtaatctggagataatttaaagtatacaaaatgatgtccataggttatatgcaaatactacaccattcacatcagggacttgagcatctttggattttggtacaattgagaggtcctggaaccaattccccatggatatgaagggacaactgtactaagtatgagctaagagtagtagcaggaaagttcataagtaaaaaaccagattgaccaaatagcagattaaatcactgatcagcagaagacccaagtggtcaaaagcacagcccctgaggcgagaaggccctggtgtaaatcctcaccccagcacctactgggtgaccttgggcaagtcacccaatctctatgtgcctcagtttcctcactgtaaaattacagttcttacctcacagtgctattggaaagattaaatgaggtaatatatgtaaagtatttagaacaattcctgacacatagtaagctcttaaaaacttttagttctaaaatttccaattctatatacagtccagaaatatattcagttctgtaaagatggtattcattttaaagggaatattttgttgcagtttttggcttcttttctcctacttatgtgagtcacactgctcatactcacttaagcataatacaagtcattttacagaataaatgttcaaagatggctggtatgtatattgaaaacaatatgccaactcctgagttcatgtctagacttcctcgggattacagagacggtaaggttaattacccttttaactatgatcattgtttattaccttgctttagttttgagaaaaggacaaaacattctgagtatatgcaaaaatattctagttgacaatatattcattactgtttatgacctctagtattctttcaaattaagtaattaagtatttaaacaaacactcccgaagtagaagcaaaaatcactttctcagactatttagcacttcttaaaggtctccaagaagtagtacactccaattaatatttatcctcttcctcagagcatcgatgcttacactgcctaagggaaacctgttgtcagctaaggcaaatgaggttaataacaggatttggctaagaagaaaaatatgttgcactttagagaactaacatctcatctcatctcaaatacgctaggagaataaagaggccaggaaacaaccaattgtaaaaatattagtaaataggtaacaattaaagtcattctttctcatcccaactagatatactaatggccataattactttttacttacattagtattacctcaggggatctattgttttcttataaaagtcagctgagctgtacagcttaaccaagataatctgctatattagtttccaagtatagaaagcatatgtgtaaataaaacatacatccctcattgttacctggatgttattaacccttgcttcccaacaactaaaatatccacacagggatttacttacaaaaaaaaagaaatatgcttattaacctaattatgggtatcacataaatacattgtatttgcccatttattattattatagcaaggctgtaggggccatactatccatattggatggctagtttctcccagtagccatcaagaagcctaaaatttcatcatttgaaatatttttaagtcttgacttttagaggagagagaactataaaagagaatgtctagagttaaagatagaacagcagtctaggactcatatgcaatataagaagaaaatggaatcagcagaagttctaagcaggaaagtgatattatccaaatcatgttggaaataaatctgctagcaatgtggaaaatgtactagagaaaacatatcatagtcaaagaaggagagatctatgtggcacctggacttagtaaatggagaaaagaaaaatattcaatagatatttttcaggtagacccaaaaagactctgtgtctaactggatacagatgataagaaaaacctagaagttaaagatggaagtgactctaactttgacttgtgactaaatatgatggcaataatcaaaatagtaaccagaagaagaaaaaaagtttggtatgggctaggttgggtttgagaagtctgaggaatatcatcatacacatatatccaatggagagctaaaattacaggtatgatgcttcaaaaagaaatcaggtaggcaagaagttaagagcagtggacaaagggaaaagagaagagggccatttctgagggctctgttctgttccactgatctatatctctgttttggtaccagtaccatgctgttttggttactgtagccttgtagtatagtttgaagtcaggtagcgtgatgcctccagctttgttcttttgatttaggattgacttggcgatgcgggctcttttttggttccatatgaactttaaagtagttttttccaattctgtgaagaaagtcattggtagcttgatggggatggcactgaatctataaattaccttgggcagtatggccattttcatgatattgattcttcctacccatgagcatggaatgttcttccattcgtttgtatcctcttttatttcattgagcagtggtttgtagttctccttgaacaggtccttcatgtcccttgtaagttggattcctaggtattttattctctttgaagcaattgtgaatgggagttcactcatgatttggctctctgtttgtctgttattgtgtatatctacaactatctgatctttgacaaacctgacaaaaacaagcaacggggaaaggattccttatttaataaatggtgctgggaaaactggctagccatatgtacaaagctgaaactggatccctgccttacatcttatacaaaaattaattcaacatggattaaagacttaaacgtcagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtcaacaggcaacctacaaaatgggagaaaattttcgcaagctactcatctgacaaagggctaatatccagaatctacaatgaactcaaacaaatttacaagaaaaaaataaacaaccccatcaaaaagtgggtgaaggacatgaacagacacttctcaaaagaagacattaatgcagtcaaaagacacatgaaaaaatgctcatcatcactggccatcagagaaatgcaaatcaaaaccacaatgagataccatctcacaccagttaaaatggcaatcattaaaaagtcagggaacaacaggtgctggagaggatgtggagaaataggaacacttttacactgttggtgggactgtaaactagttcaacccttgtggaagtcactgtggtgattcctcagggatctagaactagaaataccatttgacccagcaatcccattactgggtatatacccaaaggactataaatcatgctgctatagacacatgcacacgtatgtttattgtggcactattcacaatagcaaagacttggaaccaacccaaatgtccaacagtgatagactagattaagaaaatgtggcacatatacaccatggaatactatgcagccataaaaaatgatgagttcatgtcctttgtagggacatggatgaaattggaaatcatcattctcagtaaactatcccaaggacaaaaaaaccaaacaccgcatgttctcactcataggtgggaattgaacaatgagaacacatggacacaggaaggggaacatcacactctggggactgttgtggggtgggggggaggggggagggatagcattaggagatatacctaatgctaaatgacgagttaatgggtgcagcacaccagcatggcacatgtatacatatgtaactaacctgcacattgtgctcatgtaccctaaaacttaaagtataataataataaaataaataaataaataaataaagagaagagggccaaaaaaggaaccagcaaagcatacaaagctaaaacagaaccaagaaaaaaggatgtaatatacaacaaagggccagaaaacttcaaggaggaagaattcatactgtccatttctgctaagagatgaagaaacatttgtatcgtggccattggatttagcaatgagaagatttgagaatttttccaaagagtttttgtagaatattagagatagaagtctgattttactaaactaaggcagtaagtgacttaaggaattgaagaggactcacagatatttcttcccagaaatatctctttccagatgtttggaaataaacatcagtactctttccagatgcttggaaataagagcaaaatgtactgatttacccgcaaatcttgacagattctagggaatgcaagtctctgtcattattgtatagaagagaggagaaaacaaaaggtaattaaagctgactctaaagtctctaaatttgattcatgggtatagatataaagattccataactttagcagcaaggtccaatacagtagccaaaagccacatgtggttactgaacacttgaaatgcaactagtccaaactgagatgtgccaaatgaaaccaacaccagatttttaagaccttatttcgaaaaatgtaaaatatctcattaatattttaatattaattacatgtggaaatattttagatctattgggttagaaaatattaaaattaaaattacacttgtttcttttctcacttgtttcaaagtgttagtagacaatttaaaatcacatatatggctcacgttatatttcttttgaacgtccctgaacattcaaaatgttatcctctagaataaatactaaactggaagaacaggattcagaaaggttccatcacagccagcctatatatatatcatattagtgtgaaagttaatgaaggggacacccaggacaacatcatgactttaagaaaataaagtcctaactaattaagtggcttactcaggtcacctagctactggaaacaaaacccagactagaacctagtccgtgggtatttcctctattattccacctcttgaaatgtcagtgaaaatttaactgttatatacgatcttattctgtaccacattcaataaaatgacttgtaaaaaaatcttaaaatcataatctccataagagtatcctttgttcaccagtcaacttgtaatttaactaatattgttaacgtatgtcaactcacgattcagttttgttgtgttttactttgggcatgtatatatatactctgaatttatttcaaccaattccacatgaattttaaagagaatatcctcctttcaagtacacatctctttaaaaaaaagttctaagaaaacatatctggaaaagttcagagaaactactctcaaccattattatctgccatttgatagtggtaacttactaaggcatcatgttgctcattaatgtaatattcatacaaaattaaaagttatattcaaaatatagctatagtatatgatgatatactgtatttcaaattctggcaagatttaaaatcctgctttgcccaataaaatcttcaaagacactcaaccattatgttgtaggtaaaccacagttccagaatcaccaataattgtaaccaaccaaaatatttagctgtaatttcttcaatatactccaacaactataaatgtatttatgcttttcattaagaaaagacacaattatttaaaaaattagtcttttcatgctaactttccatgtgaaattgaaaagtaaacatcacttgaaactttaaaacttaattttatgagacatcttaataagctaataactgttgtagtcatggtagttatttcctttgtagaaatactgctccaaaaatagtgctatgctgagtgcagtggctcatgcctgtaatcccagcactttgggaggctgaggtgggtggatcacttgaggccaggatttcaagaccagcctggccaacatggcgaaaccaagtctctactaaaagaaaaaaaagaaagaaaaaagaaaaaaaatgcaaaatagtgctgataaaaatgaatgaagattatttgattaagcaacatgcttaattttgtacgtataccctatatttattttaacaaataaaactattattgtcattccaaaatgacattattaaaaataataaaaataaagaatatcagctccacttcttgaatatttgctgttatttcaatgttatcacatagataaaaggatggtgaaaatctagctaatagagttagctatgcacagggtgactatgcttccaaagaggagctttccatggcgatctgcatgtcttcttttctttgcctggctgtttgtggcccctcttcacataactggagttagtgtattcatctattccaaagttattccatctggactcctatgtggcagcctcccccaaaatacaaaatacaaaaaaatacaaaagtacagagccagatgtcactaagacctgagctttaccacatccttaaaagttttcaagttttccttggttgtatatgtccctttttggcttactatatagcagatgctaagtgtcccactgttgactgttcttagcaaggcgtaatccagcatggagctacagagaatcactgctccttcaatactggcagactgaatgacattgttggtgtttatgtcaacctacttcatgttaagaataactgacagttgatagtcatgacattgcataaacatctgtggtagattcaatatcaatattctagagaatatttgcaataagcagcatttaacagcatttgttcagccactatggaaagaagtttggagatttcttaaagaacttaaaacagaactatcatttgacccaccaaacccattactgggcatatatcaaaaggaaaataaatcattctaccaaaaagatgcacacactcatatgttcatcacagcactatgcacaatggctaagacatggaatcaacctaggtgcccatcaacagtggactgaataaagaaagtgtggtacaaatacaccatggagtactacacagccataagaaaggatgaaaccatgtcctttgcaacaacatgaacgcagatggaggccattatcctaagaataaattaatgcaggaacagagaaccaaatattgcaagtactcacttaaaagtgggagctaaacattggtcactcatgaacataaagatggcaataatagacactggggactacttgagtggggagggaaaaagggggaaaaaggttgataaactaactattggctattatactcactacctggatgacgggatcaatcataccctaaacctcagcatcacacaatatacccaagtaacaaagtgcacatgtgccccagaatctaaaataaaagttgaaattactttttttaaagtccacaatatgataaagtgtgctaaggaatcatacctccttgaaaataactaaaaacatcacttctcccatttataaagcaaaagtgaatattcaaagataactgcaggaggttaagttcattagccaatattcccctagcacctaaggcagttttccgcttttttttttcagtatgctcttattactgcctaattatccatattgcttttcttcctttttgttaaactgaaattcacccaagcagtttaacctttcatttagaatcattaaatacactcccctcccctcactgataattggcctctttctttattaactgatttccccccttgatttattacaaaccttttttgccaaatttggatccattctgttaatacattctttaccttcttgcaactcaattaacacagtgtcattgttaccaaagctttcctattatttcttcaagttcttattgctctttaaagatcatctagtagaataatgaatttttaataaacccggaatattttaatgattcttacttaattctatggtaaaatttatgtgagacatactattcttcacactgaaatgtttcctactgtactgtcataatactatacggtaactttctagcaatccaaatacacaaatccttgcaatataacttatgacttctaaaagtacagaaagccatattataattatcatatccatagctaaatcaaaccaagccagcttcttcaacagcagttccaacatccatacaatttttaataaagtgaaacttatacttgtgccatcagtaagtattaatgtaacctctgagtatgagtaaacctgtcactagattatgcaaaggaataacctttcatgggcccttgaggtttctccttaatggaaataaacaatttttttaaaaggcattcctgttctcttcttggaaagaaatactttcctgagctccaaggcactgataaaatttggtgggtgtcgttttaaggcctttccctttcttatcagctaccgacacatttcccagccttgccacctctactcaccaaaacagtgccttttttttttctaaaaggaaaagaaaaatgaaaggtatctactgaccttggatcaaataaggttatgtttaagtttagtttagagatttcttccacttttccaagacctaaaatatgaagcagaatatagactatggtatctttatttagcaagaaccagcggacactgtgtttaccagtgggaaacacatcttaagttgacaagagatatggagataaccagaacaaaattaaccattagaatattaaaaactctactcccagaataaattacaaggaacaaagaaacaaagatttctaccactatcttattttgagtaattttaaataaataggaaaggattttgatctcatccttctgtaaaacgtctacctgccaacatttatgtttgcaattttcaataattgcaactacagacataatctttataagtatatattcatttgatgtctttcaccaataaagacctggtgttccaagtctcctatctgttccagaatttctatttcatgtgccaatatagctcttctttaaaaaatttcaagtcagttttgactccaactttaaaactatgcaacatagttttctgatatcctgagggattaattcttatgttgaacttcctaacaattccattttgatccctaaagctattttcatgcattttttaaatgaaagagaccttaaagatcaactagtctgtacctcttattctgcagatgatgcaattgatccaaggaacagttaaagtaacctgtgcagggtcactcagccaattaaaaatgatgcaactcaaagtagaaacaagatgtcccaaagcctagacccatagtcttgcactgaagaactggcaaatagaggctttcagatttgtttcacagaaaagaaaataatactttttaaattagtcaattatgtaaataaaatcggtgttttcaaacacttaataatcttttgtaaaagtacatttccttgtacatagtaaacgtggttttagaactgtttgtattttttattgcttaagatgattttctattggcactgtaacaaattacagcaaatttggcggtttaaaataacatttgtttattatctaacagctctcaaagacagaagcctagtaggtttggctagatcctcttcttaagatctttcaaggccaaaatcaaggtgtcagtgggactaggtccttctatagaaatcccaggataatctatttccaggctcattaagttgttggcaaaattctgtgtagttgtaagaccgaggtacttgtttccttgctgatctttgattgaaggttattcttaccttctagaggcagcctgctttcctctgcccatggcccctgaatcttcaaaggctgtaacaatgtgttgcatccttcttgtcctttggatctctcacttcatatgctgcacttccctaactactacttctgcctctgtttctaagggctcatgtgattgcactggacctacatggataatccaggataacctttattttaaggtcaactgattagtagccttatttacatctgtccctttggcaatgtaaagtaacttattcatggatatatcatcttattatattcactatccagggaattagagcatggaatctgcttggaaaccaaagttctaattattacatttagctcatatttattgatgcatccttaaggaaatgtgactggttttctacagatcacgttgttcaaactctaacaaaataaataactttgcattcctaatatttatatatccatttccaggaatggctctgattggccctgcttaggtccagtgcccacccctctaccaaccaccagggctggcttcatggcaatgtgaccagtgcagtcacacataatcctgggctcagaagggaccccacatttggggcttaatgctctgaagctaccaacttgaaattcttaaccctttgaatttgttttgtacatgaagtccaatagaacaattgagcatgtgccaggggcttgtttgtctgaaaaagaatgcatttctctttcattttttaagaatatttccaacaggtacaacattctagattgacattttttttccttttaccactttatagagatgtcattcagttatctcctgtcttctatcagttgaaaagtaggctatatttttgcttctttgaaggaaatgtcttttttcctttgaagacttttatcggccggacacagtggctcatgcctgtaatctcagcactatgggaggccgaggcaggcagatcacctgaggtcaggagttcaagaccagcctgaccaacacagagaaaccccatctctactaaaaataaaaaattaaccaagtgtggtggtgcatgcctataatcccagctactcaggaggctgaggcaggagaatcgcttgaacactggaggtggaggttgtggtgagccaagatcatgctattgcactccagcctgggcaacaagagtgaatttctgcctcaaaaaaaaaaatagacttttatcttctttggttttcagtggtttgactgccatgtgccctaaatgtgctttcattgtatttattccaatagtgctttttcattctgtggattgatgtctttcattgattttagaaaactcttggcctgaatctattaagataatgcttcttcctcaattcctactctcctattctcctgggactccaattagatggtagtcagccttttccactattatattatttacactattgattgtgtgttccattcttttattcctcccatgcactattctatatattttctaattgacccatcatccagttcactaattctttcctcagctgtctaattttctaataaactaatctattgagttcttcatttcagtcacagtttttatttctagaatttctttaaattatttttatggattcttattctgtgctgaaattatccaccttttcatcactttaaaaaaatattgatcataatttttttctgtttttggagagagggtcttactctgtcacccaggctggaatgcagtggttagaccatagctcactgcagccatgatctcccaggctcacattatccttcctcccatctcagcctctgtagtagctagactacaggcatgcaacaccatgcccagcttttgtttgtttgtttgtttgtttgtttgtttgtttttggttaagtagagaccagggaagtcttgctatgtcacccaggctggtctcaaactcctgagctcaagtgatcctcccacctcggcctcccaaagtgctaggattacagacatgactcaccacacctggccaattacagttatttaatagtccatgtctaatcattccaatatctagattactgtgagactgtttctatcctttcttgttttatattgtttttcttggtcctggcttctaatatgcatggtataattttttattaaatgccaagtgttgcgtataaaaaaattatagaaactctgcatgatgtctcttgcttccagcaatgacagacagttgaagtaaaggcagaccaccttaaaatcaagattgggtttatcaaagaatacattttgatttttgtaagtagtggcctatttatagttcttcctaactcctaggatatagccccacaagaattccaatgaaaagcttagagtgttttaccagggtccttcttcctccttcctgaattttagcttgcaggcactgtgaaactgccaaaagttctgctcatcctgtcaccatcttagctattgctgcttggtttctcagcttggcctgtgttgcttgcaaattgacagaacccaaggtgaaaaatgacaccaaatacagggctcacttcagtgtgtttcctttcattcttagatctttagctcttggtagtgctccaatgcctttagatatatatatttttctaatccagtttttttcattattcacagtgtaggccttagtttgaaataaactagtccatttacagccagaaatagaaatcagccactgactgatctgtggcctatctttatgtatgcctctatatcttattaattccaaaagtatttaagataagttgacacccttatatgacggttgatttgccttgtgttctatttcctgcttgaaacctaaactgttcactactctaatatcctaattaattttgttgtaattattatgtaaacttacattcaaaatgcttctcctcgatagctaaatctgactccttacatataatatttaacgtgtatttgggaggtcctttgcaaatgccgtcttgtacttactcatttttttaaatataagaaacagcattctcagagactagattatttcagagtaaaaatgaaaacatttataaacataagcactagtatttaatagaatgttgcctgtataattttgttctttgaaaacttatagttacctctcaaaggatataaaatttataaaacaggatgagcagaagctatgtataactcctatggttacattaacacaaaatctcggtaattcaaaattgaaatttattaaacatttctaagatgtaatttgtctctgaactaagaaaatgtcttattacataattaagtgtataagcattgtgaaggcagtttatcctactttaaaaaataaattgctgttaaggactgtcttaaggataccaacttttttttttttttttgagatggagtctcactttgttgcccaggctggagtgcagtggcgcaatctcggctcactgcaagctccgcctcccaggttcacgccattctcctgcctcagcctcccgagtagctgggactacaggcgcccaccaccacgcccagctaattttttgtatttttagtagagatggggtttcaccgtagccaggatggtctccatctcctgacctcgtgatccacctgcctcagcctcccaaagtgctgagattacaggcgtgagccactgttcccggccaaggatatcaactttttgtatggctatgaacagcatttaaaaatcagtttaatctatatcaaataataagaataataatacctatactatctcattttatttattttaaaaatgtcacttgtacatatacttagtaatgactgcaaattactatggataattgaaagtaccaaaaataaactgcaacacaggatttccctccccagcattttactgtcaaaaaaaaaaaaaaaaaaaaaaaaactggaaacctaggtacttcatcctccctaaagaatctttcataaaagtcatggtctttctacatttggttcctaaatgtactacattaactacaaactcagaaaaatgtttggccatagattttaaaaattgggaatgagtacagatagaacagataagtatacacaattatattttcccagctcaattgataactggcttttaatacaattatgggtcattattcagtattattattactgtggccaaaacatgaaattccatttttagcaggttccaattaatttccttggttggtcaaggaacctttcaagatttacaagcactcaagacacaaagcatctttcgtttttcttttttcaaatgctctattctatttcatctatttcccttgctcaaatctttatgactctttgttcatacttatcgatagagaagcagccaccacactggccatctatcagaaagtggtaatgagtttagcatgacaaaaaccagctgttgaaactgctgtattatgcacactgtatgttcataatacagtaatattgctattaatgaagagactgctatgtatttcaggaaccactgtatcagaaattcaactacagaaatgggagtaaaataagagatgtagacataccagggccagaatgacttctttggtgagaatcaatgttattcaaccatagcatcgtaccacattatatggagacattataggatgatggttaagacacagctttgatgtgaggcacttcaagcctttgctctgccacttattaatatttactatgtccttaagcaggttatttagcctctctatgctttagtgttctcatctataaaaccggggataacaatacctactttactggtttttcttaataagaatcaaataaaagtgaagttagaactcctaacccagtggctaacaaaaaaataagcagtcaataaacactttaaaaatattatgttttttttttttctctccatagattatgtgtctttttctctctgcctttggacctgatcactccgacactcttaccaacaccaggtgtttattacctatctttagaagtctacctttgcttcataggaactaccttagtgttttccatctcagactttgggattttatcttagttcacttcagacatactccagggatacagcagtgtacaatgggaaaagatttagacgtagtgttatcaaatagaaataaaatgtatgtcacatgtgtaattttacattttctactaggcatatttaaaaaggaagaatcagccagatgcactgcttatgcctgtagtcccagccactcaggaggctgaggcaggaggatcacttaggcccaggagttcatgcccagcatgggcagcatagcaagacccaatctcataaactaaaactggaagaaaaagaggaaaaagaaacaggtagcattttagtaatatatttatttgcatgaatatatccaaattattatgattttaacaagcagcaatcaccacatttcaagtgttcagtaactataggtgcttgctatattagacagtacaggcttagagtcaaatgaatgtggattcaaattctggccttgctttttacttgccatgcacttgctgtaaatctgtttcattatgttaaaaattactatctccagatattgtgagaattaaataaaaacagcatactcaaagcacttagcacaatgcttacttacaggcatgctcattcaatgagaattccctcacaccaaccttctactatagaactgaacactggctcaatacagtgaaatctgtgatccagattaagaggaaaggaagagaaaggaagccccccatcgtccttcctttctagctctctataaactgtggccatttctcccactcacacagctctccttctttgcttcctagcagctataaatttgactcggtagacttatttctagaatccctgaacccttgtagtcatgacccaagtatgtggttccaagaaactaaaaaaaaacccatgcctgaaagagaaatcctaccatctctttcttctctgcccctgtggtatccacctccccagctggccctactgcctagtcagacagagtttctcctttattcaggggttctcactgctgcagcttcctcagcctcagcaactgccattaacgttagtgcttctctattgaaagagagtctggcatcaaacattaaagaggctgagcagcattctgcaaaataactggacagtacccttcaaaagtgtcaatggcataaaagacaaagatcaaggaactggcatatactgaaggtgactaaagagacataaaaaataaaaaatgaaaatatgggatcttgagtaggatcttggcccaaaaaaaggacattagtgggaaaacaggtgaaatctgaataaggtctagacctattcgtctaataagattagatctaataatattctactgatgtcaatttcctggtttcaatacttgaactatggttctatataatgttaatattaggggatttgtgggaactctctacactatttttgcaacttttcttcaaaacaaataaaagtaaaattaagttaaaacacttttaaatgtgattatttaggactttattatgaaagaacctctgtcccgatggacttgttaagtgatatattattgtgaaatagtgcaacttatgttaagccaggaaggccatcacacaggttaacgaaaagtcaattccaaggtatagaaaattcaccttactcaccactatgagtttgtaaatcactaagagagtatgatgccacctacatatactatagtgaggacttgatgacagcaaatcatattttgtgcaaccaataatgttattaaataaatgtagctactgaataacatacttaaacaataactccactgtgaccaactttttacagaaagaaagagacagtgaaaaataagaaagatatgcaaaaaaataatatgcacccacctccctctgccagatctcccatgctttaggaaacaacactggtcaaccaactctgaacaaaaccccttgcaatagaaaggacagtctgctttgctatatatgtgtttctgtaacatgaattaacatagacaattggtaagtggagaaaagatttcagtgtaatgcagaagttacattggttcctatgtaatttttttcccagatgattaatgttttgccttattagtacaggcaactgaaggctacgtatactaatggcagcaaaccaggaaggaatcagtattatacattcagcctttctctgagaagtgctactgcaaagttaaccctgatctttgtttataaataactaaataaataaaacaaagtaacacaaaacaatgaggagagcatacaactctggtatcagtacattttgtacaaagcttacaagcttttctctatttatgacttgtaatgataatgtctttctgcccttgcatccacagacagcctcaacccttccttataccacctaccaccaagctatcttcaccttttatgttttaagtaaaacactacttttactgcagtttaattattagaaacttcatgtcttttaaactgtgttagtatttttattgacattgttattgttttcatcagtgctctggttataaagttgaataagccctactgatttaagtaagaatttggaaactgcaaattttccagaaaagcacacataatattatagtagaaatggtgtattaccacacattctgaatacattgtctcaagatttttttaatataaaaaggttatactggtttgttttcaaagattacttatttatcaatgaagtatactgttaatatcaatttctaaacaaaattacgaagtgtattttatcatcagctttaaatcgaacattttaatatacacttctgtatgtgtcacacatttcttaaataaataggatgttccaatgtagtaacaaaaattatcatctatgttaaaaacaaactgatgcattgtataagaaaagcaaatattcaatatttgatataaattaaatgtatattatgaactgcaatcaaaccaacatcaatcttctaaaatgaagcagtttctaaattgtatgaaaatacatggatatggtctagaaagcatgtttcatcataagactaaaaagatactttttattaggcagggtctcactgtcacccaggctggagtgcagtggcacaatcacagattactgcagtctcgacctcccaggctcaatcgatcttcctacctcagcctcccaggtagctaagaactacaggcacgcatcaccaaacccggctaatttttgtattttttgtagagacagggtttcaccgtgttgcccaggctggtctcaaactcctgggcttaagggatccacacaccttgccctcccaaagtgccaggattacaggcctgagccacctggccctgacctaaaaaaatactttaaataatgctaaagaagaatttagcatcagattttttgtttctttctcaaagcaacaatattgcttcacgatcatctgttgttaaatatataatactagtaactaagcactcttttatgtaaatggctcctcctaagaacaagcacatgaaagtttgtgttatttgtacatgacaaagatatagcacataactgagtcattaaaaacacagttcaggccgggcgcagtggctcacgcctgtaatcccagcactttgggaggccgaggtggatagattatgaggtcaggagatcaagaccatcgtggctaacacggtgaaacccgtctctactaaaaatacaaaaaattagctgggcgtggtggtgggcccctgtagtcccaactactcaggaggctgaagcaggagaatggcctgaacccaggaggcggggcttgcagtgagccgagatcccgccactgcactccagcctgcgcaacagagcgagactctgtttcaaaaaaaaaaaaaaaaaaaaaaaaaaaacacagttcaactggaatagctataatttatatatcaatcccaatttgaatagaatatttttgaagttaatgtatataataaatatcaatcactatgaatatttatataaaatagtagtgtgctctttttaatatactccatgatatggtaggatacttttatggacccatgcaaccctgaatatcaagcagccctgttttatttttcaattatctatttaagtccacttggttagagatagtcagcatgtttctcacgggaaaaaaaaaatactgcacaattgtctgcgtatagtgtgacctctttcacttgggtgggtatcctttccatcaccaactaagtgaggatataaccttgtcaaaccaaaggcaaaagaataataagcatatgacaggctaacccagcatggaaaaggttgtttaggaggttgcaaaaatagtactcggaatgacaaaataaaagtacacttcaaagagcaggttaatatttttaaaagcactcaaaacctgagaagcatttaatccccctccttggatgtctgccatacaaaactccacttgaatttatttcattagtcactaacgagatttggttaatatgttttcaaatgaatactggtagaatagtctgaaagaaacacatttatagaatatctatttccacaaagcactagccaaaggtaagtacaaataagcagatgatgtcttgcttttaccaattataaattaccatccaacaagaaaaaaatccttccaattcaagaatcagaaatacaaatgggaaaagtatttacccagtagcaggtttttactgtctccaaatcaaatggcagtaacactgctaccttaattgctacccctaactggcataacagggaatcatactacaacatttttataagtatttgaaaccagaagaaattagacaagtttggctacagtcttcctagtgtaaatttacttttaaagcaaacaaacaaaaatctccaaaccatttaggcctgtcctaggactatgtattatatcattgtgtcagttatacacactttgacattccttttctacattaagactggaatgaaatttttgatcctgaccagtcatcatattataacagtgaaacagtgccaccttttggacccaaacagaagcatccagtgctagtctttcaaacttcctttttcagttaaactcctgatgtacataaatgtcaatgattttcatgtcataattatcaccttctaggaatactttttaatctatacaaaccaagaaaacattggggtaacaaaaaagttgcttaccaagatgcaaaatttcaaaatattccaaagtagtaccaaatgcatgtatttttaataatttctaatcaacatttcattaaatacatttcaccaaatccaaatatgttagtcaactaacatattttaaatgcaaaaaattctttttatagcattgttacactgcaaaattgattttttaaaaatgcattgtatttaacatgtattcaatttaataattggcaatatgatattaacagtggattaccagttaaatcagcataagtataaataattttatatacaaatatagtatgcttctgagttacttacaccaatgatacaatgtcaccacggtgtacttcaaaattcctcactttccagtggttcaaaagcaccacatcagatgactggctccccccaggattcaaagaaggctagaaaataaggagaaagagacacttctatcatttgtatttttcaatcttcatggttcttgcacttcacagctcgagtggactgaaataaaacatttctaatacagtacctttctataaattgctgttctaaagtaactgcaaatgatgagttttcaaaaaggctcactgggattcttcacagatgaaccagaaaaaaataaattaccaatgcttatttgaaaggaacgtgtgctagacattaaaatctttagtaaactccaataaagaggtatgaaaagccttaagaataatataaaaacatgaggaagaagtgagtcaaacctcctaacaaaatatccagataggatctaattccacagtagtacacatcattgttccatctggggaaaagaagaaataatcccaaatcacagtcatgtccacaaatcttcacagtcatatgaaaaactgaagggggcaaaagaaagatgtgataggattaccattataaaatgtatggatttcccactttgacctctcttttctcaaaagagcacatatcctaagggtcctggtcccagtttgagcctaataaggggctttcatcctaggattcagagaagtctaactgtgcctgagggttaatggatcaagaactgagaaacattttgtgtaagaatttttctaaaggtcaggaaccatacaggcacaaaaatttgactggggaactatgaaaccagcatacctgtcatttggacaggggtacagacaaagccaatgaataacaagcttgaggcaagaacagggggacaaaataattagaaaagctaagatagccttttcactgttttttaaattttttttcattttttatttcaataggttttgtaagaaaagacagtgttcggttacatgagttaagttcttcagcagtgatttctgagattctggtgcacccatcacccgagcaacgtacactgtacccagtgtgtaggcttttatccctcaccaccacccacattttcccccaagtccccaaagtccaatgtgtcattcttatgcctttgtgccctcatagcttagctcccacatatcagtgagaacatacaatgtctggttttccattcatgacttacttcacttagattaatagtctccaattcctttcagattgctgtgaataacattatttcgttcctttttatggctgagtaatatatatacacaccacattttctttatccactcgttgactgatgggcatttgggctggttccatatttttgcaactgtaaattgtgctgctataaacgtgcgtgcaagtacacatctttttcatataatgagttattttttcatataatgagtttattttcctctgggtagatacctagtattgctagggactgctggatcaaacggttgatcgactttagttatttaaggaacctcgatgctgtttttcatagtggttgtactagtttacattgccaccagcagcgtaaaagtgtttccttttcaccacatacacatcaacatctattattctttgattttttgattatggccactcttgcaggagtgaggtagtattgcattgtggttttgatttgcacttccctgataattaaagatgttgaagattttttcatatgcttattggccatttgtgtatcttctcttgagaattgtctattcatgtcctcaatccactttttttttttttttttttttttttgagatggagtctcacaccgtcgcccaggctggagtgcagtggcatcatctccgctcactgcaatctccgcctcccgggttcatgccattctcctgcctcagcctcccgagtagctgggactagaggcgcctgccatcacgcccagctaattttttttatttttagtagagacggggtttcaccatgttagccaggatggtctcaatctcctgaccttgtgatctgcccgcctcggcctcccaaagtgctgggattacaggcgtgagccaccgcgcctggcctcagcccactttttgctgcggttgtcctttcttgctgatttgagttctgactctccaataatgctaccatgggaagtggccatttctgtggtgacaggaaaggtgccaagcttcctctccgccttcactgaggggctgatgacagcagccagtggagacacaacaacaaccagggcagaagcaaggaaaatagtgaacgcagggcaacagccagtccctggagcagtaatgacgtgccttttgttaaagattcctgggattatttgcagattttctacaaagcaagagttgacaaatatgtcaaaattctgcatggaggctattatcttgacactatttttgatccagggttttgcagctgaaaaatactggttatccttgaacacctcaaacactttcagaactttcaccaactcctttagtgataatacctaaatccctaacttaaattccctgctactcatttcacttaactacctgacaaaaaattcaacaggattaaaatggaatttgttatcatttcaacaaataaatttttttttgagacagtctcttctgcttttctgcctcagcctcctgagtagagctgcgactacaggtgtgcgccactatgcccagctaatttttgtatttttagtagagacggggtttcaccatattggccaggctggtctcgaactcctgatctcgtgatccgcccgcctcagcctcccaaagtgctgtcattacacacgtgagccaccacgcctgccctcttttttttttttttttttttaagagggtctcgctctgtcacttaggctggagtgcaccggcatgatcatagttcactgtagccttgaactcctgggctcagtctcccagttccagttcccaggtagctaggactacaggtctacaagtgcataccaccacatccagctaagtcgggttttttttttcctttttttttttttagagatgggagggtcttgctatgttgagcaggatggtcttgaactcctgacctcaagcaatcctcctgccttatcaaccaaagcgctgagattacaggtaggagccaccatgcccagccctttcttattttcttacatccgggttacccttttcccagtcaaccagtttaaaaacttagttgtcttcttacttctcatccaaccagtcagcaagctaaagggatctttttttaatcataatgtcttctacttctggcacgttttctttcctctctagtatcatcatatttcaagcaccaatcattatgtaactcatgctatatctacactaatcagtctctcacctccaacttagaaatgattccatttctttctagttatatgatcttcagcaagttacttaacttcattatgccactcattactaggaaaatggtgatgaataataactattatctaattaataattaaataataatagccaatacctacgaagtacttaccatgtgtcctggtctaataataatagccagacatgttaagtgcttaccatgtgcaagacactgtttaacagctttacaaatatagttgacccttgaataacacaggtttgaactgcgtgggtccaacaatacacagatttttttcaataaaagttacactgagtgtgcctgcctctcctgcttccctttcccacctcttctacatctgccacccctgagacagtaagactaactcctcttctttctcctcctcctccttagcctactcaatatgaagacagtgaggatgaagtcctttacgatgatcctcttccacttaagaaacaaaaatatatttttctctttcttatgatgttcttaataacattttcttttccctatcttactttattgtaaaaatatagtatataatacatatagcatataaaaatatgtgttaatctcactgtttatgttaacagtaaggcttctggtcaggagcagactattagtagttaagttgtggggtgtgggacagtcaaaagttatatgcaaatttttaactgcatgggagttgggtccctcaccccctcgttgttcaagagtgaactgcgctaccttatttggtaagatcattcatttaaagtgcttatggtagttcttggcccatacttacctctcagtaacttctattattgatatttctacatcacaattttaattttaagcaggtctgtactctctacccccaggttcctcctatgtctctatctctagtgaggaacagagttgatatggtagcataagtccaaagggctttactgagccatggtgctgaggaatggagcttttgtcatcacaacagtaggtcagattattaaaaggtgagctttcacaagggtatgctctctatctcattcatatttctcattcaaattctctatctccctcttcctctctgtctttgacctcagtatccacaggtcctcttccctaatttatttgtattctttttcctatataactgacactgtaaaggtgacctggagggagaccatctgggctctggaccataaagagaaaatattcctattgaactttcactgcattcgttttttttttcttttttcttgccataatagtgaaggaacaaaaggtgatttaattatttctgactgttctccttggtctcttttactggtgttttttttgaagtttgtgaccacaactcataagatcaaaaatcccaagttcaccatcacagcctatgattatttctataataatatttaaatatgcattataatcactcccttgtctctctttccaagagtctataagctctttttttttctaagttttgagaataaattatttcctatgcctatatttttgagatcgagcactttgcaggtaattaacacattttagtggaaagaatttaaaaaaatcaattagtggaatttccaaagattttcaaaattaacaaggtcaaaacaaagatcctattccagcccactccagcccccaaatatacttcccctccttatttaacagtagtaccacttaccctatcccccatactagaagactcataagtcaggtccagtttctaacccgctctttggatgcctcattatcagacttcccctctgtcaagaatgttttttccccacttggaaacttctagtcatttgtcaaagtccttatctgatggggactcctctgtaaagcctttaaaaagaataaaaaacatgctgcagttcccttaaggaaattggaaaattatatcttggtgttccaacaatggggatagaaaaatccccactgacccaaattttaacttcgtctttcccttatagaatcactcaaatgcccaacttttctaattgtaattgttagaaccaaaaggtaaagcattataaacaaaagatttatgcaagggaagaaaacagaaggaagcatgtctaacttccaatagtgaagtaagtattagaatcaacagtcaacacctgaatgacattgcttgattttataaaggaagcaacagagttttcttttaccttttctttcctccacaagtttaaattagctactccctcatgtgcgctcccatagcaatgcaggtacttaataggtatctgcctacagataagactcttccactcaggtgtaagtttctcaactgctgaaaccgtgtcttagccatttttgtacacctaatcccagaacagtgattggaaaataatatttctataaagtctaaaagattaaaggtttttaaaagcgtatttaaatcagatagtttctagaatatacattatctaaataatgtatacatctctttcaatgaaaacatattctagataagtatagcaataaattttttgtgtctcatcaagttaggcaatttaagagttagaaatagttgaatagggctttgttattcataatgaaataatggtaatcacaacacaataaactatcttgtttatttattaatctaacacttatgaatatcaacaaaacatcataaagaaaaaccttcttgaattgggaagttgttcctatggcactataagaaccacagttttctgtacttcactaaaaacaaaagctttattaaaaagaaaaaaaacaggccgggcgcagtggctcacgcctgtaatcccagcactttgggaggccaaggtgggtggatcacgaggtcaggagatcgagaccatcctggctaacacggtgaaaccccgtctctaccaaaaatgcaaaaaaaaattagccgggcgtgggggcgggcgcctgtagtcccagctactcgggaggctgagacaggagaacggcgtgaacccgggaggcggagcttgcagtgagcggagatcgcgccactgcactccagcctgggcgacagagcaagactccgtctcaaaaaaaaagaaaaaaacagtggccggtcacggtggttcacgcctgtaatcccagcactttgggaggccgaggcaggcagatcatgaggtcaggagatcgagatcatcctggctcaacacggtgaaaccccgtctctgccaaaaaattagccgggtgtagtggtgggccgctgtagtcccagctactcgggaggctgaggcaggagaatggcgtgaacccaggaggcggggcttgcagtgagccgagaccacgccactgcactccagcctggggcgacagagcaagactccgtctctaaaaaaaatatagagcaagcaattttttcaaatcgatgaagttaaacacatcaagtagaaattaaaagtcataaataataatttgatatggccacagaatctgtattttcttgttatattgttaatatttaaatcctagattccaagagactacatcaaaatataactaacttaaaataataaagtgtttgaagaaatctcagagaatatttaatctaggagtttccacctgtatctccaagtatttgattgtatcagatattcctgctagtagtcacagtgatttccagtagcaaaaggaaaaacactaacaaagaacaaaaaaagccaaacatctgctctggactgagtaagaaagacccaccctcacccaaggtgggcagacaccatacaattagttgagagcttggaaacaacaacaaggaagaggaaaggtaaatattctctgtctgtctctctcaacaacttgcattctcacactcatctatttctctgcttctaccatggaccactaaagttaaaaatcaaacttggagaagtgttttgaatagtccttgccctaaacacagaaaactatgttcaaatcttgtctccatttcttattaaccatattactttaaacagattatttaacctgtctcatttcctcatctataaaatggggactgactgcaggaacactgatctcatggagttgctacaagaattaaatgagacagtctacaaaacattacagtcatgaaacagagtagcagtcaacaaataggacactaatgatgatggcaacaataacaaaataaagggaaacaatatcaggtacagtatcctttccacaagatttaagaaaaattaaacatttaaatattgccctgcacatttctcattttacatagtaaactgaaagtattcaggcagaaaattctacccctcatttctaaattctttgttgattgtttcctcacttttttaaagcaagtaaagttaggatgcttttatgtggggccttaattgttctgcctctataaattaatccaaaaaaatttaatatgcataattagttatgaatacctataaaatacctaaagaattttacacccgttatgttttacattcttatttttaaaacatatacacacatacagatatatataaaaacatatgcatttaaaaatctaacagttcttagctctggttgatgaaatgatttccattttctccctccctactgcttacccctccccacaccttgttttcctctggctcagttgtatctcacaaattgttttttataatgaacatatatttagtttgtatgctttgctctgacctaagtactatatagttcactctaagaaatacaatataagtcagcatatttcaacagatgttagtaagttatgctaaagctagaaatagccaatatctatcaaatctgcttttggaacaagcataacacaaaagttaggctttaatcttttctctgatcaaagactatgctgaaggatttttatttgtcctacaaacaaatattattgtcaaggtatcctaaatcctcagcttgtgtctaacctcaaatcatatgacaggtttggaagaatttatctttcggtttacgaaaataaaattctcctagagaattaagcacagtcacagtacacttcctgttttgtaagacttaactgaagccatcaatcaataaatgatattattctggctttttactataaattttttattcattttttaattttaaagaatctacagcctatgattcactgcctccaagatataaagaaagcctggttttgaccttacttctttgggtacaatgctttcaaccttttcaggcttataaaaagcaccactcacactggctacatacaatctacaacaggtaaatatcaaactttgtgcttttaagtgagatggagcccagctgcagccacaaggacccaacagtagccctcagacttcttttgaagaaccattactttgaagacatatctgtggaggcgggggcaataacagaagaaactgaaatagtactgttgatttagactttttaacactgcagcactggccaagaagcatgaagtaagtacagttaaagtaaatgtacattctgattaagaattattagatgtcacacctttgaaagaatgcggacaatatggtctacaatgccgtctttcttcccttgctattcaggggtctccataatttgcatggcttctagaattctcagatttgtctcactaggtgtgcataataaaatagactataatgtacccaggtctgtacaaagctgtaagttagaaatggaacattccttttatatcatgggtacttattacccataccccttctgatggttaattttaggtgtcaacttgactagattaaggctacccagaatgctaagaaagcattattctgggtatatctgtgagggagtgttcccaggagagattggcctttgaagcactggattgagtaagaaagatccaccctcacccaacatgggcaggcaccatgcaattagttgagggcttggatacaagaacaaggaagaggaaaggtaaatattttcatattctctctcgctctctctctcctgacgctgggacaaccttcttctctttccattgcaaatcttagaactccaggtcctctgacttttagactctgggacttgaaccagcagcccccaggtctcaggcccttggccttggactgagagttataccatcagcttctgtggttctgaggccttcagacttggactgagccaagctacctggacctccagcttgcacatagcctataatgaaacttcttagcctccatgatcacatgacccaattcccctaataaattccctctcatagatagatacatagatagatagatagatagatagatagacagacagacagataaatatcctattcgttctgtctctccggtgagatctaattataatataatttcttaatttttcttttaaaagcaagcctgtaaaactacattaataaaataaaagtgaacatataacatattgatttaattcagaattacactaggttgttaatttttcattctcctaatcttaactgcatgttctactatagaacgccccatcaaagtgtcacaggcacgctcacatactacctgtaggaatgaaaatctttataaactatcaacaaggtaatttgccaaaatatatttaaagtcttaaaagtgatcttgtccttagacttgaaaatgtcacatttaaaaagatttcctaagaaactaattggacatatgtgcaaaggaacatatacaaagatattcataatacattatttacaatagtgaatagcttcttagtcttttagctaaaatcaagtgaataactgagccaagctcaataccaataataggaaactgattaaaccttggtttagcaatggttaaactttatggatattaaaaaatgattgtaaaaattacattgtggaaaaatatatatttggatatgtctggagaataagtgaaaaatgcgacatagaaaaaacaaactgctatgatccaatttcaggaaagacaggacggaagaaaaaagggaaaaaccttaaaagaataaagtaaagaaggaaattgtgcagaaaagaaagagagtaacttataatggtttagaaatgcaaacttcaaagtcagaagctgggtttaaatctatgcaatcttcagtaagttatcccatctctctgattgtatttcttcatctgttaagtgggctaacatagtatcttcatcatacagttgtgggtgatattaaataaactaatatatataaagtcaatactgtaatgacttgaacatagtgatcattcaataatttttcactattagtattatataataatatatttaaaataaataattctgaaaggtggtatcaattatttattttccacatttttctatgttttctaagttttttgccaatcaatatgcagtgcttttatattaatgtaagcactaagcaatgaattgtttttgaaggggaaagcatctgatttttatatcctcttattactaatatttttaaagtttgtgttctttaaacaagctcttcagtatttaagcatctctttaattcaggtcgctacaactagattgcaaggttcaaatctgcaaagtttctgtttcaatgcactaattataaaatactaccattaaatacgtgcattgtgtttcctagctaataaaacatgttttgagatagctattctaatttatagttctaattaaccatatcagaaatagatcacatatagtcaatgaaatataaaatttatataaacatatctgcatattaacctgaagacagactgctatatataaaataagccagctacacggaaaaaccccagcaagatacatgcggaatctttaacttcctcataaaactgaataaggctttcctattcattgctaagtttttcttgctcagaaccacttttctgtctcctaacctaattaaaaaaaaaaaggtcatagtaaggtgtgtagcacagaaaggaagtgattcaacaaataacaaagattttaggaggctgcatgattccctcagaagcatgtaactccaaagaggccaaattccccaacatatacaatggtgtagcaatctattcacatggcttatataatatctgtgaacaaatctgtgaagataataccatggattttagatcctttagttcttcattgttgaacctgatgctgcattataaggaaaaaaataaaaaagaaccagtcagcatcctaacactacaaatgtgtatcaacaggaattttggtacctgggtaccctaaattacattgatcaaagctataagaacaaaggagctcaaatgcataggaaacagcttatcaaaaggaactgaaaagcattctggcagataaaaagggggaaaaaaggatatataccttatatcatttatctactgctacaaaacaaaccactccaaaacttaaaacaaaaatcatttattggttcatgattccacaatttaggctatgcttagctatgcaattagccagcttgtctggctgtgatcactcaggcagctgcagccatggaggcagcagtgttccaggagcaaaaactccctcgtgtaagcatctaccaagcctctgtttgcgtatttgctgatattccaccagccaaaatgagtcataaggccaagtcaagaatcagcataggtgaggatgacatagagctcagtaccgaggagcatgactcatgggggatggggtagacagggaatatcaatgtaataatctaccaaaactctgccctctagctccaatgaatcatatccctcacatatgcaaaatacatataacccttcctaagagccccaaggtctcctcagatgtttgcaataggattcatatccgttaattcatgatatgcatcaggtcccaggtcccagtatggaagaggactctagggtgcagctcatctcaaatcagagacttatgaagtgaaaagataaattatctgttccccaaacaccaaacatataatggaaagacagaaagaagataaccatggattttaaaaagcaatgaaaaaagcatagaagtcacttgtccatagaaagcttaaaatccagcagcatgtgttgtcaaggcctcccatctcatggagagaaatgtcctttaattaagattcttttctgttctctggaatggttccctaatttattggtctgcatggctcttagctctgccctctgggctttgggctcttttttaaaaaggaggcccggtggagccaagatggccaaataggaacagctctggtctacagctcccagaatgagcgacgcagaagacgggtgatttctgcatttccatctgaggtaccgggttcatctcactagggagtgccagacagcaggtgcaggacagtgggtgcagagcaccaggcacaagccaaagcagggtgaggcattgcctcactcgggaagcacaaggggtcagggagttccctttcctagtcaaagaaagaggtgacagatggcacctggaaaatcgggtcactcccaccctaatactgcgcttttccaacaggcttaaaaaaacggcataccaggagattatatcccgcacctggctcagagggtcctatgcccatggagtctcgctgattgctagcacagcagtctgagatcaaaatgcaaggcggcagcgaggctggggaaggggcgcctgccattgccgaggctcgattaggtaaacaaagcagccctgaagctcgaactacgcggagactaccacagctcaaggaggcctgcctgcctctgtaggctccacctctgggggcagggcacagacaaacaaaaagacagcagtaacctctgcagacttaaatgtccctgtctgacagctttgaagagagtagtggttctcccagcacacagctggagatctgagaaagggcagactgcctcctcaagtgggtccctgactcccaagcagcctaaatgggaggcatccgccagtacgggcagactgacacctcacatggccgggtactcctctgagacaaaacttccagaggaacaatcaggcaggagcatttgcggatcaccaacatccacttttctacagccaccgctgttctgcagccaccgctgctgatacccaggcatacagggtctggagtggacatctagcaaactccaacagacctgcagctgagggtcctgtctgttagaaggaaaactaacaaacagaaaggacatccacaccaaaaacccatctgtacgtcaccatcatcaaagaccaaaagtagataaaaccacaaagatgggggaaaaacagagcagaaaaactggaaactctaaaaagcagagtgcctctcctcctccaaaggaacgcagctcctcaccagcaacggaacaaagctggacggagaatgactttgacgagttgagagaagaaggcttcagacgatcaaactactccgagctacaggaggaaattcaaaccaatggcaaagaagttaaaaactttgaaaaaaaattagacgaatggatacctagaataaccaatgcagagaagtccttaaaggagctgatggagctgaaagccaaggctcgagaactacgtgaagaatgcagaagcctcaggagccgatgcgatcaactggaagaaagggtatcagtgatggaagacgaaatgaatgaaatgaagcgagaagggaagtttagagaaaaaagaataaaaagaaacaaacaaagcctccaagaaatatgggactatgtgaaaagaccaaatctacgtctgattggtgtacctgaaagtgacggggagaatggaaccaacttggaaaacactctgcaggatattatccaggagaacttccccagtctagcaaggcaggccaacattcaaattcaggaaatacagagaacgccacaaagatactcctcgagaagagcaactccaagacacataactgtcacattcaccaaagttgaaatgaaggaaaaaatgttaagggcagccagagagaaaggtcgggttacccacaaagggaagcccatcagacaaacagcggatctctcagcagaaactctacaagccagaagagagtgggggccaatattcaacattcttaaagaaaagaattttcaacccagaatttcatatccagccaaactaagcttcataagtgaaggagaaataaaatactttacagagatgcacatgctgagagattctgtcaccaccaggcctgccctaaaagagctcctgaaggaagcactaaacatagaaaggaacaaccggtaccagccactgcaaaacatgccaaaatgtaaagaccatcaaggctaggaagaaactgcatcaactaatgagcaaaataaccagctaacatcataatgacaggaccaaattcacacataacaatattaactttaaatgtaaatgggctaaatgctccaattaaaagacacagactggcaaattggataaagagtcatacatcagtgtgctgtattcaggaaacccatctcacgtgcagagacacacataggctcaaaataaagggatggaggaagatctaccaagcaaatggaaaacaaaaaaaggcagggattgcaatcctagtctctgacaaaacagactttaaaccaacaaagatcaaaagagacaaagaaggccattacataatggtaaagggatcaattcaacaagaagagctaactatcctaaatatatatgcacccaatacaggagcacccaggttcataaagcaagtccttagtgacctacaaagagacttagactcccacacaataataatgggagactttaacaccccgctgtcaacattagacagatcaacgagacagaaagttaacaaggatatccaggaattgaactcacctctgccccaagcatacctaatagacatctacagaactctccaccccaaatcaacagaatatacattttttttcagcaccacaccacacctattccaaaattgaccacatagttggaagtaaagcactcctcagcaaatgtaaaaaacagaaattataacaaactatctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgcagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaagatcaacaaaatcgatagactgctagcaagactaataaagaaaaaaagagagaagaatcaaatagacacaataaaaaatgataaaggggatatcacaaccgatcccacagaaatacaaactaccatcagagaatactacaaacacctctacgcaaataactagaaaatctagaagaaatggataaattcctcaacacatacaccctcccaagactaaaccaggaagaagctgaatctctgaatagaacaataagaggctctgaaattgtggcaataatcaatagcttaccaaccaaaaaaagtccaggaccagatggattcacagccgaattctaccagaggtacaaggaggagctggtaccattccttctgaaactattccaatcaatagaaaaagagggaatcctccctaactcattttaggaggccagcatcatcctgataccaaagcctggcagagacacaacaaaaaaagagaattttagaccaatatccttgatgaacattgatgcaaaaatcctcaataaaatactggcaaaccaaatccagcagcacatcaaaaagcttttccaccatgatcaagtgggcttcatccctgggatgaaaggctagttcaacatacacaaatcaataaatgtaatccagcatataaacagaaccaaagacaaaaaccacatgattatctcaatagatgcagaaaaggcctttgacaaaattcaacaacccttcatgctaaaaactctcaataaattagatattgatgggacgtatctcaaaataataagagctatctatgacaaacccacagccaatatcatactgaatggacaaaaactggaagcattccctttgaaaactggcacaagacagggatgccctctctcaccactcctattcaacatagtgttggaaattctggccagtgcaatcaggcaggagaaggaaataaagggtattcaattaggaaaagaggaagtcaaattgtccctgtttgcagatgacatgattgtatatctagaaaaccctattgtctcagcccaaaatctccttaagctgataagcaacttcagcaaagtctcaggatacaaaatcaatgcacaaaaatcacaagcattcttatacaccaataacagacaaacagagagccaaatcatgagtgaactaccattcacaattgcttcaaagagaataaaatacctaggaatccaacttacaagggatgtgaaagacctcttcaaggagaactacaaaccactgctcaatgaaataaaagaggatataaacaaatggaagggcattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcatgctacctgacttcaaactatactacaaggctacagtaaccaaaacagcatggtactggtaccaaaacagagatatagattaatggaacagaacagagccctcagaaataatgccgcatatctacaaccatctgatctttgacaaacctgacaaaaacaagcaatggggaaaggatttcctatttaataaatggtgctgggaaaactggctagccatgtgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaactgacaaatgggatctaattaaactaaagagcttctgcacagcaaaagaaactaccatcagagtcaacaggcaacctacaaaatgggaaaaaattttcgcaacctactcatctgacaaagggctaatatccagaatctacaaagaactcaaacaaatttacaagaaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattgctgggtatatacccaaaggattgtaaatcatgctgctgtaaaggcacacacacatatatattgtggcactattcacaatagcaaagacttggaaccaacccaaatgtccaacaatgatagactaggttaagaaaatgtggcacatatacaccatggaatactatgcagccataaaaaatgatgagttcatgtcctttgtagggacatggatgaaactggaaaccatcattctcagcaaactattgcaagaacaaaaaaccaaacaccacatgttctcactcataggtgggaattgaacaatgagaacacatggacacaggaaggggaacatcacacagtggggactgttgtggggtggggggagcggggagggatagcattaggagatatatgtaatgctaaatgacgagttaatgggtgcagcacaccaacatggcacatgtatacatatgtaacaaacctgcacattgtgcacatgtaccctaaaacttaaagtataataataataaaattaaaaaagaaagaaaggaggccaggctcacacctgtaaccccagcttcttgggaggcgggaggatggctccaggccaaaagtttgagaacacctgggcaacatagtgagactgcctccacacacaaaaattttaaaaattagctgtccaggacttcgaggctgattgcaccaatgcactccagcctgggcaacagagcaagaccctgtctctttaaaataataataataataataataatataaaaataaataataaatttttaaaaagaaatgctccttcataataaggtggacacaccccagaggtctctttctaaattgaccccattttagtacaagttaattcaacacccttaaaatgttgtagacttcccattaatctagttggggctcattccattccccccaaaactacatccatatcttccttcttttttctttttcttgccctgtcccccaggctgcagtgcagtggtgcaatctcagctcactgcaacctccgcctcccaggttcaagcgattctcctgcctcagcctccagagtagctgggactacaggcacatgccaccacaccaggctagtttttgtatttttagtagagacaggttttaccatgttggccaggatggtctcaatctcctaacctcgtgatccacctgccttggcctcccaaagtgctgggattacaggcgtgagccaccacgcccgacccttaatttttttcaaaccagatctttctttactttgaaagtgtcaggctgctgtggcacaaagccctgaagagtttacaatatattttgtctaattaaaaagatatactaagtaccaccttatatctttctgaggttttttttgtttttgcttttgtttttgtttgagacagagtctcacggtgtcacccaggctgaaatgcagtggcacagtcttggtttattgcaacctctgccttctgagctctggtgatcctcccacctcagcctcccaagtagctgggactacaggcgcatgccaccaagcctagctaagttttctatttttagtagagacagagtttcgccagttgcccaggttggtctcaaactcctgggctcaagttatcttcaagccttggcctccccaagtgctgggattataggcgtgagccactacacccagccctgaggtcttaataaagagtcttccagtcctgatttgatctctacccgaggctatttcttattttgaggatcttttgcctgctagatactgggaatgaaaaatagttttattttccaacccaaaaaagttctgggcaccctatatttcctctaatttctgctataagttcatttctctcttcccatatcttatataaagctatacgaagccagctgacaatttcaatattttcgcctggaaatctccttagccaaatctataagatcattaggtatatcttctatttttcaagttcttacagttcacatttttaaaaaatgtttaagtaccataaaacacagatcatcgtaattccagtccgcagtaacagatactttactatctttctgttttctattaacagttgtttgccatttgtccagcgtctgccaacactcccctcaccacattaccagccccaaactgccacccagtccccaaatcaatgctacatattttaggtttttgttatagtatcacttcactaatagtaccaatttttgtttcagttatctcttgcttcataacaaaccactccaaaactatatgtctaaaaagaacaaccaaaatgtatctgcttgtgatcctgcaattttggcttccctcagctggaaagttcaagatggcttcattgacatgtcaggcactcaactggggctggaaggccaggatgcttcatttattctccaaaatctccgtcatcaggatagcctgagtttttacatgtacccagctcacaagtactgaccaagctcctacttgagcagtatttgcttatatcctactgaccaaaacaagtcacatggtcagagtcattgtgggaggaaactacacaaatcaatgagggaggcctgattcactatggaatcattaccataaaaatctacacatatctcatactaaatgaatgggccatccattcagctgacaatcttgtgactgtgctttctgttgatcattttaaaagctacagaaataaaagatagtttatattttaaaaagaaagaaaaaaattcactgacaaaaaaataaaaattttaaagataactaaatagtcttaaaagcaaatgacaagctaaaaagtataaaacaggcattttaaaaaataaaattaaaaaagtttacgaagaaataaaaataaagttcataaaatagaaaaatgtttaattaaaacttaaaaattaaaaaaagaacataattataaaatgatatacccattggtataatattgttgtggtctttctactccttagctcaggtaggtccgagttcttgtcgcacaaccaggaagaattaggcatgcagacaccagagagtcagtaaagtagaatttaacaggcgaaaaaggaaagctttcagccaagagagggcacagagggtgggaggggtatggttcccctatctgaaggcagggaagtccccagtgtggctgggtccagggccttttatatactcagaatggggagagtgtgttgattggtttgtgagtatgcaaaaaatgttaaagcaaagacaccactcaaaggtgggcacgacagagtagaaaaccaattaggaaagggtaggtatatgtgaaataggtgaatggtggggatctatcagaggaaatcatgccaaataggcaagttctcaatccagtctgaggatgtaacttgtagcttggctttcaggctttaaactgtcttgggcttggaaggggggtttcactggggacccaccctatctgcctaggcatttggctgcttcctgccactctcaatattagaaacaataagctaaaattagcacaaatatatgataaataatttaacagacaaagagatgggaaataaaacaaattttttaaaagttataagactaagaattcaaaagtttagtaaacaaaggcaatcaggattttccaagcaaaagcaattaccatgtctagcaaatcccccaacaatttgccctcacccaagacatggagctctccttaagaaaatggttctcaaactttagtatttacagagtttgttaatgcagattccaaggtcctcacaaaacgattctaatttcataggtctgaaatggggctcattaatcttcattaataagtaccccagattatgtaataaaaaaggcccaaggaccacagcagctacaaaagggttttctcaaacaagggacagactatggggctccttatccttcgtgttgcacttattgcttgaagtgcttatgacaagcccacatttaaaatttcagaatcaaaagttaacatgctccactcccttagttatagctcaatttgagctgtctcacccttgtaagcttccctccagcaataaagcagcattttgcaaactacaggtcacaaccaatgagtgagtcagaatcatcaatttaataggttatgaccagaacagaaaatatcagagggcattgcacataatgatagtaattacaatttaagtattgttacatgaaacttttgttccagttgcatgtatgtgtgtatagtgcaaaatatattacttaatatgagtcatgagcaaaaaggtttgaaaatctctgccataaagaatatgatgaatttgtcaagaagctaaaaactttttaggagaatagttcaccagaaacaccctcaaagtctaagaaaaaaaaaattttaatgatcataatttcattttatcatatttctgtagggtttaattattcaggcatatcaatgcttcaaagaagaaatttcatatgcatttattccagcatccctctgaactagcaggtgagaggattatggtcccctttcttttagaaacttacagagtagagttattattaacccatgaaattaataattagagggcagtacaaaaggatttataatcatgagttaaacttacaatgctgtaggatttctaataagtgaatgacagaattaaagaaagttacatgaagaaaatagagcttgagtttagacttaaagggaacttcagaaaaagcagaggagaaaaggtataataatgagtcgtgttatacagtcagaataggctaaatgcttgtaaaaagaatttcaaaagctcagtggtataacacaatagtgagtggactgactccacacaatcattcagaaacccagttttttcgagcttgtacatctaccatcccctgcggcatcgtgtcctcaactggatcctctgctgtattgtattatatacatacatatacataaatatagatatagatattgatacagatatcaaaatcagtatagatatcctgtatattatgatgttttgacacgttaaaaaaaacattcctagctggggagacactgcctctgccagacctagccaattcttccagctagcaagagctcaaccagaagcatgcctttcatatacaaactaaccaatccagaaccatacctcctccagccagcataaccctggagacaatttcctctgccttcatcttcccaaggccaggtaccaggcaaccagggaccacccctacagcttagaatctgccaaaattattcaaactagccagtcctaaactgttcattctgccctgccttgccttgccttgcctgcacagaaaccccaaaaaggctttggcctagctgctattgtcatctgcttcctgaccactctggtgtctttcccatgtggccccacataccgtgctttaccttcctgtctctaggacctgtaagtctaataaactttgttttcctgagcctctcctctgtctgctctagtggccatacctaactaaccaactcataaaagaatacaaaacatctgccttcagccagcagacagaggagagagcatggaggatcacaaagatttttcatgggccaggcctaaaaatggcacttcacttcctcccattttccactggccagacctcagtaacctctgatatcaggaaagattaaaaaacaggacaagaaatcatccattcatcattagtcatccctcttacaactaaaacaccctgaacataacaccacacacaaaaatataggaggatctgcaaggtggaaagaagataaactagaggctaggaaccacaggacttgagaaatgacaccatcgctcccctggactttctttttgcttctcatatatcctagatcaggcactagggaatcctgcaacctgtagctaccaacaggccaagcaaaaaaaagggcctgaagacgtggtggccaacacctgtaatccagcactttgggaggctgaaacgggcagatcgcttgagctcaggagtttgagaccagcctgggcaacatggtgaaaccccatctctaccaaaaataccaaataaaattagccaggcatggtggtgcaagcctgtaatcccagctactcagggggctgaggcacaagaatgtcttgagcccaggaagcagaggttgcagtgagcggagatcgcgccactgcactccagcctgggcaacagagtctccctctgttgaacaaaaaaaaaaaaaaaggccttaagaaaagcctactctctctagccaaaggaccaggaaaaggaagacctagcagaacagaaacatttttgctaataaccatcctaatccagtcaaacatcaaaggaaaaactaccccaccccatcccccaacaccatggtgtcagcagggcccagcaaggagctggacttctaaccccactcagcaattaggagatggggcaagtaggcccttcacttccccgtatcaggtgtcaaagaggtggaatgagagtgcaagtggtgccagttagcagcccactttccccaccccagttagttgagcaatttctttagaagttaaacataaatgtaccatgccactcagcaaccccactattacgtatctgcccaagagaaatgaaatcatgtatatacacgtaactgtacacaaatatctatagcagcattactcacgataatgaaaacatcaaaacccaaacatttatcatctggtgagtggagaaacaaaatgtggtatattcatacagagaatactttttgcaataaacagacacaaaatgctaatacatagtacaacatggctaaacctcaaaaaaatctagtaagtaaaagagccagtcaggaaaaaccacattagtatggttctatttacaggaaaggttcagaaaaggcaaatctataaatcagatcagcagttgcctaaggaaagagatgggagtgaggattaacttcaaacaagcataaggttcctttctcaggtgatgaaaatattttaaaaccgggttatggtaatgattgcatgactccataagtttacttttaatactatttattgatattttattatataaaacataatttttaataaaaaattcaagtcatcccaaagcgttctacagattcaattgcactatctttaaaactctgatgtcatttttcgcagaaatacacaacacaatcctaaattcatatggaaccacaaaagaccctgaatagccaaacaatcttaagcaagaagaacaaagctggaggcatcacactacttaactcaaatgcaaaattatagtaatcaaaacagtatggtactagcataaaaacagacatatagaccaatgtaatagaatagagaatccagaaataaatgtacacatttatgaaaaatcaattttcaacaaagatgccaagaacatacaatgaggaaagaataggttcttcaataaatggtgcttggaaaactgaatatccacatgaagaagaataaaatcagacccttatctcacaccatatacaaaaatcaactctcaatggatttttaaagatgatgcctgaaactgtaaaactacctgaaactgtaaaactactagaagaaaacatagggagaaaagctccatgacactgatctgagcaatgatttgttagatacgaccccaaaagcacaagcaacaaagcaaaaatagacagctgagctcctatcaaactgaaaagtttctgaagagagaaggaaacaatcaacatggtaaagagacaatctatggaatggaagaaaatatttgcaaaccatatatctaataaggggttaatgtataaaatataaggtacacaaacaactctatagcaagaaaacaacttgattttaaaataggaaaaagacctgtatagagaattctcaagacatacaaatggcccagaagcatataaaaaatattcaatatcactaattatcagggaaatggaaattaaattaaatgtgcaatgagatgtcacctcatacctgttaggaaggctattatcagaaattcaagagataaatgttggtgagaatatgcagaaaagagaacccttgtgctctattggtaggaatgtaaattagttcaaccattatgaaaaatagggatatatctcaaagaattgaaaacagaactaccagatgatctaccactctcacttctggatatgtatccaaaggaaatgaaatcagtaagtcaaagaaatatcttcactcccatttcattgcagaattattcaaaacagccaagatatggaagtaacctaaatgctcataaatggatgaagggataaagaaagtgtagtcagtgtgggtgtgggtttctgtatatatatgagtgcgtgtggatattcttctgcaggtgtatatatacacacacacagtggtatatatactatgaaatattattcagcttttaaaaagaaggaaatcttgttatttgtgacagtgtggatgaacctagagaacattatgttaaatgaaataagccaggcacagaaagacaaatactgcatgatctcacttatatgggtaatcaaaaaaagctggactcacagaagcagagagtagaatagtggttgcaaagagctgagaagtagggaaaatgagaagatgttggtcacagtatacaaagtttcagttatgtaggattaataatttctggaagtctaatgtacagcaaggtgactatagctaataatactgtattatacactcgaattttactaagagagtagatcttaaatgttctcaccaccaaaaagaaggtaactatatgaagtaaagggtatgttaattagtttgtggtaatcatttcataatgtctacacatatcaaaatatcatgtatactgttctcactcacaggtgggaactgaacaatgagaacacttggacacagaatgggcaacatcgcacaccggggcctgtggtggggttgggggatgggggagggatagcattaggagatatacctaatgtaaatgacgagttaatgggtgtggcacaccaacatggcacatgtatacatatgtaacaaacctgcacattgtgcacatgtaccctaaaacttaaagtataataaaaatatatatatatcatgtatactttaaatatatgtaattgttgccagtttacctcagtaaagctggaaaacatcattacatcacttacaatgggtaaattcaatggtatataaattatacctcaataaaaatgtgttttaaaaagtagatggactggcataatgaaccaccatgtaatccatcacctagagccaacaattatggattcatagccaatcttgtttcatctgtaacccttctacttttattcttgccatattattttaaagtacatctcagctattatgcatttcactgcaaattttataatattcatactatgaggataagggttttttttaacataacagcagtaaataccattatcaccccaaaaaacaatgtatcaaagcacaagtgatataagtagtgctttgcttgaccattttagataatctcttgttgctttctgctattttcattctcctctctttctttcaactacatttagtatctgatagctccaatttctaaagcctttaaagtctagttcggctaatggttgcttctgactctcacttacagagctcattttctcatgcaatatttttactgggatataatgttcatcaaactttatctttgggattctataaggcctggttgcaagctgcatgtgcccagggaatttggtgcctgaggctgctctaaacccaggccactgtaaattaatatctcagtttagggtttttcaggtgcagtgaatgtgaattcaaacctcaattccacatcagggctttctctctcagagcctagacaatttttcttacagaacagatttttgctttagtctacccatttcctaaagatgtgtctcttctatggtcctgactttattaagaatttctgttccaatttcctgccttctatgagcctatggccttgtcttctgatccccatgtggccattgaaaccaaaagctctaaatgaccaggaattgacaaatatccatgtgacagctactgactttaatgtatacttactgccctggaaatgtattcccccttattgtggtctctgagaatttcccttgcttccctgcaagttagttacacatttttaaagtttttaatgttttgtttttaattttttaagagttttgcactgggaatatttcaagatgtttcatctgctatatttccagatagtctaatcccttcttataaactttaaaatctttagactttttataagagaaacgtatcttccatcaacctgagcggcacagtttaaaatctttttcccccattataacataaagcttaatttctatatttaagtcctaaatgtactacagaatcataccaaaattaaataacttactaagtacatcattccataaaccaaaataaaatggaataaaacatcactgtgagaaggaatagtataaacaggcaccaaaacagtgacaaggcacaacttttattagttattatttagtgaaatggacagcactgtcagagttggttcaagccagagttccaaaattcaatgattgtctgagcttacgtaaagtacctcaactgtctgagcctcagttgtttcaaatgtaaaatttagaacttgagtcatttcttaatgtatttaaagctctatactactatgaataaagtgttaaattttaaaatcagctgaagaaaagcattaatataccaatcagcaagcatcgtgactcaggaagaatgtacaagagtatcaagaattaaaggggcatgatgtatgcaacctactttcagatggtttaataagattttttgagggtatatattcatacacgcataaatacagagggagaggaagaggagggggaggaggaggaagagagagagaagagggagggaaaaaagataataaaataaatatactaaaatattgaaactggtgtatctgggtagagaagccataggagttctacgcactactcttgcaacttttgtgtaaatctaaatttacaacaagtttttaaaaagtgtaataaagttggtatttaaataacagatataaccctggctatataaaacagaaacacatagttattctatcatgggaagtgaagaaaaatccacaaagggacattacaaatttatcactcaccaactgtttcaggaacacacgtttgttgctataaatacaaagtctctattaatgacaggttacagaactatgtaaaaactcataactcatcctaaggggtaaaacatcaggtgagatttctgagccaaaagtaatttgggcagaaagcacgcaagtaagccaataaagcattccaacattaaatcctgacttcctttgacgtcagccccagcagaccaaggtgagtgacgacacagagaagtcagcacaggaggaaatgtgtgccagcttgtgcccagtatcttggaagtgcaaatttaccaggtaacataaaactccataactctatcttaaatgctggtatataaatcacaatgtatctcttttcttaagagtctgtatccagcttctcagagttcaaaataagttacaagcaataatgactgttgagtattattaagctgactgtaggttaaaattttttaaaaaaaacatagattgaaagagagcttgctttttgatgatacttttaatttcaaactcagcaggaaacaagataatcacaggtagctgaaagtcaagacaatttaaaacccataaatgtatgttattgatgaacaaagacctcaatgctaattaaactgcattttccttcatattctgtaatttcctaatatattctgcatacattatctctaaggtctgacctagagatacagtattgtgtagcagtgttttcaagtatttttgccctctggccatgcaaatgaaaaaaggaaaatggtacactatgtaaaaattatgtatcaattgcaaaaaaaaaaaaagataatgacacaaaattatttattttacttactttttaaagtcttaaatcttagttttaaatgtggaaagcatataccttttatcaggaccagtgaccccactgcaggaattctcactcaaataaaatctaaaactttggcatgaggtcattaaactattcctagggcacccttttacgctaaaagcctctgtaagcgattaaagttctaatttgaataattacattccacctacataaattccctctgtagtttcaactgtatgcaatatcagtcttcatttcctgaattaaattaatgtcgtgtaatgtggtgcttcttttttaaaaaaagaagtacatctactttcataggtaacctttcagcaaccagtaaaagtgattcatgtgcatgaggggaataggtcagtatgaataatcattaaccaacaatttgtgccagcatttattgtgtcgagcattgcaaaagggacaactcatataatgaaatgaatgcagctatacggctttataaaaatcaaatattttataaactaaatcctattttccattgaatttaccaatgcatcattagaaactttattttttatttatggcttgcctttaattagctgatacttcccatgtttgatcacccttatctttctagtcaaatacttaatgaattgcaaattaatactgaaaatcctaacttaaaaaaagaaccactgagtagtgtttaaaaagtaaataagtatttctcatagagggaatcttaaaaacatgcttcccctaatcacaaaccaacagaatttttgaaagaccgaaaaacaattcttacagcaaaatttgttactcaaagtgaatttccagtgtaaccaaaacagtatttattcaataaacccaaaagactagtattacacctccctttaatgagatttaatctttcgatccttggatatttcttaaataatgtgtctaccagttgctgagtgaccttcaagagtggcttttcccagagtaaagaaaaacagctgtgttccttgcaggatgctcagtgacttccagagatctccacaccatgccaactatttcagtccttgagtcattagagaaatttaaagagaagaatttatcccaattgtcaaaaattctgttgaaccccatgacataaacgtgtttagttgatcaaagctgtatagtagcaaagatgtcttcaaatatgttgaattagttaatccctaaatctcattattataatttctgctcttaaagaatttaaagtatgatttactggcatctagtgaaactgtaaattaaattatctattatacctagagttggtctcaaattcatgaaatatagatccaattgtaaaaacatattttcctttcttcctagaattccattctactttgattctgaaaatagcatcctctttcctctaggaaatgtcacctgtactccaatccccaattcccacagaacaatgtgattcaaagagatgctgtcattttcttacagatcacttggcctagccacaggcttggggtgtgtacttgttcaaagctggaccaatcacggtaccccattctggtggccaaagttgatctgtatagttgtatagataagggcatgtgacccaagctgaatacatcacagtccttccccaagatattccacactgaaatcaaggcagtaggagcaatctctctcaggcggtgaagaaactgggcatgcgagctgccagcagccatgtaccctgctatgcagagaaaactggtctgagagaactaagccaagatgcagagaagaacttaaaaaagacggagcactccagcggcatccaagtcctggctctagttgtccctgacaactgtctcactcgtgccttccttgtgtgtatataataagccttccaataaatcccctttataccaagctattttcctattaccagtagccaaggaaactatacaatataccaaacaaattctaacataatacatttgacttcttagggatagggcctaggaatactgcaagaaatcctaatacctctgcaaattcaaatatatctaatgcaaacctgggtttaatccatgaaccgacatttagaaataacatgatttaacactttcttcactgccttcttcactggggataagccttgtcctttcataaggcagtcaaggtcttgtgagcaagacctgtatcttatattttgcaatgaattgctctctcagcacaagccatgaacatagatgttcagtaggaatatattaggctaaaaatatgaagattgggatattatgattgccacatgatcctctggaatatcatcagatccaaagtaaggagattttgtgttctggaaaagtccttcttagaatagtgatagctgtatagcaagacagcagtaacaaaattgggggaaaaaaaatcattcttaaactgattatttgttaccaaaagatacatgcttgtgaatggattcaaagggatccttgggaccaaaaaggaatgtgggtggctgtgaagaaggcagttttaatctgaaatgaagaatctgactccaaagctcagcaaagaaagtctacgtttccctaaggattgagtctaagacaaggctgctaggaattcaagattaaagaggcaacgaatgtaaaatacattctatcttaaacatattaaagtgtatttaaagccatatgcctataaatctttctttctatgtttactgtacccctacattaagatattttggcattcaaagtaagtgaccagtttgctttgggctggtgatccactatggagagaacctgaaagacacggttgagagcagaatcttctgcccaagaaaaggccctaaccatgctcaaatgatggaagtagaatataaaggcagtcctgttttaaaaatgtagcttttcccaaagaagctaaaggatttcctgaccttctgtatctgactaccagaactcagggagaagttcaataccataattataataaataaagcaaactaattctaactccttaaagctgataactatgcccttaactagttctaactgaaacaaaaagaaaaaaaattaagctggttattctctgtataattttgattttttagaagcttatatattcattttagttatttgttttatacaactatttaccacaacgcatgaacttaatacatattgataatacaggaaaccaaatcctataacaaaatgcaaattctgcctaactgcttaaacttactaaaaaagctaggttctagacatcaactttaggacaacataattttctctaagttattccagaagactatttgcataaaacttttggaaatctccactccaaagttcttccactgtaaactgcacttaatcttttcaattagcaacatgcttaaagaacacaatacaatatctgggatcaatggtctagacatttctacaaactgaaatcatatacctatataacaagagagcaactgattgtgactcaaacccatcttgcaactacactaataatttggcattaaaaggatattctaatagagccatattcacagaaaacagtgtcatttagtataatttcttaagaatctccatttaaaattctcagaaaaatttaaactacagacccagagaactgatagttacttttattaacctctcctctgattataatacgactgtattagaagaccttaagaacaaattcagtaaagtaaaatttcatttcaatgcctttttataacctttcagttcccagaataggaataataattagcactctcatttctagtgcttgaaaaacaatgaagtatgtgctttaaagaacgaagttatatcattttcacctgcatcgatgctccttctactcttgccacacaggcgacccgatccaagaaagtcactgccacaggcaccgccacaaagaagcctttacaaaaggccttgatgtatcttttcacccacccttgtgactgtgccatacctaaaaatacaaagaaaacaactatgaaattagtctcaagaaaggtgaaaaacaaagacataaaaacagtacatgaaaagtaagagttaccgaagggcaatcttgtctcttaatatattacacactcattcctgtaaccattagaataaatctgacttacttaaagtcctaaagtgaaatacgtgaactcaggttaatgcttttccacaactcaagtccacttgctaacttcagtgggaaatttctccccacaaaacagtaagttagaaaaaaacaagcattccagaagtaaattcttttctgttgctattatgatgaagttactccttatacccctgatatctgttctcttctacagtaataaaagtttcagtggaacatgtggctgcccaactaaagactgttttccagcctcccttgcagctaattgtgaccatgtcactggatttgatcaacagcatgagtagaaaggatataattcttggttgcaccctgaaaaggaggatgccctcccttttcttccccattttataactgtaatactaacaatttggtggtaggagcaggggtggccatctcaaactatgagataaaagcttcaagtaaagatgacaaagcaacaaaatggaacgatcctaggtccgcaacaccatggaggcaccatactgtcctgcattgcttacatttggactgttaaatcacagataaatcacttgcgctgtttgtggtggcagtgttggtgttgttgttgtcgttgttgtttttagacagggtctcactctgtcacccaagctggagtcttggcaagacttttttggataagacttcaaaagcacagtcaatcatagcaaaaacagacaatggagattacatcaagctaaaaagtttctgtgcagcaaacaatcaacgtaatgaagagacaacctacagaatggaagaaaatataaggaaactatacttctgacaagaggctaatatccaaaaacgcataaggaactccaacaattcaatagcaaaaagacaacccaattaaaaaatgcccaagagcttaacaataatttctcaaaagaagacatacaaatagccaacaggtatatgaaaagaatgcgcagtcatgagggaaatgcaaatcaaaaccacatggatatcattccaccccagttagaatggccattatcaaaaggcaacaagtgctggcaaaggtggagcaaaaggaacccttatatctgtttatgggaatgtaaattaatatggccattacagaaaagagtatggaggttcctcaaaaagttaaaaatagaactaccacatgattctgcaatcctattcttaggaatatatccaaaggaactgaaatcagtatattgaagagatatttgcactcttatgtttatcacagcactattcacaatagccaaggtatggaattaatccaagtgtccatcaatggatgaatgaactttaagatgtgagatacatatatatatattatttcaccataaaaaaagaatgaaatcctgccatctggtacaacatggaaaaacctggaggacattaagtaaaataacccaggcacagaaagacaatattgcacgaccactcatatatagaatctaaatagttaaactcataaaagtagagagtagaagggtagttaccagaaggtggggtagttagtggggaggagaggttggggagatgttgctcaaaggatatataattatatttaggaggaatacatttcaggacatctattgttcagtaaggtgagtacagttaatggtaagatattgtattcttgaaaaatgtaaacagagtggatgttatatgctcttaccacaaaaatgataaatatgttaggtaatgcatttattaattagctagatttaaccattccacaatgtacatgtacttcaaaacattatgttgtatacaataaaactcacaatgttatctgttcactcataaaataaataaaaataaaaatactcaaccactaattccctcccaaatctttaacatgtcacaggaaaaagatgaatgataatctaaattggctaattctgaattacctactgtaactgacatcaatgagggctatatgtatgcaaggtaagtaagaccagtactcttgttttttatacttttatcaacatatattgcacataacattcacccaaaccagtaatctttttatacctaatcaaaataatgtaactcagactaactttagaatataagcaatttaaaaacatgttttcattcaaactcatctaacaactataatcttaagttaaattgcttatgagttcacacatctggtactcaagaaacgtgtttggcccaaggtactgattgtttctgcgagcagtcttaaccactatattcctaaaagagtaaacctgcttgacatgtttcattcattcatacccagctttaatgtgagcccttgagtgaaactaatttctcttcaatgacgtcttttgcctagaatcaaaacacctttactaactcattttatatatctctacaaaagatttaatatacttttccaatggactattttacaaagatcccatttatcatgtactacctccattaatataaaagaataaccttgacatatttatcaaatcagtaccttcaagatgcaaaagatgcattttcctcaatattagatttcattagctcagtctctctgaaaacacttctaaccacaggtttagcaacacaaacatcagtcttataataaatttaaaaacggaatgacctccacatctattctttttattgtttccaaaatatatataaataaataaataaatccaaagatttcagattataaaatatctgaatccacaaataatttataaaatgctcccatgtacataggaaaaaaaatagttactacgtagaagagaaaggaaacggctcaacagtaaataatcaattcctctttgaccagtttgatagcttcaaagttattttaagtggtctacacttatgtttaagtcatatacaactcccagataataattccagggtagtgttccccaagcttgccttgactgacatgcttaaaaatgaagatccccactccgactcagacctccaaaatcaaacacttcaggtgattcccttaatagagcaagtctggaaaatactgatatttgggtgtttaaaggtcagctgtttactcactcctcaagtttattaccttctgaaaatgaaaacaggggaaaagttagcaaagaaatatcaccctgaatgtctcctcacatttagtttacctccttactagattaagaaaaagtatctgcagaacaaacattgcacagaaaatgaacaccactaccagatcctactttgtaacctctacgtggttccatcagaaaatgacttccagtggattttctctttgccccactaaggcagttcaatcatccatccactcatctacccagtcacttactacctggctcattcattctttcaaccagtatttactaacggtcttccacaagcactgtgttaggtaccagggaatcataaaacagtgaacaaggccagtcccagtccctgatcttatcaagtttttacagtcaactatggagtgataagggtcaatctgaaaatcacataaacatacataagagttgtaataagtgctataagagagatacacagaggtcaggaaaggtctttgaggaagaggctgaactgaaaaatgaggagaacttctctagataaagaactgtgggtaggcaagggtattccagagagcagccatgtcacatgccaaagtccctgggtcaggagtggccatgttgtgatggacaactgaagggaggctggtgcagataaagcacacaggaagtggaagagcacagtgggacatgaatgggaggaggcaatgtaaatcccagagcagttaagacctcacaggccccgtaaggatttgcagcaaatgagaagtaactgaaatgttctaaaattgaggtgaatgatcctatctgcattttgaaataatcatctatctgaaagcctggataggacaaaaatggatatagggaaaccacattattctagtggtccagggcaagagatgatagttggagtagcatgatagtggagatggattaaaatgggcagatttatgtatatattttggaagttaaactgacaggatctggaaatagatggacaatggtgggagaaggaaggagataagaaagtgtcaaggggccgtggtagcctgtcaaagcactgctattctgttgttctcttgaattacatgtcaaaatatttaatactaaaattatgctcataattccattcctcaaactttttttttggcaaacaagcagatgtgctccctgccctcaaggagttacaatataccaaggaagactgcccttcaacaattatttccaatggatgagcattaaaagggacgatggccctgaagcatgacagcatgaagcaaggctgtctattcatcagaaaatgatcaaggaaggcctgccccactccacccccacccccaaaaaatggcatttgaggcaagacctcggcatttcaggtaaaagcagtaacatatatgaaggcctaggggcaaaataaaatgtagctgtttaagaaactaaaataagttcagtttggatagagtatatacagaatttattacgtgaatttttaattcagtaagcatttatttgctatcaagcagcaatgctaagtacagaggatataaagatggctaagcatacagtatagtaccattcaaaaactctcactaaacaataccttacatttcaacatacatttatatgtgcacataaaagtatttaaaattgaatatttatattgttttaattgtttaataaccactcatatgttacttgtgtaattattaaagtataccaaaagagggaagaaagcagcatcaaaatgctagcagtggttaattctatatgctaggaatggagacgattactattttcttctttgaatttttgctggtttctaaaacagaaagatggtatctgccctaggaagtcactatgatatacagataatacggggtaacactagtgttaatttctatcccatcacaatgaacaaaccacactctcaccccaatctctgctgctctaagtagtacaaataacactgagcaagattctttcctgtttatgcagcaatcaatatatttaactgactataatgttgtttatgtagccagtgcaggctatctatatttctggaaacttctggaaagttctgtcaaatattcgctacttttattttaagaggcacagaatggaaacatgtcttctctttgctgttcatcatgccctgcatgcatggaccttcacaaaacagctgaggatacctgcaggacagaaacggaatgcttccaaatatgatgccacagctatcttagttataaggtagtatgcatgattaaaatgtaaattaagggggaaacattaataaaagttgcattaaattcacatttcctgaattgtgagcctcctcttcttttccagtaatgctctcctacattacttctactccatgtagtcactggtccccaaaaaggagcatggtaatgagactcaggagacctgaggtagatatctgtctctgtctataaccagttccatgactttgaacaagtcacttctggcctgtttcctcatgtgtgacaagaaggggcttatttgggaggccaagcaagagggtcacttcaggtcaggagttcgaggccagcctgagcaacacagcaagacttccatctctaaaaatttaaaaattagcaaggcatggtagcatacacctgtagtcctatctacttgggaggctgaggtggaaggactgcttgagctaaggagtttgagactgcagtgagctatgactgtgccaccacactacagcctaggtgaccaaacaagaccctgtctccaaaaagggggggggggtagatttaatatctaaggttctttctaagccagaattctttatttctataactttttattgtcttttaactgtttcttaagaactttggcagatactaaaacaaacactgagatcactattgactaagaaaaagtgagttgcctttatggtttgagacttttttaagtattgaaaataaaagagaattaactttttttaaacaactggttaaaagacccaacagtgagggagctgaaaccagtgccaatgatgtaaaagaacattttaaatatagataaagacctgaacaccgttgctctttcacttctcatttccacaacctgactgctgaccagagcattgctaccatcgcctgcacaacaaagtcagggcaagtgtttttctgagagattataaaggagcatgtgggagatgtctcaatctgatatgtgctgatcctgctccaagccaaggaagcaagagcaataaaagctaccctggaaacaaggtacaagtggttgctattttcagaggctcaaaagaaaacgctcaattcagtcctgttttatctgaattgtgaggggcacctatatttcataataataaaacactgttaaaagcttctatcatgtaaatactaaagaagccattcatacatgaagaaatgaacacaacatttctatgttgtcatatccaataattttcttaaagttttatggcattcacatattggcaaagttaatgcacctccttgtctatgtaaattgccaaagaatcattcagatgatccggtcttttgttcacaccttaaatgtttaaaaccaccacagtaataagtacctagccccgacttcctctgggaaaatttcatctaagcaataacaatcaggtactaaaatcacccccagcaaaaagggaataatttttatcagttacctcattcttcttgtaactatggaagtcactgaggttcaaaacactgctcctgagaaaattattgcttaaaattgtaagtacacccagttcattgttgaagtgcttaaactgagaatattttttaaataagctttcagaatcaagtgaaaccatatttgccacctggcatacagcacttacaagtgagagtttcttggtgatgctgacctcaaccacataacaacccacactgtaaatttctctccttcccgtaacaacttgtggcttgatcatgcattaattcatctaaaattgttcttaagcctgcttatattttagcttgtacaaagtcaccaatcactcatccatggcaaccaggtggataaatccaccacaagtcatcctaattataaaaactatttaaaagttgtgtgggaggtttgaaggtaagaggaaaataataagttataaagcagtatcttatgtaaaatgtaacctttcaatcatcataagcctacacaaaatcaagattttatttataaagaggaaaccatcaaactatgaatatcagagaacacaagagtagggatccaagcaaatctgacacacaattcctgaatcagtcagtatatgtgtacctaccatgcaccatggaattgtgctaagagataaatatgtgttatagaacaaggtcagcatggtcctttctccacgtagagtttgcattttcattctttcaacattaagtgcctactttgtgctagacactatgttaagacaccagattgaccaagccatacttcctccccagagggacctgtgacaaggtcacaagaaacaagtatatgaccataaataatccagctatcatcctccacggatctttctagcagcccctggtaccaataacctggctcggcaaacagagcctaagcatgtgaaaaatcaggagacatttggatacatgtggtctaatacaaggataaaaaagaaaaactgatgaattacaacaattttggttccactggaagcagatcctggcaagtaatctatagaaagcaatttaaaaaattttttcaggactatcttgctcctttcacattataagtaaacaatattttataaacagacacttagtactctttagaacatgaataccagtatcaaattctttatctttagtcttgtctgacctagtagttctcacttgaaaattctcaggaaagaccaaaatggcacatacacaaaaaaagaaataagaaagaaagaggaaaaccagccaaaaataataaaggaggagaaatgtaattatgtaaggcataaagttagtcattttttggcaaagatacccaataaaaaagtcaacactgatacaatgatgaagctaagccctataaaattgcttctttcatggagataattgtgactttctgttggtaaactgataagcatctggatactaagagaagagaggttaaaactgatgtattcaatcttaagtcagcaatatgtaaaaacaaatgaatttgaaggtcatgctctagtacaactgatgtagagagaaaatacaaccaggaaacaactaggatacagaaattcataaaggcttcctgatttttggtaaggactccttcaacttgcaaacatcatgcatttatgcacacccttccctctgattcagtggaaaagcaggccccatcctatccaaggtgctcttcagaagcagcatcagcaaagagggaaagtcagtgaaaacctggtgggctttgaatccaagacctcagttcaaatcgtgattcaacagtgtggaaattactttatctcagtaagcaaaatttttcatctgtgaaaccttgcagggtttccagaggttcaaaatgttcatatgtgtttgttttcttttgtttacataagcatttgtgtaaagaaaatgactagatcatcaaataaaggatatttcttcagataaagcactagctatgtctaaggaagaggactagtaataacaaatcaaaaaaggataacagaattaaggatgtccattacagacaataaaccaataaagcccatcttctaggtgataagacacctaatacataatcattttgttctgctttgaacctcatgctgttctaagatttgaccagttaggggcaatcatatgtactgatattaaccagttaacaagaatgtattcagcactgtcttaggtgtcttgagatttttttaaaagcaaaataaaaggaaatataagacttagtgccagaattggaccacagggatagattatataatattcattgaggaaagaataaaaaggaagaaaactggaattacaggaaaaaaattcatgatgagaaaggctaaaaagaaaaaaaaaggaattagaatgtaggtggtgggtttaaaaatgttcattataaaattcttagaatgtttctgtatgtttaaaatttttcctcaaaactttggaaataaaagaataaattacatctgttaagtcactcagataaaagaaaaatataattagaatgaagatgcatacagcccatctgagatagcaagaatgctggccagatcagcgaacaggacctatattaagacaagtgagacataagactgaatattaattttttttttttttttgaggcagagtcttgctctgtcacccaggctggagtgcagtggtgtcagctcactgcaagctccgcctcccgggttcacgccatcctcctgtctcagcctccagagtagctgggactacaggcgcccaccaccacgcccggctaattttgttttggtatttttagtagaaacagggtttcaccatgttagccaggatggtctcaatttcctgaccttgtgatccgcccgcctcggcctcccaaagtgctgggattacaggcatgagccactgcgtccggcctgaatacgaatttttcttgttttagttgttttctttttttttttttcctcatcaatatggacatcttcatggctccagtatttttggaaaccatataaagcaaaatcctttaacaataatctaggactctctaagaactggctcaggccatcctaatcctataaattatccttatcctgtaactccaaatagacaccatttaacagcatttacaaccaaggcctaatctcaaatttcagttattaaaatgaaataaattctgcaaaaagtttaccataaaaattaataagacagtgaatagctttttacaggagaaaaatcctattaaatgataaccattagcacggagaagcttggtaagctttaaaccctaataaccacaaaatttggatttcaacactgtactttatttttttccaatttaatagaaaagcataactgctatcattaagtagaagctaaaggcaacgtgaattttaagctaacaatgtgaggacttaaatatgtatataaatgaaacagaccagctacttatccataacccaagcaaagcaattagaggatacttttcaccataagtccattttttcttgaagtaataatacagtgggttagtaaaaggatatattaccagcatcaggaatacttactgaatagctaagaagaaaatactgcattatttggcatttgggctgtgttcaaaattggctttaaaaaaattaagaaggcctataaatggaaaaagcactctttttagaaaaaaaaaatctcaagaacctttcaaaaatcaaaacttagaagaagtgagataggggaaataagaaaaaggtagtaacactcagaacctaaaaaaagaagggtacaaaatattagaaagtgggcattaggcaataacatgagtaatggaaaagtatcactagaaaccatgtgacagccagtttccaaagcacggtcatccaagtaccaagctttgctgttccttatctactttgctacctcacattttttcctactatctgacactgcttcatattcacttctcttacactgcagccctacttcggtcttattttagaatggtacaagggtcttattagggctcaacaataagcggaattgaaaaacttttttaaagaacatggtttctgggtctcatgaaaatcctatcctgatccctactcttcatgcctcaaatatattgctatctatactagaatgcaaatgcctttactagaatgccatatcaactcaagtcatacttacaacatggcttttcctttgatcagggttgggagtaaggagtaggaaggcttctcaaaagaatcaggccactagaccccaagggacaaaaatggaaagagaaagtcacaaaaaagtaggactgaaaaatacaatttaaccagcaaacttatagctagcccagggactattactactctttacaaaatgataaatacaaaaaaattagaaacacaggctcccccatcaggaaagcacattaaggctccaattagtctgtcaaaaataaaatctattcagactatggcttgaagatttggaaaggtgcccacagcccatgtatggcagctgcaagtccatggggagttcaaacagcaacagtgcagagtcagtactgaagatgcaagccagaggaaaagatttatgcaatttaaggtgaaagcaacagaaataaactcccttggaatgagtgcttatggtccttttagcttataagtgcaagtgtacccacaaacatgcatgcacacttgctgaaatggcaacaaaggccaagttagcagcatatgttaaaaaagaaaaagtaaaaataaatatataaataaatagaacagccaagaggccagagtataaagcagctcatcctgagtggcctggagataaaagcagatggagcacagcattacccagactcaagtgtctgttgcacaaaaagtccaggtattataacgagcctgtggtattacagcaaatggaactgcgatctcatttagattattctccactcttatatgccttgttttgatttctgcatacttgcctataaattggaagacactgttttaagatacctgtgaaatttcatcaactgtggctagagttgaaatcttaacttcaaccttaagagaaacactgaatcagaactacaaagctgacccgctcctaaatttctgatgatccatggaaactgtgtgagataataaatgtgttaagccactgatttgggtggttatttgttttgcagaaatgactaatacaatacaaaatgcacaaaaagacccaagggcgcaaagaaacttggtatttgataaagtcgacattcatattgggaagagaagttgaattaacaagttatgttgaaacaattagctacaatttggaaggagaataaaatcaaagctagatatttattaaattcattataagaaaataaattccagataagccaaacattatatgtaataaatagaaatataaaaataacaagagaaaataaaggcaacagtcttttaagggtagaaagaggtctttctgaacattttacaaaatccagaaaacatgaaagataaatactgatagatttcactacataaaaatcaaaacataccataaataatgttaaaagacaatcagcaggacataaaaaattataatatcagtatctctaaaattacacaattcttataaagtataagaaaaaagacaataattttgagagaaaggtatttcactgaaacaaaatatggacagtatataaagacataaaaagatgtacaaacacactaataataaaatcaatataaataaaaacaaagtactactttagtctatcaaactgacaaatttaatatggtaatatgtaccaaaatgttacatgaatataccttctgatgcagaaacaccactccaggaatttattttatggatgcaaagatatgatcaacgatattcaacataccatttttattgcagtgaaaaaatgaaaacaaccaaatgttcacaaatatgtaaataaattatgacatgcatacagtagagtaatctgcaatcattaaaaagaacaatatatcgttatattgcttgagattctcctccaaaaaagttggaaaattgcatttttaatatgaacccatttatgtgaaattttatacacacacagcatcatcctcatcgtcatccttatcatcatcatcatagaaagaggtcaaataataaagaatatgaaccaaaatgatgacagtatttatttgcaatgaaaggaatttcactttatgctttatatttttccatattacttaaatcttcagtaataggtatttagtatctttatatactaaaacaaaattaatattacagtcttttctgctacaatagctatttcttaatgtaaattagctcatatataggaaaatgacgtcagtcttatgtgaaagctatgctggttcatacacaattttccccagtacatgaaggttttgattcaaccaagagcaagtcttctcccaattaaagtgaaagtctcatttggtggcttcaagactttccactgttaaaggaggctgagcataccaacgaagaaatgcaaagatattttcccctgtgtttaaaatagaataaaatcaacagatcaatatcctagagcagattttcaactttgatgaaattggtctgtattagaagtagatgactttaaggacctacaacaaaggaagaaaaccagggtttcaagctaagactgatgtgatgctgggtgcaaatgcaaggagggagttaatagtgctcgtttttatgacaacttctattttctcagctctgtttacaaaatgtcactggtttcaaatgatctgttcctagccctattttctttataagccctaaaattttatggtttaattttgcagaattaaagatttttcaggaatgcatgtatgtcattaataggagaaatgcctctactattctgagtaaaatgcagtaaggtagagaaatgttccatatcaaaaagaaacaaaaaacaaaaaaaggaagcaaaaaggagaaatgaaggaagggagggaaggaaagaaagagggggaaaaagaggaagaggaaagaaaaaaactgcacacttcactttgttttagtgagagtgtctaacgaaagatattaaatgcagggcaaaacaatctcattaatattcttgatttataccacacattttgattctatatgagatatatctaaagaaatggtctttgccccatcggacacttaaaatctaaacaagggagtgaattaaacagtcatcaactatggtggggcaggaaaagggactaatccaattaactttaggacacagttatttaattatacccaacccaagggtatagagtcaaatactataggcggtatttgggctgggaagttggggggtggggaatgcaaacagtgagagaaacaattgtgaaactacttaagatacattgtaggactcagcaaatgagttgggagaacagtggtgactgtgggaaaagggagataaaaatacacagtgggaatcagggaagaatgctgtggggccctggaagcaaaaccatatagaagtagcaatgagtatatgtagtactcaattcttagggtctaataccattccctactccaaagaatcagcaatcttcagagtaaaggttgattctggggctgtggtggggaaggtttaagatgagcctgaaacattttctttggccactaagaagtgcttagaaaaaagatggaagtacatcaaaaggagacgggagcttgcctggtgatcccactggctaaatatgaaaaaaatttgattacttattaaataaagtcagtaatgagtttaaactactggaaaaacagctttgaatgtgctaattttctgaatctgagcaatactttaaaatatgggttttagcttcaaaaggtaaatcaggtaatttcattttatttaagtaataccatgaaaataatgttacaaactactaagttaaatacaatatgaaatattggtggtgggttgttttttgttgttttttggggtttttttgaaacaaggtctccctctgttgcccacgctggagtgcagtggcatgatcacggctcactgcagcctcaattcccaggctcaagtgatcctcccacttctgcctcccaatagctaggaccacagatgcacaccaccaggcctggctaattttttatattttttgtagagatggagtttcaccatgttgcccaggctggtcacaaactcctgaattcaagtggtccaccagcctcagcctccggaagtgctgggattacaggtgtgagctactgtgctccgcctaaaatattgttttaaaataagtcccctttatgatcattctcagaaatttgttagaaaagaagttcccttgcacatataaaaaatttttttcaatttataaattatccttctacactaatttccaaagaataatcattgagatgagttaaagcttttcactattctttgaatattatatcagcatatccaactgttaattgaatttgagatccactagtaaagcaaaaagcttgtgactttgaagactatttaaaatgtacaatgttttattaattatcattagtagtactattatacaatggttgtacccttgtaagtttgttaagaaacagctgacattgaaattgtctgcatctaaaggacatgtcaggaaaagcagagaaatcttaccaaaaaaaaaaattgaatcaacatctcttcttttggtatttacccctttcacatcaataaacatttactgaatatctgctaagtgccaggcatcatatcagtttctataccgaaagagtaaagacgtttctgtatagtatctatatagatattgaacattaagcattgttctttggaattattccagccttgagataaggctaaaagggccataaaaataaaatgaagaaagatggattttataaaggatagaggcaattggggatgttatggaaagacaaactacacagcattttatactctctggttcttctactttcagagaatgactctatcatccaaacagctgcccaaaggtcaacatggtagtgagccaaagtgagcattcatgaaaaaaatagaaatcatcctaactttctcttactttaaatcgttcaataactcctcattttctataggataatatcaagctgcttagatttagcatataaggctaattatgattagattcctagtctcatcacttccacttttttttttttttttttttttttttgagacagggtctcactctgtcacccaggctggagtgccgtggtgcgacctcagctcactgcaacctctgcctcccaggcacaagcaatcctcccacttcagcctcccaagtagcgggaaccacaggtatgtgccaccacacctggctaatttttgtattttttgtagagatggagtttcatcatgtttcccaggctaatctcaaactcctgagctcaagtgatctacccaccttcccaaagtgctgggattacaggtaccagccaccgtgctgggccagttcctctctttcacagcacatcatgcttcaaccaaacccacctccatacaatttctagaatatgccacacttttacttgtctctgggcccttatacatctctcccttctgtctacatcactcttcccacctttctttgttttggccagctttacccatccttcaggttagcttagatgtcactatcaggaagtccactccgactctccaaatctgacttagatttccttcctatgtgttcccataaaactctatgctccccctagcacagcatttatcacacctgattttctcatccttacccctaatcagttgtgagttctgcgcgagcagaaacacttgttcactactatacttaagtgctttgcacttaagtgctcagtgttcaatacagtttcattgaagaaattaattaaccacttagctgtccatataaactacatcatactcagaatgtgatataagttctggaggccttgattgaacagcactgcacaaccacatgccataaattttatgtgtgtgtgtgttagtttgtgtgtgtggtgtatgtacacacaaatgactgtctccatctcttacctgatagttttacttcacagctgaagatatttatgaagaaagtggtttttaaaagaaattatacttatgctgtaagtataaatatacacagaaagaaatatgtgggctggacacagtggttcatgcctgtaatcccagcactttggaggccaaggcaggaggatcacttgagctcaggagtttgaaaccaacctgagcagcataggaagaccctgtctctaaaaaaaaaaaaaaaaaaaaaattaacatagccagtcatggtggcacatgcctgtgctcccagctactcaggaggctgaggtgggaggatcacttgagccaaggagatcgagactgcagtgagctctgatcacaccactgcactccagcctgggtgacagagcaatgagaccctggctcatttaaaaaaaaaaaaaaaaaaaaaaggctgggcacagtggctcacggctgtaatcccagaattttgggaggctgaggtgggcagatcacaaggtcaggatgttcaagaccagcctggccaacatggtgaaaccccgtctctactaaaaaaacaaaaattagccaggtgtggtggcgcatgcctgtagtcccagctactcgggaggctaaagcaggagaattgcttgaacctgagagacggaggttgcagtgagcagatcatgccactgcactccagccttggcgacagaacaagactccatctcacaaaaagaaaagaaaaggaaggaaggaaggaaggaaggaaggaaggaaggaaggaaggaaggaaggaaggaaggagggagaaagaaagaaagaaagaaagaaagaaagaaagaaagaaagaaagaaagaaagaaagaaagaaagaaagaaagagaacatacgtcgattactacatatatatctgtatattgaacttcaggaagttgacttttctgtatttttcttcaataaatcataacacaacactcttgtccaaaagcagtaaagatggataagaaggatcaagtaactttcataatccacccaactataaggcattaagaatttttttcccaattaacagctgatttttaggaagtgtttagttagattttctttcaaagcaattatttttcagtctgtgcttcatggtctcctaatgattccctggagtctcaagggccagggggagcaggtgctaagtgaacagagttctgaactgcctcaatcagagccactctgctttttatctggttttttttttttcaataatggaattccaaccaagattttctttgaagaagggttcactacattaaaataagaataaaagaaaaaaagaaaaaggttaaaaaacactgccttaaagaatcagcagtggattgaggtttgcactatataattcaagctctaatgtatttcatatttcttggttagactaaattcaactgtcagctttataggcctttctttgtgctaaaatgagaaataccatttgaatacaaaaatatccaggtagagggaaaacaaaatgggtttttgataagtatatttattctctgatgcagctatttctaaatttacttattatttttaatggctttatttatgtaccaatcttcaagttaatgattcataacagaacaccaaaataatctaattgaacaacagaagcccactgtaaatgccagctgctgctatgtttcatatactgtaaacaaatacccacctcattttaatagtttcttagtagaaagattaccttaaaggaaaagatccaccaaactcatatttaaataataattttagctattttcgcaatctagaaacaacaggggctccgggtaactgaaactgggggtgctccatcataaaacatccagaagaccagtggggtgaatttgatctgctggtgaacacaatgaagactaataagcaaaaatgggcttcttccaacagaaacctcctgccaacctgtgcacaacattgtgcaattgcagaacggcacttcactggaagtcagggaaacacttgcaatcaagtccaggctctgtaacaagttaagtgaatccaaaacctttacagctgaacacataaaattattcaaaagctctaacgaggtgagaagcaaccaaacttgattttcatctctgggaaaccctatattagcactgtaacccacaaggccctcttccacttccaaactcctctggcattcactagccacaccttcatttggcacccaagagtgttagttaccgttttataggtaactccccaactaagttgtaagcccctaaagggtatacataggtcatgtctcactcttttctatacatcctaaaattcttagaattttgctaagcatttgcagatgctaaataaatgtatcttgactgtttgtttaattgtagatatggtttatattaccacccgtttacaatgttgatagtttcatatggttgtgtcagacgacattccactcctttaaatgccagtcaggagagtaacggagaaaataagcggccagatcaggctgtattgacagccatgcaactaatctgatactacctctccatgcatgcgtccctcccaaagaccaagtgcccactctgttctagggctaagtgttttctgttcctgctatgctttgtaccaagtcagaaataagatttggattcaagtcttagctatgccaatgagtaagcaatttgaatagatgaccttagctccaattatctatgattctatgattctaacttcaggcctttaccttccaatatcagaatggcccctccctcacagtactaaaattacttatcttccatgatatgtcccattatcatcatcaatacacccatgttcaaaggccatttctgacttctgctacaaggtcaacatactcatgaaattatttacacttctaaagataacactgttaaatttcttgtctgatctttacgtcatacctgcgttcatttaataaacacaagtgggtagttgggtaatatgggaaaagacactcatttagggaagtttctaacatattcctgctttcagcagcaaagataagttatggctccatttgcaaataagcaccaataatagtaaataaaactaaattatttttatactggtcactaggaaggttgttttcatcttaaacggcagcttagtagccttgagaataatctgatctctcccattttataagaaacttatttttattgtctcatcaacatcaaatgatattagggagtttcacaatgactgtgacaataaatggcttagaaagaaaattcagtaacaattttgataggttttaaggaatatatgagctagataaaaatatatgagccatatagagatttgatgcaatttaaattaatatctaccagttttgaaaaataaagtttctcagaacctaatgtagctttcttctgcaaaaaagacgaggcatatcacctaaaaagacctgtccctaaccaactgttatccaagtaattaaaaagaaaagtgaaaatttcacctcttcatacatgttaagcaaaaccagccataataaaatccctgatgaaaggtgagttttaaaaataaaagtgagacgtaggtaacagaatcctccaagaaatacttaaaaggttagttttcctcagccaaaatcatatcaacattttcgtatattttggatattaacctcagtacaaatattagattatcaaacataaaatataaaaatatttggctaatggtatagtaaggttttgtttcatttttaatagagtgattagccattcacaaaaatcagtcaatattactcctccataaattatgacaaaaaatatacaaactctgaatgaagcattaattgggaaaagaaaaaagctaaatatttttattgtgaaactaataaaataaaaacctcagtctagtagagaatatacactttgtgttgattaaaattttatatcactatgttaaacacagtaatactgaaaattgttattttaattacctcatttaatctctacattaaccttatttttatccccattttaaaagatataaaccgatgctcagagtgcttaaggaatcttcccaaggtcaaagaaacagtaagtagcagagctgaatccagattatttgaccctgtaaactaggtatttaagcactatgctacactgcctccagttattcataactcccaataaatattcaacactcccaataaaacacagggcacgatgagttattgatttcataactgctactgcagcattcagatactacttatttggaaaagtgttctgaatacacaattaattcaatccactatgtaaaaggtaaatgttcaagtctcattcaaatggagaaggggtagaaaaggaagaaaagtacaaagtctatatggaacatcaattaataaaaaatattatcagggttgtctttaaacttcacaattactgaaggtccttattatcttgctgtcatttcagcactctcaattgcctcttagaatttgaaatttcactgttgaaacaaaagaaacataaaatatatgtgcattctaaaaaattctgcccttttgcaatttatcttctacatttattacctggatcttctaacactcgactagaaactaaagcaatccaactgtatatacaaaatgtaaaactggaaatgccagaaaatcaacatgacctttcaaatataacattttccacaatcatttacttaatactagaaaaacattttacagtatttaaagcataatctttatgtgtaatactttcggcaaatataaaagcaaatacagaataaagtcaaccacatttttaaaccaaaactgcaattaattttaaactactactttttctccagtagttcattatctatctattaaaacattcataaccatattagtgtgctctccgtttcaaatacaaagctgatgttaaccactgtactagtcacctcctgtacctggtagggactgctagtataacaaacccctcccctgacaccaatttccctatattagtttgcttgagaacaaaaatatgtattgggcaaagaaatgagataagccttctctgtaagccagcaagaccactcttgattaatccccaacgtactggcctcaacagcatggcttctaaccaaccagaatcctcagtcaaaaatactttaaacaaagataaaaattagctagaagatcatgttaccctaaaattaaattttatttgagagcaaatgtatagcctttatattttctgatccaatcacatctttgttaaaagcaaaagatatgtaaatcaacactaataggatgttagattttccaagagagaatcacacttcagataaactactactcaaaatcttttttattccataatcaaatagcaatccttaagaatatacctttcattcccttttgactactttaagtatttccaaaagaagctgaacagaaaatacttttcttcagacttttttccgcacatctcctagcaggagagaaaaattagcaaaacaaatgaactcagaatcattaaaaggtgtggacagtgtccatcttatagctttaatacctaagaattaggaagaaaaagagatcaaggaaataaagcgaccaacataatacctggctgaaggacaaattctatacttaaaattaagtatggctctaaaaaaggatgagtttatgtcctttgtagggacatggatgaagctggaaatccatcattctgagcaaactatcccaaggacagaaaccaaacaccacatgttctcactcataggtgtgaactgaacaatgagaacacttggacacaggatggggaacatcacacaccggggcctgtcgtggggtggggggatggggtgggatagcattaggagatatacctaatgtaaatgacgagttaatgggtgcagcacaccaacatggcacatgtatacacatgtaacaaacctgcacattgtgtacatgtaccctagaacttaaagtataataaaaaaaattaagtatggctcctaccgactctatgaattcagttcatatttctttaatgcaaagagagaaagagcaaagttactgaatgaagagataaaagtgtaaaacatcaacaaagcaactaaattagatacctcacctatcacagagaaaatcaacaaggcccaatgaatttatatgtacacatttacctttggaataatacgtcatctgctttttgtattctagacatgttctattccattgactgggaaaaatcgaaaaggtggcctttgtagcagaggacaaacagaactcaggcttagtgtaacagagcagcaaaataaggtgagagaaaagcagctgagaaggggaggtttacattcaacatgtataaaaataatgtatattggctttttttttttcatgagggaaggaaggtaactggctaccctaagaatgaagcagaatcagcatggcaagaaacaaaacaggcagaaaattaaaggatccctgagaatggtttataccccaaacaaaacaaaagtgagacaaagtagaaaaaagaccaaaacccaaactaagacaaaaaccccaatcctctctcttacattgagagaagcagaataagacaacatcaagaacaaaatatctgcatccagaagtcagactcacacacacacatactctcagagcagcaggagaacaaaaggacaacatattttacaatattaagataaaactagtacaattatatttttaaatattaattttttttaaaaaagagaaagaacaggttggtcagctctgcccatagatgcttccaaaaaactccatagcagtcatcctaatggatgtgagacacaatttcactaggcctttgatatgcatttccctaatgattaatgatgctgagcatcttttcatgcccttattggccatttgtatattttctttgcagaaatgtcaattcaaaccatttgcccatgttttaatcttgttgttttttcttgtagagatgttcggagttttttgagacagaatcttgctctgtcacccagctggagtgcagcggcgcaatctcagctcaccgcaacctctgcctcccaggttcaagcaattctcctgcctcagcctcctgagtagctgggattacaggccaccattcccagctaactttttgtatttttagtagagacggggtttcaccatgttggccaggctagtcttgaactcctgaactcaggtgatccacctgccctagcctctcaaattatatactgtggatagtaaccccttatcagatacatgaactgcaggattctttttaaattcatttctctattccctaatttctcagagttggctatatgtaatgcagaagtacattttgagttgaatatatttcttctttgtttttattttttacctaatacaaaatttacaatactcaaaagaggaatacaatggaaaataacctccatccctgttcttcagctacgaagttccaatccccagagacatttttcatcttcttataattccctccagaaatattctatgcctatataagaaaatacatttcttaagtctcctccaaaataatctattcattgttctgcattttcctttttgatttactacatcctgaagattattacatttcagtatatataaactgccttatttttaacaacataaatatttcattatatatactataatttatttatccagtcccctaaggatgggcatttgtttccagtcattgccaagagtatccttaaatatatgttatttcacacaattacaggatctataggatacaatctagtagaaaacttaaatgctatatatatttcaaattttccaaactgacctcaatgaaaattgcacaaatccatactcccattagcaatgatcacacttgcctagttccctataccctcaatgacacattgtgttttcaaaatttgtttctttgccaattaggttttaaaaaaaggcatctcattagagttttaattttgcatttctcttattatgaaatattaatactctttgtatctttgtccatttttctatccaattgttggtcttcttcccattgagttgttcgtgctctttatatatttatgaaatcagctgtcttcctatgatatgaattgcaaacattttttcctagtttttctttgctttttgatatactttgttttcttaattctcaaatttaggaacaaaagtacttccactatgtctttgttcaaactatattccttattttgaatgttcttcccttccttcaaaggtcaattcaagttgatgtctctgctctctccctaatcactcaagatcaccttgattcaaaaattatttagtgagagcctactgcattatatttacaaataagtaaatccagtgaattttgtgatatagtagcacacagcaaggaaaatttatagaggccactaaacatttaaattgtatctgaaaaaatgagaagatatgatccaaattttaaaaatgaaacaaaggcccaggtaacgagaacttattgtctataaattagtctcattggggtacagaatgctaatgttgtagtgaaaaagagaaaaagctgaagaggcaagcagagccaggtaggataggtcttttaggccaatttaagtaagtttttcttaatctaagggcaactagaagccacagaaccattttaagcagcagaatgctggtcagagaagaattttacaaagaccactgactgcaatcttgagtttaaccagcacttcagtgaacagagttgaaactgattcaaatatcaaatatactcttatttattcaataagtgaattttaaaccactatggaatagaatgctacagaaaggtgaaataaggtactgtgctgctctacttccttaactgagggcttggaacaatcactgttgcaagtcaatttaaacaaccagacaatcagaccatgttaaagatgagacctctaataataaaaaatcatagttgattctcactttatcataaaatccaaaacggacaagtatgggcccaaattcatgcagttcactcaacaactgtactcttacttctccattgtaggctaaacaaactgtcataccccccccccctttttatcctgcttttttgcttgtttttttttaattttttatttatttaggttgggggagacagggccttgttctgtcacccaggctggagtacagtggtgtgattatggctcactgcagtctcaaactcctgggctcaagagattcccctgtctcagcctcctgagtagctgggactacccatgggcaccaccacaccagtctaattttttttttttttttgagacagggtctcactgtgttgcccaggctggtgtacagtggcatgatcacggcttactgcaacctctgcctcccagtctcaaacactcctcccacctcagcctcccaaggagctgggaccagaggcacatgccaccacgtccagctaattttttgtatttttgggagacacagggtttcaccatgttgttcacactggtctcaaactcccagactcaagtgatcctcctgcctcagcctcacaaagtgctgggattacaggtgtgagccactgcacctggcccatcctgctttcaacagatgacattaaatgtccagaaagaattcatgagatgttatgaccattgaatttccccacgtttagcctgggtagtgagaaaccagtttcagggagagaatattatctatcagggagagaatattatctatcttgtcacccaattcaatcctctaaaatgaccttctatgtgcttgctacaaaaaaaaagttcttccaaacaaatacattcaaaaaataaagtttgtttgactgcatgcttctctagaatgcttttaaaattttcttctccccattctcaatatcataaatcaggtaacacctaacaggaattgtctgtactatttcttatttgctggtgacaattcctttttgattccccatgtctactttaggggttagtggtttaacagtcattcttacatcttttgtcataggatattccaccgttctgtctttagatatatgatacactttgaagttaacagaagaaagtaaattagtataaatacaaaaagttgatattacaatataataagcatgtcaatggtactaacaggagatgacaattacacctttatctcgaagtaatcaccatcaaccattctcaaactcagaagtgtatagttttttttataattttaattcattatcatgtcacttaccatttttctctaagtattttaaactatagggacattttgattgaaactagaattgtattcaatacaacacctccctcaggaatttaactttacaagcctatttctattctcttcccaagaatctttccatctaattctaccttgccctcgtggcttaacccatacagagactggtcataagtgctttagaatctagcattttcttcctacaaacaggaaataatgtgtctctgacactatccaaaaatgtggcaacataatttatgcttttggaaggaagactaacatctcaagctgacaactaggtaataaatatgattaagacccaagcacacaatgagaatatcccaaagggtatacctttcagaagaagacaaggcttaatcagtgagacattttcagcaaaaaatacagtcatttttttctcagatgctcctaaataaccatctttttggcagtattgacttgttagccccaaatcattatttcccttctttactattaatcttcaaaacaaaaaaatttaagtctatgatagtaaccaagtctgactcattaaccgaacaattccccactattctctgagtttaaattcacataggattcttacaaacagcttatgaagtcctcaaaaataacccatgaagtatgtgttatctctgctttcccagaaggaaaatgaagttcacagacaaaaagtgacttgttcatgttcacataggtaataacagagctagcacctgaataaagatcttacatatccttttcactatatatcaccactttaacatctggatatttatatttaaagcctattttttaacttttaatatagaagttttaactgaatgtttagagtattagcataatgtagtcatatacatcagacaggtctcaaaaaatcttctaatatgttgtcataatccacatactcagactacaggatgtctcttaaacatgagaaatagtaagattctggccacgtgtggtggctcacacctgtaatcccagcactttgggaggccaaggcaggtggatcatctgaggtcaggagttcaagaccagcctggccaatatagtgagacctccatctctactaaaaatacaaagattagccagacatggtaacacatgcctgtaatcccagctacttgggaggctgaggcacgaaaatcacttgaacttgggaggcagaagttgcagtgagccgagatcacgtcatagcactccagcctggatgacagagcgagactccgtgtcaaaaaaaaaaaaaaaaacatagtgagactcataaaaagcacaagctaattcatttataaactgattcaaactgccctcacataataacagtgctaaatagttattaatatttaacaaaactaaataataattattcagtatttaaatctgacactaaaaaaaactcttattcaagcaactattaaacaaataagctcctgggaaaataccaagatccttagtaaataatctgcaataccaataaaactaaaaataaaggccaaaaaggctacatactgtatgattctaactctatgacattatggaaaaggcaaaaacattggagacagtgaaaagatcagaagttaccaggggttaggagaagggagggatgaataagcacaacccaagatttttaggcagtgaaaatactctgtatactataagcatacatacatggcattacacatttgtccaaacccacaaaatgcactacaccaagaatgaaccctaatgtaaacaatgaactttgggggataatgatgtgtccatgtagtttcatcaattgtagcaaacgtaccattctggtgggggatgttgatcatgcaggagaggctatgcatgtgtgagggcagggagtaaatgggatatctctgtaccttccattcaattttactgtgaaccaaaagaccctaaaaaaaagtctattttaaataaggcaaaatatctgcggcaatcttaatcttctcctatcaattattacttcacaggtcctctgttaactatttagtagaaagcatccttggctgtcaatgctaaccttctgcacagctcttatttacacacacattgctcctcataacatctgctctgcccactgtagcctgcttatcctctaatggtcatcagtatactgagtccaaagacagggaaggagtcaggtacaaatgagatggagaagacaggtagtggggctaaggaagcaaagaactgctaaagagggaagtcagcagataaatctgcaggagaaaatctgcagcaacaaggagaaaagaatcctgagttgatacaaatttgtttattggtttacataatgggaaaatcatatgaaatgaaattatcctaaaatacaaaacatgatgacattacaaacatttcccttctttaaaaaaaagtctttgctgtatacaattccgtaactagaacttgataatctgtttgcaatgtgtcccccagcgacaagcaagatgatttttcaaaagttgactgtaaatgctacatttttcaaaggaaagatatataaaagtgtgtgtgacaaagacctatgtctcagaataacttggaaaaaagtacaaatattaaatttttatgatttattgcctgaaagaaagttgtacacttttatattctgggtattcttaatctaagaagtcaagaacatactatgtattaccaaactgggcaagagttcaatgagattctgaaagttatacctaacgtactatgtattaccaaaaacatacaatatgtttagtaacaaatagtatgttaggtatgttaggtatgactgttagaggtgtgtgtgtgtgtgtgtgtgtgtgtgtgtgtgtgtggtcacttgcttgctttggtcatcggtgaggaagccaggctaagcaactaacaaagagtccaaatatctgagtcatttatgagaggctaagggctccagtggcaaatcagggacctataagacaggctcaaagatggttctggcaggatccaccaccaccatcactaccacctcagcaaaatacaaccttcttcatctgaagtttcagggaagcacaaaggctcgagttctgccagcagtccagctcagtaaacactgattaagcaccagtgaagtacaaagcattaggttaaaggtgataaaagacactgaataggaggaaatatagcccctactaccttaagaattttccagtaaaaaatatggtaagactataatccaggcaaggtagagcaagtactaaaagagaaatacaaagaaggcattcagaggtttcctcaaggagatgctctagaatgaaacctgaggctattactcagatgaccaacaagttcatgctatagccactgctcgtttataattttctcccattcaatgtactacttctacaccagagatgtgagaaacttgaaaaaggctattttgttctagctgattattaaagggggagaattcttgaatataaagtaagatataaggtaaagcaagcaggaaaggatttggagcaaggtgtgtcataatgctaacatggcacaaagcaaaataattcaacttccattcagttttactggtcaaaaggaatagcatcatttttgttttgttttgttttgttttgagacagagtctcactctgtcacccagcctggagtgcacgggcacaatctctgcccactgcaacttccacctccagggttcaagagatcctcctgcctcagcctcctgaggacctggcatcacaggcatgtatcatcacacccggctaatttttgtatttttagtagagacagagtttcactatgttggccaggctgttctcaaactcctgacctcaagtgatccacctgcctcggcctcccaaagtgctgggattacaggtgtgagccaccatcacttctataacacatttatatgctgctttaatggtttacaaaggactctcacataaatgcttacaatgaaactcaaagcaatcctatgtcaggtagagactgttatcctctcagagagcctaccctcacaagacagtccacaatgatccttgcctcatgtccttgtgtaatccactcccatactgaatcagggctggtctgtagaaccaattgaatacatctgaaatgatggtgtatgacttccacaggtaagtcataaagggcactgcagtttctactttggcagcttgaatctcgggaaagtcatctgccatctcatgagaatagtcccacggcaagcccattgtggaaaggaaccaacctgccaacaccaactggccagccaagtgagtaagccaccttggaagtgaatcttttagctccagtgatgctcctataaaacttccactcctgctgatatctgacagcaacctccagagaaccaagcaaggaccctcaaattgctgacccacagcaaccatgagataacaaacaatcattgttgttttcagccactaaggttttcatgttacaaaacaacagagaacccaattttacatatgaggctcagagaggttaatttaccaattatcatataggaatgagtagagaaaacagatctggaacccagtctttaggctttaggttcaatttgtcattaaacaataccactttcttctcaactaaaataaggtataatactgtaaggatgatcattcctacacgattatatgactgatactagtatgtcaagcttcctacagtacagagacacagtatatgtccctgcattcttaacgaatataatgggaatctccaaaataagtccatttgtggtgctccattgtgctctgtggagttgttactattttctggaaaatggctatttttaatgtgcatatcatgaaaataaacacttaacacatttagagaattttaatactaaaatattactgacactgagactacacacttaaatcttaattacaataagcatctgtgtaattttaaacaattagaatatatcagacaggaaatgctcaactgctatttctttaaggttctgcattttggctttaggtcttcaaccttgtagcattacacaaatgtagtaaaatatatcatcaaaatgctcgtgatggtaaaatattaaatcaaaatccataaagtagttcctatcttacaggacaaggtagccagctcttaagcctgtccacttctggagaaggtcaagagaacattttattgttataatcacatctgcatataatgttccttcacacaaatctcctcttttgagccatataactttgcaaaacaggtaggcaggacgggtatactaccatcctatttttcaatgatggccttagagaagtctcagtaacttaactaaggatacgtaactattaaaaggaattcaagaatctaatctacaattttttagctccaaatcccagccttttcttctaagccatgttttagcccagtggttctccaccctgactgccatgaggacacctaagatgctttgaaaatatcactgcctggacctcatcccccagatacttgatataattgcactggtttgtgttagctgtctaatatataataaaccagtgttggtaaattcacagaaagtttatatcacaagggagaaaatgctgatacgtctatatgtaaactgaaacatattaaccccctaagaactccctcaaacacaaaaatatcttgcaataaaatcacgcagaacaagaagaaagggaagatgagaaacccaagccccttctgctgctatcgtggggccattaaggaatattttattcccctaatcttactccccgaacctcaccatgccatatctcaagctatagctcaggtatcaccttttgtgagaccttcaggatcacaaaaataatgaagtccattttttgcatctatcttaccttgaactctatcatagcacatattgtccctcaaagcattgctttatttttattttattattattattattattatttgagatggagtcttgctctgtcacccaggctggagtgcagtaccacattctcggctcactgcaacctccacctcctgggttcaagtgattctcctgcctcagcctctgggattacaggtacatgccagcatgcctgactaatttttgtatttttagtagagacggggttttgccatattggccaggctagtctcgaactcctgacctctggtgatccacccacctcagcctcccaaagtactggtgctgctttatttatatatccatttttctcactgccctgaggggtccttaacccatttatgctggaggttgcaaattttttttgtgaaaaatcaggccttggcgatgaccttgagaagtaggatataaataactcccactagcttagcgctccaataatggagcactaggcataaatgcattaagatcagatccctatgttactcatccttcctgccatatatatctttgtatccagggcctttaccatagcagatattaatacatgttggctatgctgaatgatttttatgtttgttatcattatttcctccattctcctagcagacactcctgtgaaatttttcaacttttaataaaggaaaatggagtttttacgcacaactggattaggttagagaataatgtatgcaaaagggccagacgtagtgagagcaagacagcagtgaactgtggggcaggaaagaatagagtagaaaggacatttaaaattcatatctgacagttggggtcagatatgaattttgcaagccgggaaggagtaggcaaacaaagcgacaacctaatcttcattcacaaaaaaaaaaatatgacaagcaaggaatcaggcaactgtattttcaacatctccctttctatggtgtttctaactcacagcatacagacatgttgtttctctctcaaaaaataaaatctgaagcagtgatatgatttcactatgtatttgacttttttttaagattccacatgtgagataatacaatatttttctttctgcatttggcttacttcacttagcataatgtcccctaggtttacctatcttatggcaaaaagcagaatctatttcttttttaaggctgaataatattccattctatatatgtactgcagtttgattttctgttgtcttttgttggacagttaggttgtttccatatattcacacccatcaagatggctactaccaaataaaacaagagataagtgttggcgagggtgggagaaaagagaacccttgtatactattggtacaaccattatggaaaaagtagggaggttcctaaagaaattaaaaatagaactaccattacttctattttgtaccaattagccatccctcttctgtgtgcatgtatatatatatatatatacatacccaaagaaaatgaaaccgcaaccttgtaaagatatcagtcggaatttttaaaagctctctaggggattctaatatgtgtgcatacagagatggagaataaaacagtgatcccaggggagggggaaggaaattgagatgtaggtcaaaggacacaaagtagcagccatgtataatgaaagagtttgggaactcatgtacagcatcagtactatataatactgtattgtattcctgacttttgctaaatgagtagattttagctactcttgtcatacacacaaaaatggataactatgtaagatgatggatgttactatgtctcactacagtaaccattttactatttacatgtattccataacatgttattttccttaaatatacacaataaaatgtattaagtaaataccctgactgaagaacaattatctcctaagagggacccaagcatatctactctctattctcatgtccagcccccttcagcctcatctcctattcagtcctttacccacagcacgatagctttacctccaccactacaatgaaaccagtgacttctaacagtcattgatgattgtaactttacaatcatcatcatacttaatggccactctccttcagcatctttacatctttctcttttatggtttctcctttaaatttttacattctctaagactaatttttagcccttttctcttctctttctatacaattcctctatgtacttttatccgtatctatggatacttcagttactctccatatggtaagaacacacaaatctgtttctccagcctttgcaatctcttgtgatgttccaggatcctatatccaactgccttctagacatctcacacttgccaatgatatgccctgcgagcatgttaaacacaggtccaaagttgaactcattctcttctccctcataccttcttcctcttctcttttcccactcacaacccagaaacctaggaagcattctaacattctccctctcccatatcttttacattcaaacagtcacaaagaccagcaaattctccctcatcttacttttcctaaacattctcacttctctattcccactacttccacctttatctaagctttcaacctctcttatccctactgatgtactgtccttgaaagcttccagtcttgccatgaccccacacccaaccccactctaccctcaatctacccagcacactgctttcagtgatcttccatgacactcacaattcttcagtggctcactactacacatggtataagaagtgtaccctgaactggctatccagtttcatctaggaagtgtaccctgaactggctaaccagtttcatctcctttcactcctgaccttgtccttcacactctaatataactgacctacatatagttcccagtatacactatgttctcgtaatgccacacaactactcatgctgttagctttacctagaaatgctttctattgcttgtcaacatgcccactcctactcagttttcaagtctcagctcaaacacaaccactactaaaacccttacctggtattgcaggcagagatcaagagctcttgctagatttcatttgtacttgtacctacctctgttatagcaaatagcatacagtatttgaactattggtcaagatatctgtagtcctacagactataagatccttggtcaaagatgacttttcatctttatatcctcctaactagttcaattcacacagtcactagttccatgtacattactagctcaatgcagatagatatactaaaaaaaggaggggcgaggttaatgaataaggtacgagtcaatgaaagaacaagaaaatcaactggactttgagtatagaaaaaaaaacaccagatcttaagaacgtacagacatctttagtacagacatctgttactgtagtacagatatccattactaagtcctaaccattaaaaaaaatagaaaaatatggttattcaggtagtatgaagatgacaaagaaaaaaacttattattggactaagtagacattaagaaggtaagagtttccagcggaacagttgacaaagatcaacagagaagccagagaaaaagatggttctttctaggaaacaagtaattcattgatctaaattcatggactgagcaaaagactgccacctttctctcagttcacaacccctctcctttgtcattattctgcatgaccccttctgagtcctcactaccaaatccccaataccatgggtagttcccctccaatggagccacaggtccaggccagtgacttaatctggatgcaagggcaagggatagaagggtatctttgttcttgtgtctaggactttgaggaaaaatgaaacaactatttactgagaatttattttacggcagattctgtgccacattacactcactcactgaatttcacagtaatcataagtaattatcccatttatagatgaggaatttgtgtccaaggtcaacagttaagcaataacaggccctgcctgaaaacctaagaatgacaacctccagagctttttctatacccctcactacctcaaaatggagggagacgtggtccagccattctaggttggcactcaggagacacttacctccaaaacactattatatatgttgattagagtctacagtaccactaatatataataagcacacaatgagtttaaaaagctttccttagtacctttaggaaagtaagtactagatttcctggggttctgatctggaaatctaaatgctatttattcctataagtacattgttaactttacaaacaacagacttgaaaatgaacttgtggaatacaatgggttcttaagtaaggcttttctttaagaatattttcttgcttccacaaaaaatacaaaagccaccaaagatagaatgattttgccttgttaacttgtaagaacaatgacactagaagaaacctatgggaaatgtgcttatctgaccaggtgctcattttcggtgggctgtcatttgactaaaacatcatactaaaccctacagaccacagcttatgagagaaatgccacaaactatagcagtacagttaatatgcctataatctactgacaaaacatactcctcagtaaagtgaaaccagatgtctggtgtgaaatcagatgtctgtgaacttgtctttctcagtttccagagcagtatcagatatactaaatacacagctaagctgtatattaaatccacaacttggcaaaatcatgacagtttggacatgaagcatcagcatttttattgtaatccttataaaccaaagacatttccaaaatggaaatcctaagtttaagtactcagctaaatacagtaatatgtctttctcactttaagaatagtgtcagggctttttaaacacattatagaaattctttcccttcatttttcaagctgacactctttatccaaggctgtggaatgatctgataaggccacatcaggtgtcagtcctcgtcccagaaattctaggatcagatacaccaggtgaacccctgtgaaaagcaaatcccagggaggcttaacagctataggaaagttaggcactacatggctttccacaatcaaaaggaagatcataggaaagtaatgggtgaccacatagaaaaacagggagggaaatttaaaagtaagtacttctatgccaggcactgttttttcacacattcttttatatatactctttgttctgttttgatggataagaaatcaagcagcagagaaattttaatggcccaaagtgacacagctaataaaataagagccagaaatcaagctcatgtccaaaagactgtaaaagtcatgctacttctacatgaagttgtggggtggagtgaggaggggtggtaaatagccaagaagaaggagaaaaagaaagaaatttacaattttatcaaataacagtgaaatatatatatataaaacatgtattatgttccacatatgttccatatataatacgcagttaagatgtatacatgtttaacatatacttaagctgcatatttagtatgtgtatatatggaacaaaaagttgaagaaacaagtatcaaattgttaagtggtcatctgaaagtggactcataggaaactcacttattgccttttataccctcccagatttaattctaaataacttttttttgactttttattactcttataaccagaaaaagacaaagaactattctagcttagatcttttaaatgaggctaaatgcacagaaacccatgcaagttaaaaatggtctactttcgaatttatttttctaagtacatcatcctttacactctccatgattcctaatattaggtccttcttatggaacaactacaaaagttatcctcatctaattattatactcgtacactggaaaatgactataacattattcattataggaaacaaatcatcaaggtcagccatccttgtaagtttattactgaaagtactagaaaggcggaataataattctgttctcccacaacactgtatagacctgcaaaccactatgatcagtagtacagggaaagtcttgtaaattaacatgtaactattgagaaaatccacaaaactggtgaaaggcctaccccaaaacagccatctccaatacaatctcatcattctcaccatcctacttttatcaaagtgctgataaaagtgcgtagcacatggtaagagagaattagctattgaatcaatgaaggaacccattatcaataaacaatcacttcctgttttccataaattatgtggtcacctatcacttgagcacaaacaaataggcacgttcaggacacaggcagccagtatcagaataggcagcctatcacagagggcaattctacttttcctgtgtaagaatccaagaatgcagttttactacattcctgcttgtagctaatctgaatttcaactaatttaaaacggttatttatatgtgacatataggatgcataatgagctcccaaccttgtgagaggagctgtgtttcatttcaccatacaggggagagggaagcagtgtattaaagaagtgatagaaaagtcccacagaagaaccaatgaaatagaccacactgaaaatcacagtaagcctcagagaacttcagtgtcctttttggcaacttttcaaaagtgaatggaatgcttgccaggaggtaccaagagtgaaagcccagagaaaaaggcccagcctggtcatctctctcccctcaaaacatcttcttctgtaagcttgagagatcccaaagaacttcaacacttgtaatcttgttactaactttatgctttggggtcctaaaggattttttcaggagtacccttttaaaatgtaaacatccctaggggggttactgttcattatcaaacaggacctggattctttagtgctatggtctcagggattagtcaaagctggctaataagataggggccggagacagacaactagagaggaccaatgttccaaggtaaaaacaggtaaaggggaagtgcagttttctgtcgggtcaaggggctaaaagggatccacatgcccaagctgttaaactctatagactgtgtgaggctgaaaacagtccggggcctggagcctgtgactttgaaggtgggtcctccagttcccgatgaaaaggtagaatctgggcccaagttccccacgagcagttctggacatctagcccttctctctctcgctcgctctcaggataaagtcctaggtccttccacccctgaccattccttacttaccctttctcccgctcttcctcggtgagaaggggtaagtggttattttgtgccctcgcccaatttggccaaaaccctaaaagtaaaaaacgacagacagacacgtgctttaaaatcatgttgttcaagcctgacgctctcccaccacctgcccaacacttccaggcagaaggcagcgcgcccccacagcgctccctcacggccagagccgggggccggactaggcccctttgtgaggactgggagagggcgcgttgttggggcgccggctcggcggggaggagcgggccagctccgggccaggtgtgccgcctgtggcgccggtttctcaacctagttagccagtggcaccaagaagaggactaggctggggtggccgccgcacgcgcctcagataaacacgcgcacgcacacatgctcgcgatcacgcaggactcgcggccgcgcacccctccgcctcccggcaacgcccgccccgccggggccggggccgactcccagggaagggtccccagcccaagagaccaccaagggtcggcggctacgcgcccgccgacccctgccagcctcacagccccccacccgccgccggacgccgggcgcccgccctccgcacccgctgcgcagctcagcccgggggaagtccccgcgcagaccccgccctccgccggcggcaagctccgccccgctgccccgtcgcgcgctggccgcccgaagctccgcccccggcggaaaactggtctctggaccgcccgcccaggtcgggctcaaaatgcggcgtggatctgaaaggatcaaacacaacactaattcagcaagctattattgagcacttgccctaagctcagcaacgtactaatgggggagactacaataaagagccgaaaagtctatgaaactgtgtcttcagctcttcctcttgttttagaagccaggaaacagagaaccctcacagttacttaagtacagggcagtagtggcaaagcacctcactagcgatctctgggcaactcttcatttcattttttcctactcatgagcactcaggaaaactattcagttttgctgcctccaggtaaaacaaagtgagtaacacaggacaggcggtttacttgagagaaacgggaatttcatactgaagcttttgccctcaaatggtacaaactctttttttttttttcctgagacggagtctcgctctgtcgccagagcgacactgcaatctccgcctcccgggttcacgccattctcctgcctcagcctccctagtagccgggactacaggcccccgccaccatgcccggctaatcttcttgtatttttagtagagatgggatttcaccgtgttagcaaagatggtctccatctcctgacctcgtgatccgctcacctaggcctcccaaagtgctaggattacaggcgtgagccactgcgcccggccgaatggtacaaactcttaactgggttattacaacctacaaagaaaccttcttatccatgttattaattatcctaattcaatgtggtttaaaatgttgatgaaagtacccaaatcatggtgctccaacaagctggatgccaaccaggtactcgtaagtacttgcaattacaggtgcgatattttcattccatatcatcccaagatgcccttccttcacgtgaagcagccagaaagatcaactaccagattccgcatgattgaggaattgataaatagaaagggaagaccgaaaccggccaaattttcccttcgaagtgaaacttgagaaacttgcgtgcattttacctgagttcctttctcagcagataaactgtcagacctcccagatagtgtcaaggaaatgcaactttccagaacactacatctggacaatgaggtgcatctgctgcctgttcacaaactcctcttccttacccctccataattccctgctatagaaagccctaactttagtctccctaagacatgtttgagactggtctccctgccagcatcacctgcattaaagcctgtcttccctggcaatactcgttgtctcagggactggttttctttgctaggagcaacccaacctaggctgaagcccaggcatttagcagcagtggcacctagaaatactgaacagacataaaatactttttttctccttttcttactcctccagttgtatcttcattatttctgtctctattctccctctagatactgccaaactactctgtgcactttcagatcacttaatactaatgtaaataacagacattctggcactcttggttcaaaatttattctaaaggtttaagaatctactcagggtcttaaatagcctgataactaaaattccaagagtttcctaaagagagcaaaattgctctcctgtgaaggggatatgtcccagtttttcttacttgtcactgaaataattactgcaaagtaagctcttttcggccagtgcttaaggacttaatttcaagagcacttaggtgacaggaccaccctcatcaaatagcagtcaagaactatttggtaccatgaccccaaattgaatggagctcctggtcactaggaactgacagtctgggatggaatgtaggtgaataaacaacaaagacaggtgtttatggcctttattgtattgggaagtcaataaacatacaaaaagagttgctaggtctggcctgattttatcactaagattcatcaagtgtacttaaaaagaagctaatatctggaaagggcagaactatggtatattagtcagggtttcctagagggacagaaccaataggatagacatataaatataaagaggagtttattaagtattaacttacatgatgacaaagtcccacaataggctgtctgcaagcttgaggagcaagagagccagtccgagtctcaaaattgaagaactttgaatccgatgtttgagggcagtaagcgtccagcacaggagaaagctgtaggctgagagactaggccagtctctccttttcatgtttttctgcctgctttatattcactggcagcttattagatggtgcccacccaattaaaggtgggtctgcctttcccagcccactgactcaaatgttaatctccttggcaacaccctcatagacacacccaggatcaatactttctatccttcaatacattcaagctgacactcagtattaaccatcacatatggagacagtaaaaagatcagtgattgccagaggtcacagaggagggggatatgaagcacagatttttagggcagtgaaactattctgtatgatatgataatggtgatgcatgtcattatacatttgtccaaacccataaaatatacaacccaaagagggagccttaatataaaatctcaactttgggtgataatgatgtcaatgtaagttcatcaattgtaacaaatatactgctctggtacaggatattcatagtcagggaggctgtgcagatgtggggtacaggaatatataggaaccctatacttcctgctcaattttgctctgaacctgaaactgatctttgggagaaaaaagtttatgagaaaaagaagcagcagttagagcatcctattttattctaatttatcaattaaattctaagctgaatatttggctttatgtatctagttcaaatatatttgccttgtctccttatatattaaagcagacctctatttgttgttaataccatcaggggaaaatgaatcataaagtcctaactaaggtacaaatttaaactatagttaggcatcaaatctaatggtcaaagagatatttaaacaaagttaaaataattaagtttacagattccacaaatatagatattaaaatatattcctatctatacatacttaccattggtaagcaaataatagaaggtatcatagagtagcagttctcaaactactttttgatctcaagttctctttacattcttaaaaatgattgagaactttaaagagctgttgtttatgtgggttatatatgtccatatttactgtattaaaatttaagatagaaaaatgttagacatgtgtttgcttaatttaaacccattacatgttactgtaaaagttatttttataaataatgactactttttttccaaaaaattagagaaaagtggcatttttaacattttataaatctcttattatctggcttaaggagagcactggattctcatattctgcctctgcattcaggctgttgtgatatgttgttatacctaagatatgaagaaaattaactgtcatacgaattcatagttgaaaaagagaggaccttacaaagctccgggaagggtttcagtaacccctaggtgttctcaaacctcacttggagaattactgccaaatggccttttgcatttcatttgtttgaatgtcatatatttccacacaggcttctgttaacacctgaaattatagccctttacttatttcaagctaaaactcatatttgtcagctcatatcaaaccatgacatttcaataaagtttttaaaagcttttactatagcaactctgatgaaattgatattattatttgaattgatatgaaaacacttgagatttcatttatatccttcatctcaaacgttttggaaaattttgaatataaattgtaccatctggaaaaaatgtaagattggtatatagttattaatccaattttaggtatgcttataacaaggtatatccccttttataaaaataatttaaaagcgagcttaaaacaaaaacaaaacaagcaattacagttttatttatgaactaaatacttgattctaaacttactaccttggaataaaattttaaatatataacctttcatttttattacaaataaaaataatgtaaatcatccagtttggggttttttaatacaatttccaactaaaagaaactagagctgaccaaccaaatgtctgacttcagatctgggtcaggttatacacaagatgagcataggataacttgtcccacaaagccgggaatccattaacaacaaaatgtgtcaaagggacacagaaaccaatatcaaatagctcctttggccaaagatggacaatttaagcatcaaaaaaagtaatggatgcagttgttagaaacatactgaatatataaaaattcatgagttcttaatgatgttccaaaaaggggaggtcaataaaaggaaaaaaaaaatccactggacactattgcaagtagctagcattaagcccttattctaaaattgtccattaaaagaaaataattcaaattttctgatgtatctttcctgattaaactatatatcagaaaaccaaattggtgttgagggaaagttgttttttataataaatatgaaacaacagaattggaaacccaccatttagcaatcttgcatttaataaatgattcaggcaaccatcatcaatggatcaaaccaacagatgaaatgttcatgaggaacttcacaatggagatcagaccgtcactacctcagcctaataatctgtcattacaagtgggactccagacattgtgtgcttcctgatctaatgccatctgaagcactcagcacaactatgaaatgttatcacccaaaaaacatgaatgggatctaatcaagccttaaaactgacttctcacttacaggcttacaaaaaacatgagggttacaggaataagttaaatgacaccacaaagaggctgggcgcagtggctcgcacctataatcccagcactttgggaggtcgaggaaggtggatcacttggggccaggagttcaagaccaccctgggtaacatggtgaaaccctgtctctactaaaaataaacaatgagccaggcatggtggtgcgtgcctataatcccagctactcaggaggctgaggcaggagaatcgcttgaacccgggaagcggaggttacagtgagccaagatggcaccactgcactccagcctggatgacagggtgagaccctgtctcaaaaaaaaagaaaaaaagatgccacaaagaaggaaacaggtaaatctagaatggagtagaatggaggacactctctaggacaattgatgtagtctctacaacaagttaataactggacacacaggagagggaatgggtcaggagaagcctaggttaaaaaaaatacagccatgaaatgtaagatgtgaacctttatttggatcctgattgaaacatcacaactataaagacttgtaagacaatcacggacatttaactatggactggtgttagatgataccaaagaaatattattttattaggtgtaataatggcattgtgattatgtaagaaaatgtccataatttttggagaggcattctgaagtatgttgaagttaaatgacatactctctggaatttactttatacttcaacataaaaaaaaagaaggaagaaaaagagatagcataaataagaaaataaaatggataattattgaatctagatgatgaggggagttctttgtacttttccatggttttcgtatatgtatgaaattttgtataatgaatatttaaaaatataagtgacggccgtagctcagattttctagaaaacagtgcctgagacaagctcacatgttaaaattttcttgggggttgcagtactagaaaagcaataatgaaggaaaagggagaacagaggcagggacagagggaggaagatccatggtggtatgtttccaagctgattatagcatcccagtacatgcagttggttgcttagtcacacaggacatctcaagaaggctgtgtgaaaccactgggtaacaatcctccctcaggaggggaaaggttaaggcactttttttaactggatccttcctgccttctgtctctcattcatcaatgtttgttccataaagcagggcaagcatgtgggggaaaaaaggttgggggcagggaagtgaaaatgggttttatgaagtgactgagatttgtttaatctcacaatgtagaatttaaacaaatcagtgacttttgggtttagtgaagacttacctataattttagcctttttgaactagaataatcattctgcttgactttcttattacatcagtaaataatttattcaggtcaaagccattatttttgattaacagaaatcacagtcacataaatggctacagaaactaaatataggagaagggttctaccacagtgacctgaacatttgcatgcgcccttgcacatctccacaaaggccacatcagcaagacttgactgcagctgatctaagtcatggtggaattctgttgattctcctacaacatgagatcatgagaggcttgttaagagctgacccaaggccatttctcattcacctcccagtttctcattgcctcctgtgttttgaggaggtatgacactttctgcctcattctccctagaatacagcctcaggctgtaaaactgcttagctgaagcatgacattggttcctcaggaacagggtgccctatcatccaggttgtggtcatctggcctcctttgtatcagtgtcaccctgtgcaagggataccagagctggcatctttggctactcttgcttttgctttccaagtaagtaataaactgtctgaatctaaaaatggcaactcattgttttcttactagctgaatctatcacccttgccttaccttgacaaattctaggcaagaaatttttactttccttaatgctaaagaggtcctttactctttcctctttgtattttgctcagcctacaaagttagtagccagtaaacaaactgatatgaaaatatgaaagacttagattcacatttttagaaagagtaactgttctctaagtattttaggataatttttggccaacagttaaaggagccttccttctcctggccttgccttcaaattaattaataggctattcttacaaggcaggtcaagattcagtcctcttaaaaaataaagaccaatcagaaggattttcaacaaagtccctttattttctactcacacttaaacactatagttggtagggttcaaaaagtctgggaaagagggagacgaagcaagatggtgaaatacaaagctccacgaatcgttcccactaacccacaccaagttaacaactatctacatggaaaaaaacaccttcataagaacaagaaatcaggtgagcactcatagtaccttgctttaacttcatagtgctgaaagaggcaacaaagagagaaaaaatagtactgaattgccgatgccaccccctattcctccccgaccccaggagcagcatggtgtggagagtgtccttgggtgctgggggagtgagaacacagcaattgtgcggcgttgaactcggtgctgtcttgttagagcagaaaggaaaccccaaactcagctggtgtccacccacagagagaacatttaaactagccctagccagagggggacttgagtgcctgcaaacctcgccacccagggctacagctgtctgtctccaagtaaacttgaaaggcagtctaggccataaggactacaactcttaggcatatcctagtgctgaagtaggcccaggacagtggactggtggggcatgtgacatactgagacactggataggtagtcaaggaagtgctggcctcacccctctcctaacctcaggctgcacagtttgcagctccaaaagagacaccttcttccacttgaagagaagagagggaagaacaaggagaactttgtcctgcatctacggtacaagctcagccacaacaggatggggcaccagatagacttgcaaggctgcaaggcccctgttccaggccctagttcccagagaacatttctagacacaccctggaccagaagagaatggcttcaggtaacagcccagccacagtgggtagaaaatcaagcaagctctcgaggtccctgattctaggattttactcttgaacagcatttccggacctgtcctgggccagaggggtgtccactaccctgaagggtgagtcccaggccaggcagcattcatgacaagctgacttaagagctgttgggcattaagggaacatcagtggtagtctggcagtactcttcatggcccaggatggcagtggctatagggtaaggctcctctgcctttggaaaggggagggaagagtgggaaggacagcatcttgtggtttgtttaacagctcagccacaatacaatagaacaccaggtagacttctaaggtttttcactctagtctctgactcctagacaatggcacttctgtacccactggtgggctgggggaccttccctccctgaagggaaggacacaggcctggctggctttgccatctggtgatagtagagccccagggtcttcagcaaacataggcagtagccagggggtggttataggaggccttggtcaagtaccagtgctctgctggcttcaggtctaacccggcacggtcttagtggtggtggccacaggggtgtttgtgttactccatccctagctttaggtggcttggaacaaagacagaggctgtttgggagaaagtaagaagaaaggaacaagagtctctgccttgtaatctagagaattctcccagattttgtccaaggccatcaaagcagtactctgtgagtctgcaagaatcatagcattactgggtttggggtgctccctgaagtacatcacaacactcacgtccttgtagatcacaacacccaagtcctttcaaatatctggaaagccttcccaaagatggctataaataagcccagacagtgaagactatagtaaatatccactcttcaatgcccagacaccaaagatcatctactaggatcaacactattcaggaaaacatgacttcatcaaatgaactgaataatgcaccagggatcaatcctagagaaacagagataggttgaagaaactcaaaaacattcaagataacacagagaaggaattcagaataatatcagataaatttaagaaaaagattgaaataactaagaagaatcaagcagaaattctggaactaaaaaatgcaattggcagactaaagaatccatcagagtactttaatagcagaatttgtcggggaatttgccctgatattcacgtaggttcttttctatttttccgaagtgtcagccagtttgagaaataaagggacagagtacaaaagagagaaattgtaaagctgggcatccgggggagacatcacatgtcggtaggttctgtgatgccccacaagccacaaaaaccagcaagtattttttaaggattttcaaaaggggagggagtgtgcgaataggtatgggtgacagacatcaagtacttaacagggtaatagaatgtcccaaggcaagtggaggcagggcgagagcacaggaccacaggaccgaggtgaaattaaaattgctaatgaagtttcaggcaccattgtcattgatagcatcttatcaggagacagggttttgagatcaaccggtctgaccaaaatttattaggtgggaatttcatcttcctaataagcctgggagcgctatgggagactggagcttatttcatctctgcagtttcgaccataagagacaggcacaccttgcgggggctgtttataagcctaaaactccaggcgtgtattctctttctcagggatgttccatgctgagaaaaagaattcagcgatatttctcccatttgcttttgaaagaagagaaatatggctctgttctgcccggctcaccagcggtcagaatttaaggttatctctcttttttcctaaacattgctgttatcttgttcttttttcaaggtgcccagatttcatattgctcaaacacacatgctctacaatttgtgcagttaatgcaattattacatggtcctgaggtgacatacgtcctcctcagctgacaggatcaggggattaaagtaaagacaggcataggaaatcacaagggtattgattggggaagtgataagtgtccatgaaatctttgcaatttatttttagagattgcagtaaagacaggcataagaaattataaaagtattaatttggggaactaataaatgtccataaaatcttcacaatccacattcttctgccatggcttcagccggtccctccttttggggtccctgacttcccgcaacaagaattgatcaagcagaagaaagatttagggagcttgaagacaggctatttgaaaatacagccaaaggagaccaaagaaaaaagaaaaaccaatgaaacatgcctacaggatctagaaaatagcttcaaaagggcaactctaagagttgttgttcttaaagaggaggtagagaagggaatacaggtagaaagcttattcaaagggacaataacagagcccaaacctagataaagataacaacatccatgtacaagaaggtaatagaacactaagcagatttaacccaaagaagactacctcaaggaatttaataatcaaactcccaaaggtcaaggataaagaacaaatcctaaaagactggtggctttgcatggtggctcacatctctaatcccagcactttgggaggccaaggcaggcatatcacttgaggtcaggagttcgagatcagcctggccaatatggtgaaaccctgtgtctactaaaaaaaaaaaaaaattagccaggcgttgtggtgggcacctgtaatcccaggtacttgggaggctaaggcaagaagaatcacttaaaccgaggaagtggaggttgcagtgagccaagatcatgccactgctctccagcctgggtgacagagtaagactctatctcaaaacaaaacaaacacacacacacacacacacaaagcaagagaaaagaaacaaataacatatgacggagctccaatacatctggcagcagacttttcaatggaaaccttgcaggccaggagagagtggcatgacatatttagagtgctgaaggaaaaaaactttaaacctagaataatatattcagtgaaaatatccttcaaacatgaaggagaaataaagacttttctacacaaagaaaagctgagggatttcagcaataccagccctgtcctacaagacaagatgaaatgctaaagagactatttcaatcagaaaggaaagaacattaatgaacaataaataatcacctgaaaatacaaaactcactggtaacaataagtacagacacaaaaaaaaatgttgtaaaactgtaactgtggtatatgaactactcttaccctaagtagttgaagactaaacaatgaaccaatcaaaaataataactataacaacttttcaagacatagtaagtacaataagatataaatagaaacagcaaaaagttaataagtggggaaacaatgttaagtcatagagctttcattagttttctttttgtttgtttatgcaaatagtattaagttgttatcaggttaaacataatgggttataaaatagtattagcaagcctcatagtaacctcaagccaaaaagcatacaatgtatacacaaaagataaacagcaagaaatcatatcaccagagaaaatcaccttcaccagaatacaaataacacaagggcaggagtaagtctttacttatcaaaattaacattgtatgtaatagactaaactttccaatagaaaaacatagagtggccgaatggatgaaaaaacaagacgcattgatctgttgcctacaataaacacaactcagctacaaagacacacatagcctaaaaataaagagatggaaaaagatattctgtgacaatgaaaaccaagaaagaacaggagttgctgtactcatatcaggcaaaggatatttcaagacaaaacctagaagaaacaaaggtcagcatataatgataaaggggtcaattcagcaagaggacataacagttttaaatatatatgcacccaacagtggagcacccagattcataaaggaaatattattaccactaaagagagagatagaccccaaggcaataatagctggagacttttacaccccactttcagcagaaagacagatcttccagataaaaatcaacaaagaaacatcagattaatagacatttacagaccattccatccacgagctgcagatacacattcatttcctcagcacacggatcattctcaaagatagatcctatgttaggtcataaaacaaatattaaaacattcaaaaaattgaaataatatcaagcatcttctctgaccacaatggaataaaactagaaatcaataagaagaattttgaaaactatacaaatacatggaaattagaccatgtgctcctgaatgatgagcaggtcaatgaagaaattaagaagaaaattgaaaagtttcttgaaacaaatgataaaggaaatatgacataccaaaacccatgggacacagcaaaagcagtactaagagggaagtttatttatgttggtgcaaatgtaattgtggtttttgccattaaaagtaattaaaagtaatggcaaaaccacaattatgtttgcaccaacctaataactataagtgcttaaatcataaaacaggaaaacttcaaataagcaatctaaggatgcctcttaaagaactggaaaagcaaaagcaagccaaatccaaaattaggagaagaaaattagtagaagaaaagaaataataaagatcagagtagagataaataaaattgaaatgaaaaaaatacaaaagaccaatgaaataaaaagtaggttttttgaaaagattaacaaaatcgacaaacctttaaccaaactaagaaaaaaagagaaagaaatccaaataaataaaatcagaaatgaaaaaagagacattaaaactgatactacagaaattcaaaggcccattagtggctactatgagcaaccagatgccaatgaattggaaaatatagacaaaatgaacaaattgccagatacatacaacctaccaagactgaaccaggcagcaatccaaaacctgaacagaccaataacaagtaacaagattgaagccataataaaaagtctcccagtaaagaaaagactgagacgtgatggctacactactgaattctatcaaacttttaaataagaactaatgccaatcctactcaaactattctataaaatagaagaggagagaagacttccaacctcattctacaaggccaatattaccctgataccaaaagtagacaaagacacatttaaataaataaataaataagtaagtataagccaatatctgatgaatatcgatgaaaaaattctcaataaattccacgaccaagtggaatttattccagggttgcaaggatggttcaacatgtgcaaatcagccagtgtgatgcatcatatcaacagaatgaaggaaaaaaaccacatgatcatttcaattcatgttgagaaagcatctgataacattcaaaatccctttatgataaaaaccctcaaacaactggggatagaaggaacatgtctcatcataataatagctatatatgacagacccacagcaagcatcaaaatgaataaggaaaaactgaaagcctctcctctaaggtctggaacatgacaaaggtaccctctgtcaacagtgttattcaagttatactggaagtcctagatagaccaatcaaactagagaaagatgtaaaggacattcaaataggaaaggaggaagtcaaattatccttgtttacagatgatattatatttggaaaaacctaaagactccacaagaaaactattagaaatgatcaacaaattcagtgaagtttcaggatataaaatcaacatacaaaaatcagtagcatttctatatgccaacagtgaacaatgtgaaaaacaaatttaaaaagtaatcccatttacaataaccacacataaaattaaatacctgggaattaatttaaccaaagaagtgaaaaatctctataatgaaaatgataaaacaccaattgaagaaattgaagaggacaccaaaaaaatgaagaaatattccatatgcatggatttgaagaatcaatattgttaaaaggcccatactacccaaagaattacagattcaatgcaatccctgtcaaaatatcaatggcattcttcgcagaaatagaaaaaacaatcctaaaatttatatggaaccacaaaatacccaggttagccaaagctctcctgagcaaaaggaacaaaattggaggaatcacattacctgacttcaaattatgctacagagctatagtaaccaaaacagcatggtactggcataaaaacagacacagagaccaatggaacaaaatagagaacctagaaaaaaatccacacatctacagtgaactcgtttttgacaaaggtgccaagaacatacactgaggaaaagacagtctcttcaataaatagcactgggaaaactggatatttaaatacagaagaatgaaatttgacccctatctctcaccgtatacaaaaatcaaactgaaatggattaaagacttaaattgaagacctcaaactacgaaactactgcaagaagacagtggggaaaatcttcaggacattgggttgtgtaaaaatttcttgagccatactccacaagaacaggcagccaaagcaaacatgggcaaaagggatcacatcaagttaaaaagctcctgcacatcaaaggaaatcagcagagtgaagagacaacccacagaatgggaataaatatttgtgaactccccatttgacaagggattagtacccagaatatagaaggacctcaaacaactctataggagaaaaaaaaatctaataattcaatcaaaatatggaccaaagatgtgaatagacatttttctttattttttatttttttacttttttttaaaattatacttcaagttctagggtacatgtgcacaatgtgcaggtttgttacatatgtatacatgtgccatgttggtgtgctgcacccattaactcatcatttacattaggtatatctcttaatgctaaccctcccgactccccccacaccacgacaggccccagtgtgtgatgttccccttcctatgtccaagtgttctcattgttcaattcccacctatgagtgagaacaagcggtgtttggttttctgtccttgcgatagtttgctcagaatgatagtttccagcttcattcatgtccctacaaaggacatgaagtcatcattttttatggctgcatagtattccatggtgtatatgtgccacattttcttaatccagtctatcattgatggacatttgggttggttccaagtctttgctattgtgaatagtgccacaataaacatacgtgtgcatgtgtctttgtagcagtatgatttataatcctttgggtatatacccagtaatgggatggctgggtcaaatggtatttctagttctagatccttgaagaatcgccacactgtcttccacaatgattgaactggtttacagtcccatcaacagtgtaaaagtgttcctatttctccacatcctctccagcacctgttgtttcctgactttttaatgattgccattctaactggtgtgagatggtatatcattgtggttttgatttgcatttctctgatggccagtgatgatgagcattttttcatgtgtctgttggctgcataaatgtgaatagacatttttcaaaagaagacatacaaatagcaaacaggcatatgaaaaggtgctcaacataattaatcatcagagaaatggaaatcaaaactacaatgagatataatatcatcccagtcataatagcttacgtccaaaagacaggcaataagaaatgctggtgaggatatggagaaataggaatccttatacactgtttctaggaatgtaaattagtacaaccactgtggagaacaatttggaagttcctcaaaaaactaaaacttgagctactgtgtgattcagcaatcccactgctgggtatataccaaaaagaaagaaaagcaatacatcaaagagatctctgcactcctatgttggttgcagtactgtttataatagctaagatttggaagcaacttaagtgttcatcagcaagtaatggataaagaaaatgtggtacatataaacaatggaatactattcagtcataaaaaagaatggaatccagtcatttgcaacaatatggatggaagtggagatcatttgtgaagtgaaataagctaggcactgaaagacaaacatcacatgttctcacttatttgtagaatctaaaaatcaaaataattgatctcatggagatagggagtagaaggatggttaccagaggctgggaagtgtagtgggagggttgggggaggtggggatggttaatgggtaccaaaaacattagttagaaagaatgaataaggctgggtgtagtggctcacacctataatcccagcacttttggaggccaaggcgggcagatcacttgaggccaggagttcaagagcagcctggccatcatggcaaaaccctgtctctactaaaaatacaaaaattagccagggtggtggtgcacagctgtaatcccaggtactcaggaggctgaggcatgagaatcacttgaacccaggaggtggaggttgcagtgaactgagattgcatcactcactgtattccagcctggtgacagagggagactctgtctcaaaaaaaaataaaagaaaaagaaaaagagaaagtaccctaaaacttaaaatataataataataaaataaaaaataaaaataaaaaaagaaaaagagaaaagaaaaagaataagacctactatttgatagcacaacagagtgactcttaagtcaataataacaaacaattgtatattttaaagtaacttaaaaagtataattagattgtagctcaaaggataactacttgatgggatggatacaaaaagtttataggaataaataaagcaaattttgaactaacaaaaaaagataggaaaagctagaataaaaaagagaagcatcaaagatcaagctccatagacatgccctactcagattttcacaggtaggtgatctgcctctgtcttttatatacaagatgattgataatgatgttaaccaattacaactttgcctttcttatttggtacactgagaggcagggttcctctcttcttttataagcttataataaagtagaaaacagaaaaataagtgagggcaaaacataaaagctagtgaatatctcatctttttcatttctttatcacaacatatgtagattatctcttggtaatggaaatacataagccttgctaaatgactatcctagtaatagttgaccaaatccttagatccatgaatgaaggaagcagttatgtaggagacccgggcctgcctcacattttgtccagggatttcctggtactctacagtgggggtaaaaaaacgggggggactggttttgattgactttttattgataatcctgagatatctgaaagaattccttaaattatctaatgaattagccagataacaattacaaaccagcaatttatagtaactagtaatgggagaaacaattcaaaataaaaccacacatggtaaaaatttgttgaaataaaaaccaacccaagattcatatcttcatatcttcttaataactataaaaaccaaaaacactgagagagtagatttagctggaataataaacacaaaataatgaagcaatggctaagcctgcacatgatcaaaatatattattgactacagttaacaaattctattttcattcatctgagaatgtctttatttcccactgatttctgaagcaatatattttcatcagatagaattgacagttcttttctttcagtacttgaaaatgttttgttattaatacttccttttcgcctccagatgagaaatctgctctcactcaaattggtgtacccctctataagttatgtgctgtttccctctggatgctttcagtactttatttgtctttactattcaaaagtttaattgaaatgtcttggcatggatttctcctatttggggttcactccatctcctattgtgtccggaattggtgagttcttggtcttactgacttaaagaatgaagccgcggaccctcgcagtgagtgttacagctcttaaggtggcgcgtctggagtttgttccttctgatgttcggatgtgttcggagtttcttccttctggtgggttcatagtctcgctggctcagaagtgaagctgcagaccttcgcggtgagtgttacagctcttaaggcggcgcatctggagttgttccttcctcccggtgggctcctggtctcgctggcttcaggagagaagctgcagaccttcgcggtgagtgttacagctcataaaagcagtgtggacccaaagagtgagcagtagcaagatttattgcaaaaagcgaaagaacaaagtttccacagtgtggaaggggacctgagcgggttgccactgctggcttgggcagcctgcttttattctcttatctggccccacccacattctgctgattggtagagccgagtggtctgttttgacagggcactgattggtgcgtttacaatccctgagctagatacaaaggttctccacgtccccatcagattagttagatacagagtatccacacaaaagttctccaaggccccaccagagcagctagatacagagtgtcaattggtgcactcacaaaccctgagctagacacagagtgctgattggtgtgtttacaaaccttgagctagatacagaatgccaattgatgtatttacaatccctgagctagacataaaggttctccaaggccccaccagagcagctagatacggagtgtcgattggtgcactcacaaaccctgagctagacacagggtgctgattggtgtgtttacaaaccttgagctagatacagaatgccgattggtgtatttacaatccctgagctagacataaaggttctccaaggtcccaccagactcaggagcccagctggcttcacccagtggatctcccaccagggatgcaggtggagctgccagccagtcccgcgccatgcgcttgcactcttcggcccttgggtggtcgatgggactgtgtgctggggagcaggaggtggcgctcatcggggaggctggggctgcacaggagcccacggaggcaggggaaggctcaggcatggcgtgctgcagtcccgaggcctgccccgcgggaaggcagctaaggcccggcgagaaatcgagcgcagcgccggtgggctggcactgctgggggacccagtacaccctccgcagccgctggcccgggtgctaagtccctcattgccccgggccggcagggccggccggctgctccgagtgcgggacccgccaagcccacgcccacccgaaactccagctggcccgcaagtgccacatgcagccccggttcccgctcgtgcctctccctccacacctccctgcaagctgagggagtgggctccggccttggctagcccagaaaggggctcccacagtgcagcggtgggctgaagggctcctcaagtgccgccaaagtgggagcccaggcagaggaggcgcccagagcgagcaagggctgtgaggactgccagcaggctgtcacctctcattatatctataggtttatatcttttgccaaatttaggacatattaacaaattatttcttcaaataccttttcagtctcactctttctcctgtacttctgaaactccaataatgcaaatgctagctcttttgttattgtcccacaggttcctcagtctgttcaattttttgttctagtctattttctctattgttcaggttgggtaaattgttattatcattattattattgtagagacagggtctctgtgtgttgctcatgctggtataaaacttctgggctcaagggattctcctgcctgagcctcccaaagtgctgggattacagacataagccaccacacccagtcaggttggataaattctattgatgtgtcctgaagttcatcaattctatctttagtcatcttgactctactattgaacccatccagcaaattttttatttcattgctttatgttttagttctataatttctatttggttcttttttaacttatttatttgctgagatattttattttttatttgtgtcaagagaatttgtaattgctggttaaaacatttttataataactactttaaaatccatattagatcgttccaacatctgattcatcttgattttagcatctgttgattttcttttctcattcaaattgtgatcttcctggttcttggtatgaggaatgatgttcaattatattctggatattttggatattatagtataagactctggattctatttaatcttttttaatcaggtaggcctcctgttggggtgtagcaagaaggcaggtgattttgtatgtttggtctcccagtgggcccaccaacaccttccagacaaacatgcagtacttattcatcctgtccagatgtctatgggggggcggggtggggggcgggggggagggtattcattttctagtgctgccataacaaaatgcgacagattggatggcttaaaaaacagaaatttgaccaggcgcggtggctcacacctgtaatcccagcactttgggaggctgaggtgggcggatcacaagttcaggagtttgagaccagcctggccaacatagtgaaaccccgtctctactaaaaatataaaacttagcctggcatgatggtgtatgcttgtagtaccagctactcgggaggctgcggcaggagaattgcttgaacccgggaggcagaggttgtggtgagccaatattgcgccactgcactccagcctgggcaacagagtgagatccgtctcaaaaacaaacaaacaaacaaaccaaaaacagaaatttattttctcacagttatggaggctggaagtccaagatcaaggtgttgacagggttggcttcctctgaggcctctctccttggcttacagatggccacccactcaccgtatcctcacatagttgcccctctgggtacacatgccactggtgtctctatgtgtgtccttatctcctcttcttattaggaccccagtcagattggattaagggccaccctaataacctcattttaatttaatatttcttttaggaactatctgtaaatacattcacattctgaggtactggggattagagcttcaacatatgactttaggatgggaaacacaattcagcccacaacatgtgagttggaagttcagctaccccttgccctgttgacaccttcccagtcaaagtgagatattcgctcacacctctaagttcaggtgccactagaaaggtggaagcagatgattgattcacaccattttattacagcaggattggggtagaaattaggttctcaactctctgctgggcctccctgatgccagaggaggagagggagacaagcaaagtgccaactatccctgcctctaccgctttgttctgtctcattgatgccaggtggaagtgaagactcagcaacccactgggccctgcctacatggaggtgtgggggtaagtggagtactgaccagacttgagtcacacgacccagttcagttgttgatgctggatgggagtggagtctcagcttcctattggttaccactgacactagactgaagcataactgtgatgagccctgcatcccaccgtctctttgagtctcactgtgggtgcaagctcagctcattgctgcaccctgccaacacaaggtgagggatagaaaaccagatccctgctcagccaggcaaagccaccctgagtgggatcacagtgctgctgcctgcctccagtgagtggagtaaaaaatcagcctcctgtcctattctactcaaactttgagaaagggagggtgcagttgttacactggtatttgccctgagtagggcaggtatcgccaaaaagttctggctacggggaacgaacaggctcatcttggggctttttgtgtatgtttgttagtggctccaagttgaaagcttctgcaggaccctgtctggaatatatgagaggcaataaggaaatccagggaactcagtgccatgtcattccttgggtccccaggttcctaagtagttcaccttcttcttttcagtgttagagtcttcctgtgcttgtttgttgagttatggccagggtttttttagttgtaagaaagagggtctgggaggaatgaggctacttccatttgcccagaaccagaagtcctccttataaacactttaatagaagaaatgcaaagaagatagggatttttatggaatattccaacataaaatcagcaactgatctaaaacctgaattatcaaaaggaatatcaatttctaaaaccagggcaagctgacaaaataaagctgagctatataaaggtatgtgtgctgtaatactcaacttcaagatgcttttggatgagctcaattcaactaacatcaaaacaaaaggaaataaatttttctacattcggaatatttgtcacaaaacaaagaccaacactatcagatagggcaattcatgttttgtgtgttttaaatttttattttaagaataacttttaaatatttgtaacagctttcaattttttaattgattttatttggtgttagtgatacttttttagttttttctatcatcaggtatagatcatttttacatgttattaaaatacataatctcatcaaatgcagttaatattgtatttttatttttatagaaaacctctgaaacttttagcataattctatcatcaaaaatgacacaccactattattgtggtcacttatcaaaatttgaaaacacaggctcagcacagtgggtcacgtctgtcatcccagcactttgggagacagaggtggctggatcacttgacgtcagaagttcgagaccagcctggccaacatggtgaaaccccgtgtctactaaaaatacaaaaattagccaggcgcgttggtgcgtgtctgtaatcccagctactcaggaggctgaggctggagaatcacttgaacctgggaggtggaggttgcagtgaggcaagatcgtgccactgcactccagcctgggcaacagagcaagactctgtctttaaaaaaaataataaaaacatgtaaatatcacaaaaaaaaataggatgaattctgttttgagaattcccaggaatttgtattttttttaacctgaatcctgaagatatttgtcagggatttagaaacactataaaaggcaaatactgtcccaattaccttattaacaaagactttttctttttcaatgatcaagacttaatcaaaattgtttttatctcttcagtttatatgtccagacttacttggttattacaggcacagtgatgcagtgaaatcatgacctatacctaaacagcctgaaaatattcagcctataaaagaaaagacttaggtgagaatttaatagctgtcctcataaacttcgagagctctcctgaacaagagggattgcatttgttctgtatgacccaagaggaaagaattaggataaatgagatgaagttacaggaaagaaaattttgacttactatatatatccactttctagcaactagagaattctgaaatgagagcagactccctcaagcaatagtgatttcttgtcaaggtaaaaggctggacgaccatttatcggggatattatcaaaaagactcagtgtttgtgattttttttttttggtgtgtatcatctcattttgttctccaagtgacacacatagaaaatgtatttaaatggctatgtatgaatgaaaatagtaaagttcagagggtatattagttaggattctttgtaaattataaagcaatttgagctagcctgagcaaaaacaaaatacagtataagaataaatggtatttcacagaacctaaggccagtgtaatgcagctgtctctagggtcggactgaggccaaagctctctctctctctgtatcttcaccctgtttctctctaacaactgctttgttctctatttctgcagatgtattttctatgcttcccaaccacataatgggtaggagatatttatgccacagatccccaatttacatctctatcattcaagggaccagtccagaatgattgggtgcctaaattattctggactttatgcagccaattaatcacattattctcccttctgaatgctaagccaattaagaaatagccacagtaaaactggatgggataatgtggcttaaacttgaggccaaaatgtacttttctgcaactttcctttgcctttgaattgaattcagccagtccaggcagatatccagattgcatctcaggagatggcctgatctggcggcctgacctgacgagcttatcagatgggaaagacgtccaggaggtgagcacattgcacttgcacatatgcaaaaggagaataaaggatctggtcagacatgtgcaatgaccctttactgaaacctactaattaagtaagtcactccaccaactccctcagggttgagttgctgaaaaacggagataagggcagaaactttcctcataacattttcaaagatattttatacgatggactaaggtaggaatgtgcagatgggaagagaatagccttcccgcaattaccaattcttatttctggagatagggaagttaactcacccactttgaaccagttattcatctacgtccaatcaattatggttttaggagagtctctcgatgcataaacagcatggccaggggacaaccattacagataggacaggcgatttttggtaaaagatggctagacagatacatgaataagtacactcagaatgcatacacttcttcgtttacattataaagttattcttgactcataatatccagctacctcacgttcaaatgcaaatacacacaagtacacacacactcattcacacatgctctgcagtggaggactacccaagtaatgagtggataatccattacattaggaagtgatgttgccttgaggtcactgctcttcctgtgtaaaatttctggatgaggtccatttcctccccgaatccagttttaattttgttctcattttcttaaaatttagagattaaattacaaacgtaaccactctcaatatatctaatatacaacacttggggaaatggccatatagagaaatagcgacggaaagaaagctccacatagtggtcactggtctgtgatttattctgctggacagtggcagtttgaaaagcttgaaagaacaggtgacttatttgggcataattttgactcactcctttggcgtgtttcttgaccctatagtgaactttcagtttgtgttatttcttctttggattgtgtctgaaaatttcctaagaattgactcttctggtatgagtcaactatgggtccctttcaccagatttagtatttttcactgacattttcattcttgtaaaacatttctggttggctctcacatccattttggactccatttgctaaaatccagcaccacaaatcttgttaggtcatgctccaaattgaatagccaggacttgttcactctactcaggcgtatgttctgttttgttcgtttttgaagtaagtctgaaggtttcaccatccatatggtctttaatacatgaattaaaaactataaaattagctgggcgtggtagcaggggcctgtaatcccagccactcaggaggctgaggcaggagaatcctttgaacctgggaggcagaggttgcagtgagccaagatcacaccattgcactccagcctgggtgacaaggaaagattctgtctcaaaaaaaacaaacaaacaaacaaaaactatagcctggccgggtgcagtggatcatgcctgtaatcccagtactttaggaggccaaggtgggaggatcacttgagcccaggagttcaagaccatctgggcaacatagcaagaccccatctctaaaacaacaacaacaaaaaaaactatggcctgatacgaggtagctagcataacagaactccttcctttcttatcagctatggaaatattgtccctattctcctattttagctagtgagaaggactttggaaggatgggggtgggaggtagaagtatggtcagtctttctccactcttctgcttcttccaggatattcccattcctgtttccaggatcttgcgttttcttggtccagacatttatttatcctaactacaaaaaggagagtcaactcagaacttgactactgcaattcacatttccttgatttatttcttcatcagtacctcagcaattgattgattaattgattgagacagtcttgctgtgctcactggagtacagtggcatgatctttgctcactgcaacctccacctcccaggttcaagcaattctcccttccccagcctctcgagtagctggaattacaggtgcctgccaccatgcccagctaatttttgtatttttaagagagacaggctttcgccatgttggccagtttggtcttgaactcctgacctcaagtgatccgcccgccttggcctcccaaagtgctgggattacaggcgtgagccactgcacccggccagcaatctatttagaagctcagattttctctctgtgcttccagtcaagcaaatctaagttggtttttttcttctgcaccttatactgacagctacaaaaaatagatatatactaatattttctaccaaggccccccatggcttggtggagaatgatctgagatgtaagagacaatgagcaggttttcctacttacttcaatattgcagaaagactgtaagtttctatcctaagattggggtggtaggtgggagtgtgaggctcctcccaatctgacacctgccttaacttcactcattttatattttctgattaagaatctgttactccgaaccctatcacaggtagcactttgtatattaaataagattctctgttgccttaagctgtatgcaacagaaactgtatcgagccagcctaagcaagaaaagaatttaagaattcagaagggcactcaggcctaagaaagagatagaaaagttaccagatctttcttcatctctcatatcttcttctctctgcatgtttgctttatttatttattttctctgaagttaggctttctctgtttctctttccacataccaggtaagatcatggtcactcagcagcttccaacttcatatgtcttttctttgagaaaccaagggtagtatgccaaaaccattgttggttttttttcagatatgtccagggagaaaatctggttgaccagtttgtccttatagtgaaccttcatcagtggtgtgtgttcaatatcaaaacatctttctaattataaagaatcttcagttaggtgagcagatatttcatctccccaccttttggttcctaaaacaaagacatgtgacccaagtcccaccaatatgatgtttttgcctggaactttatcaagtgatacacacaatttggaatttttctatggctgtggcaccaatggcagtggcttctggttctggtggcagtagtggcttccagcatctgatgatacagtggtgactgctcggcaaagacagcagtcatgtcctaaccaggttctttctgcagcataattttaaatgtcctgagttatggcctcccttaattattgctcatttctttccaagcccaatcttcagttcttctcattgattctgtgagcgttcctaaactcttctaataatgttttttttcctcaaatataccagaatgattttatgttgtttacaactaagaacttgcctatattctaatgagctaaaccagtgggtaggggccttgtagagcaaacctgattgtcagaggtctacccctgtgaacaggaagaacagttcccagagaagacagaatcagtggacatcccaataagtgtctttttgcattaatattggaaaagttgtccaagaccatagaagagctgaatatcagaactttaagaagaatctgcacatctcactactcaatataggatttattcctttgtcccaaggattaattttaattcttgaattaataatggatggggatacctaaggttattatagaaaggccaacataagcccttcacaatctcaataatttgctatttcaccaaactgaaaaacctatttcaaaaaagaaaaggctgaattcaattaaacaacctggttctttcaaaataactggttacctaattaaaccttactattgccttaaactttgtaaacatatcttaaacactactatgctaagatggggcagaggaatgaattactgataaaattcatagttaattgaaaatgatatcaaaaacattttaatacttttcaccacataataaaataaaaactgtgtgatttgagtttttatctccttttatgggcctgtttaatttctgtaaaggagctttgaaattaagcaaaatagaaagggaaatagtaatttggataatcagtcccaaataaacaagaattgctaattgcatttcttgtacacaactaggagtaaattcaaaaactgaaagtaaattggacatgatgctcagagagtatccttgagcatgagtaactaaaattaaccagaattttaaataaactggggactcctagacttctgaagacatgaatgaggctattagaactctctttctcctactcatccattagcaatgtcgggaacagttcataaaagattaatgtttaaatgcttaagaatatatatttgaataccttgaaaacaccaagcaatgctttttaaattaattgataagtcattttatacttgtgatgtagacttagacttttttgtagtaacaagccagaaaacatctatccttctgagagataatatgtgaaagaattgtagaagaaatgagaaagatgattagtaatcctgtattgcttcttgagacagcaattctctcgtaagtggaaacttaggcaagcatcagtgatgagaaatagatacattttactctttacttcatggttgagaagtgcctgtaattcacctttcaaataagaggcaacatgtatagcataatcccacagtattatgaaattttggaggtgaaagggaccttgatgtatcggtaagctattgctctataacaagccattcccaaaactcagtggtttaaaacatttattattgttcaagcatctacagattagctaagggtaggctgagctcatctggggtgattctgctccatgtgtttctcattctccataaaccacaaacaaaataataataataataataatagtatttttttaagttctcacttgttgaaggcttactatgtgctaaaagcactttaaaatgttatctcctttacttctcacaaaaacattatgaggtaggtactactaatatcctaatttcacagatgaggaaacaaagaaggaatttccccaagctcaagaagctactgtatggtgaacctggagcacacagatgaaggtctacctgacactaaactttatgttcttaatcattctgttatattctgtttcatgaaatttactattccattttcagagagttctaaccactaagaagttattcttatattcagtgaaatgattttctctataacttttaatcactgatcttaatttggcccttgagtacatacaggataaagataataatcataaattaaatgatatagtaaaagtgcctgacaaacagaatgtgttccacaaaaattaatctaagtcagccccacaataggcataacagtcgttaataaaatgttcaaccgggcagggccagaattatttgcagttttacccagttggcacttatcctattatacagaaaactatccaacctaggataaatacaatgtttaagtccagatatactgtgtctataacatttcctttatctatcagcctagtaatcttgtcaaaaaggaaatgagccctagattgaataagcaacagacaattagaatttagagggtagagaggaggtaagggaacattaaataatgctttttaaaattaatcagcatatattttattaataagcaagcaggcaaaacctagtaaatgttgactttctttctatttggaaaaaatttaatttgttcaaaggtaaacttttgtttatattataggtttacctaagctgatgagagaactgagtacataatacctattgaggataataaacttgttaaaagatgattttcaaaatgacaaaatacaaatattaaaagagcatatgtgaaaatttttatttaactcattaattaatgaaggaccctgtaagatattacaagctattcaaaaaagaatagaaacagtcatatgtaggcaagcaggaatgttgaagtaaatgtgctaatatgtgcaaattaatagatcctataggtactaaattgtaatgtttggaatcatcttttctacagagaggaaatcaattatatctctatgataaaattcattagcatgtctatggaaaagaataatttgcattttactgtcagtcaattttttacaacttcctgagttgtaaaatagctcagtcaagggcagtccaaagcacaggttccaacagaatcagataaccttaccttggagagtaagccagacagtgtcagacgttccagaacacccagaattgtgcccattcaaaattcttcactagtcttcctgacaaagtttctagaagaacatcaaggagaaaaactgggggaagtgctgattacatgaaaatgtacactggttgaaacgttttacaattttttaaaaacatattatttgagactctttgagaaaaaagataatcccggaaaatcatgaaattatttttttttaatttttttgtcacatccttcaaataaactgttaatcatgatatacaaggtcagatggaaattgaaaaaaggaaaaattaacgttttttaatataccctcccatttgtctgccaaaattgtatttaaaagtagtgttatataattaatgatattttatattttcagatgattgctaacaagccaaagaaaaaaatttccctgatcgtatttggaattaaaaaaatcattgattgaatgaactagtaatattttatttagcatttccttgtatttagagtggtaagaatttctatgtcagctctgtcctctgcattgacaaatcagaaggtcctgaatcctctttactctgttatgagatcataaaaaagaaattaaaagtcaattgctctccactgaaaatcctagaattgagaatcaaggaataatcttctcttccaaccaaagtccctgtgtgactaaagatcagtgtaattttaaaatgtggcaacttgtatattaaaatgtcatatagaatttttaaaaatcttttattgagattcaaaaatagacaaagaaaatataataatggctaataagcacatagaaagatgttcaacatcactggttattagggaaatgcaaatcaaaatcacaataagacactactttacatccatcaaaatggctattgtttcttaaaaattgaacacactaggcattagtgagtgtcttacttcgttttgtgctgctgtaataaaataccacagactggataatttataaagaacagaaatttattctctcacagttctggaggctgagcagttcatgatcaagggactggcaagttaagaactggtctctctgcttccaagatagtgcctggaatgctgagttctctggagagaagaaacgtggtttcctcaactgacaaacaggcaggagagagagagaacctactcctgcaggcctgttttatagcagcattaatccattcataagggtggagcctcatgacttaaacacctcccatcatgccctatctcccaacactgttgccttggagattaagtttcaacatgagttttggagtggacgaaaacatttaaaccatagcaataaggatgtagaaaaattagaaccatcccatattgctggtaagaatgtaaaatggtgcagccactatggaaaatagtatggcagctcctcaaaaagttaaacatagaattaccacatgatctagcattctatttctaggtatatacctaaaataattaaaagtaggggctcaaacagatgcttgtacagcaatgttcacagcagcattattcacttgtagaatttaagacactctaccccaaaatacttatttaagctgaaagaatttgagaaaacagcagaatcaggaaggtcaccctcactttactccacccttcttttctgaagcaggtcataaaacttaggcaggattttctgaccttcccttgaagcaggtcatagcaccctcatgtgagaggtgccctctctaatacctggataaagcagccaaagacagagacacgaataatctgaacaggcaggccttgctaagtttccccaaattcattactggtagattacacccactatgtccaagtctacttctccacgtctatacatttattcatcaaacttggcataaaagtacacatgtttaatctgcttctttgggtcttcattgccttatgcaggctcccatgtcacataaaacttatattgaataaattcatatgcttttctcttgttgatctgcatttcagccatgaacctgggataagtgaggaaatacttctcttcccctatatcgcagtaggcaacaggtagaaacaacccaaatgtccatcaacaaatgaatggataaactaaatgtggcatatacatataatgaaatattattcagccttaaaaaggaatgaaattttgttacatgctacaacatggatgaaccttgaaaacattgtgttaagtgaaataagccagactcaaagggacaaatattgtgtaatttcacttatatgaagtacctaaaatagtcaaattcatagagacagaaagtagaatagaagttttcagggactgagaggaatagggatagggagttattgattaatggtcatagtgtttctgtctgggatgatgaaagagttttggaaatggagagtggtaatggttgcacaacaatgtaaatgtacataatgccactgaactgtacacttaaaaaaggttaaaatgataaattttatgttatgtatatgttatcgcaatgaggaaaaaaatcactagttggaagtcaagaatgttttaaagctttttcagagctccaagtgttacaggaaagggatcccgatccagatgccaagagagggttcttggatctcaggcaagaaataattcagggcgagtccatagagtaaagtgaaagcaagttttattaagaaagtagaggaataaaagaatggctactccatagacagagcagccccatggctgctggttgcccatttttatgattatttcttgatggtatgctaaacaaagagtggattattcatgcctcccttttttagaccatacagggtaactttcagatgttgccatggtatttgtaaattgtcatggtgctggtgggagtatagcagtgaggacaaccagaggtcactctcattgccatcttggttttggtgggtttttgtgggttttggtgggcttctttactgcaacctgttttatcagcaaggtttttatgacctcaatcctgtgccatcctcctatcttatcctgcgacttagaatgccgtagccatctgggaatgcagtgatgttgcgggaagtcagggaccccgaacagagggaccggctgaagccatggcagaagaacatggattgtgaagatttcatggacatttattagttccccaaattaatacttttataatttcttttgcctgtctttactgcagtcgctgaacataaattgtgaagatttcatggacacttatcacttccccagtcaataccctgtgatttcctatgcttgtctttacttcaatcacttaatcctgtcagctgaggcggatgtatgtagcctcaggaccctgtgataattgcgttaactgcacaaattgtagagcatgtgtgtttgaacaatatgaaatctgggcaccttgaaaaaagaacagggtaacagcaatgttcagagaataagagagataaccttaaattctcaccaccggtgagccaggcggaacagagccatatttctcttctttcaaaagcaaatgggagaaatatcgctgaattctttttctcagcaaggagcatccctgagaaagagaatgcgcccctgagggtgggcctctaaaatggcccccttgggtgtggccatcttctgtggtcgagctgtagggatgaaataagtcccagtctcccatagcgctcccaggcttattaggacgaggaaattcccacctaataaattttggtcagactggttgctctcaaaccatgtctcctgataagatgttatcaatgacaatggtgcccgaaacttcattagcaattttaatttcgccccagtcctgtggtcctgtgatctcgccctgcctccatttgccttgtgatattctattaccttgtgaagcatgtgatctctgtgacccacaccctattcatacactccctcccctttgaaaatcactaataaaacttgctggttttacagctcagggggcatcatggaacctaccgacatgtgatgtctcccctggatgcccagctttaaaatttctctcttttgtactctgtccctttatttctcaaaccggccgacacttagggaaaatagaaaagaacctacgtgaaatattgggggtgaattttgcccaatatctggctgaattttctgcgatacagcacagtatgtttcagccttattttacccagctcctattcaagatggagtttctctggttcacatgcctctgacacaagcactccaaactggtttccatttcaattttctctcattattttatttaattaataggcatttattaagagctttttttgctaaacactgtactaggcacagcaaaaaaattcaaaataataagatctttttttctctgaaatccatcatttagctcttcctaaactgggatttaaggaaagctgtttctttttttatggttttgtttctttttgttgggatgggttgttcataggtgtgctgaaaggaaaaacatttttcctctttgcaaataaatgagtgtttaattattaaacaaagttaaatggatttttttaactgtgaagacttcccataacctttaaaatgctaatgtattttttgaatctacaagactggatttagtaagtggcattcctaagcttatttaatcaagaattctttgtctctcagagcccaattaattaacatctccctttgtactgtggctgcagaagttgagctatgtggtggattctttttatactgggctaaatgtattatacaatctgtaattatggtataaatgtgtattttgttttatccctatgtgttctagaatgtgagtatgattttaaaagcatttttaaatttaaaaatgtagattaaacattagagacaataaagtcattataatttcttacctcaatttaccattttttttctcctttagatagcatttattattctggaaaaagggatattcttgttttggggagaaggatttgctaatggagattttgcagaaaactgtgatgctgactgtgatatgtaacttgtgagcatttttaataagaagaaacatagaatgccagtccttattcttttcttgataaaagaattcctaccgaattgtatccaatcaatagctttaaggacttgtgattttctctctgcctttgaataattgcaaatttttgatgctaattcttactccataagtttaaacgtccctatttttccgattactaaacttatactttaagtcacaacctacaataatatgcagacaatccctgacttacgatggtttgacttatgattttttgacattattatgatgtgaaagtgagatgcattcagtagaaatactgttgtatccatacaaccattctgtttttcacttttagtatacagtattcagtaaattatgtgagacattaaatcctgtattataaaacaggctttgtgttagatgattttgcccaactgtaaactaaagtaagtgttctgcacatgtttaaggtaggctgggctacattgtgatgtttggtaggttagatataataatgcatttttgccttacaatattttcaactgttgaagatttattgggacatatcccacattgtatgaacatctgtattcctgcatcctccatatattccttttttttttttttgagatggagtctcactctgttgcccaggctggagtgcagtggcatgatcttggctcactgcaacctccacctcccctgttcaaatgattctctttcctcagcctcccaagtagctggaattacagatgtgcaccatcacacctggctaatttttgtatttttagtagagacggggttttgccatgttggccaggctggtctcgaactcccaacctcaggtgatccactgacctcagcctcccaaggtgttgggattacaggtgtgagccaccgtacccagccctacatatattcttaattttgtgcttttccttcaaaattaaacacagtagaacaatttaagtaaagctaaagatatagcaaatttgagcctatttcatgattttaatattggtctcagttatattttcattagtagtatcattttcatgtgtctaaagtatcacgtaaaatgcattagaatatttaagtaattgcacaggcattacaaaggaataaaaatgataaaattgccaagatcaaccagctggtcatcaggcagaagcaccccgtgatactgtgaaatacttggttattggtgaaggatgaaagtctagattcagcataggaaagagaattgttatgtgtatatgtacactggatggaggtgctagttgtttgcaagtcaagcattctaaagcctaggactgcctgaactagagcaacaaataacaaagtatcagagttcaaggatttattctgaccggatgattttggaaaccttcctggacaacacattgggctgggttctgaagaataaataggattcccacaaatttttccagactgaggagagaggctaagatgtgcaaatagagggtctatctaggagtgtaattttggagtgcaaagtatagagtgcgtaagggatagtgaagtaaattaaactagaaaaaattattgaggccagatcattagtactaacaaatttagactttattctctaagtaactgagagctgaggaaagtttttgagcagagggcatggtttgtgtttcagaacaattactctggtgggcccatagggagcagatgagactggaatgaggcagggaagctaattaggatgttataattgtctagcaagaaaagatgaagacttgattgactgtcaaggaaacaataaataggagacattttgaaaaaattaactgagcttggtgaataaatcaattagaaatccctttggatgcaagaaacagaatttcttttgaacagagttgaacatacagagccttactttattcaagtagatgcagatagatgcagatagatcaagtagatgcagatgaatctactttattcaagtagattcaagtagatgctgctggtgttggtgcagaggcttgacaatatcagtgacatcatttctcagctctcttggtttttctttcatgttgttgaacaaccgtctcctccacggcctactttaggtgagtgattggctggagctgagtcacatggcagcctctagctacagtagaggctaggaaggtggggaatagtagtgtcttgatcacctgagactgatcatggtctgtaactatgggctgatcacactgtccttttgaaaaaacattattagcatggagtacatgggcattggatattaggtgaacaattaatagagtttgctacagtaactaattggctatcggagtgcagtgggttgaatagtgtccttccaaaattcctgtccacccagaacattagaacactacattatttaaaaatgtgtgttgcagatacaaataaagtaaggatcatggtgagatcatactggattagggtggaacataaatccaaaaagactgtcttataattaccaaagataaacaaagacagatactattaaagtgataaagacaggttttgttttgttttgttttttttgtctttttttttttgagacagagttttgttcttgttgcccaggctggagtgcaatggtgcgatctcggctcactgcaacctctgcctcccaggttcaagtgattctcctgcctcagcctcccaagtagctgggattgcaggcatgcaccaccacacttggctaattttgtatttttagtagagatggggtttctccatttggtcatgctggctggtctagaactcctgacctcaggtgatccacccacctcaccctcccaaagtgctgggattacaggcatgagccaccgcaccctgcctaaagacaggttttaattagtaattaactattgcaaaagggaagagaatccagtataaactgaactcaactttgatttgttttaaagagagaatgagagaataggaaaggggaacggtagggaccagagtcagggagtggaaatttacaaaaagtgagaagacgagtgtcttagtctgttttgtgttgctataacaaaatatcacagaccaggtaatttataaagaaaagaaatttatttagctcatggtcctggaggtgaaaagtccaaaagcatggtgccagcatctggcaagggccttcatgctgaatgataacatggtagaaagtatcacatggtgaaagaaagcaggagagtttgtgtacaacttcaagccgtttaaataatcaacattattccattagtgaaggtggagtatcaatgactaaaataacccccatatggccccaactcccaaaactgttgtattggtattaagtttccaacacatgcactttgggggacacatctaaaccacagcagtgagttggcccatgtaaaatcatctgagtttgctaactggtactggtcaaagttaggctcctaccctcccaaagaggcaaaaagacaggggccctatcttcaggtgttggccagaacaaacaatatgttttttgggcagccttgagctttcccaagcaggaacttaaagagactggagtggtgatactaaggatgggaacttgagctgtcagaaactatactaatgtttgttcagacttttaatgagaatggaggaggaggccaggcatgaaggctcacacctgtaatcccagcactttgggaggccaaggtggatggattgcttgagcccaagagtttgagaccagcatgggcaacatggtgaaaccccatctctaagaaaaatataaaaattagctgggtgtgatgacctgtacctgcggtcccagctactcaggaagctgagaggagaggatcacttgaacctgggagggcagaggttgcagtgagctgagatcgcaccactgcaatccagcctggataccagagtgagacaccatctccaaaaaaaaaaaaaaaaaaaaaaagacagagagagagaaagagagaatggaggaatggaggagggacattgtcgtaagagacaaagttaagaaggctatgtgaaaatgaaggcagagattggagttatgctgctacaaaccaagaaatgtcagaagtcatcagaagctggaagagacaaggaaggatcctcctctagaaactttggaaggagtgtggctctggtgacaccttgatttctaatttctggcctcctgaactgtaagagaataaatttctgctattttaagccactcagcttatgataatttgttatagaagccctaagaatctactacatggggtgaaggagagggggaggtatctaaacataatagcctggaagaggatattgacagggctcagaacatgataccccaaagtatggcgccctgggatgctgagtactttgagctgaaggacattggaagggcctcagaagcaagtctctctaaacatttctcactctcctgtctctcatccttttttctcctccaggtgagtcatagaaatcagaatccctcttccccaaggtgggtcatagaaattagaacccctctcccacaaaacaagccataaaacctggaaagataacaagggccttgctgcattctgggaggaaggaattctacatggagagaccaagaagaatctaaacagacaggtgttactgagtattccccttcagtctattaccattccatcatacccttttggccaataacatttctacatggctgtccattcttcatagaatccaagcataaaaacaattttttccttggtctttgggtcttcatttctaaaggctcctgtgtcaagtaaaaccttttttttttctttgagacggagcttcttgttgcccgggctggagtgcaatggcacgatctcagctcactgcaaactctgcctcccgggttcaagtgattctcctgcctcagcctcccaagtagctgggattacaggtatgcaccaccacacctggctaattttgtatttttagtcaagatggggtttctccacgttggtcaggctggtctcgaactcccgacctcaggtgatccacctgcctcagcctcccaaagtgctgggattacaagtatgagccaccacgcctggaccataaaactttgattaaataagtttgttatccttttatcttgttaatctgtcttttgttataggagtgtcagccatgactcttacaatgggtgagggaaggtatcacacttttctgctcctacaatattaataccatgagtagaacatgttgtctgtgagacatttaggaaatattcatatgaggatgttaggcaagaattgggattatggatttagaattgaggaatgaagtaaggaataaagaaactgcagggaaaagaaaaataaacttcaccaagcaatagttaataacataagataaagtataagttagtatttaattgaccacttgaacacaattctttccctcttatttccaaattctattcctgtgtagcaggaatagaagaaaaagccagcatcattgagggttaatgaatttggcctataagggctaataaatatctacaaacaaactttggaaagagtcattaacaggactttgatttcccatttgccttagtagcaaatttagcagcactttttaaactgcctcatggatgactatctccattagtttttttttttaataagaaaacagtaaacactatgcatggtagtgttgtatcctcagtgcttctaatataatttcttcatatttctagtattacatttatctcactgcattctaattattgttctgtctcccctgctagactgggagcttcttaaaggtaatgcaccatttttattcatatttgtatttcaattacttgacacaatattcagcacttaagcaatttatgtaataactactggatggattgtaataacaataatagttaaggatgcagatctagagctagtttagttgggataaatcctggctttactgcttatttgttttgtgaccttgtgaaattactaaacctctctgtgccccagttttttcatcacaatgtgaaataataataagacctttgtcttggtcaatttgggctgttctaacaaaaatattatgtaccgactggcttaaacaacaaacatctgtttttcgtagttctgtggctgggaagtccaagatcaaggtgccagcatattcagtatatagtgagggctctttttctggttagcagacagcctccttctttctgtatcctcatatggctgagagaaagaaaggtcatctctctggtgtctcttctcataagggcactaatcccgtagtgaaagctccaccctcatgacctaattaccttccagaggatccatcttcaaatatcatcacattaaaattagggttttagcatttgaattttgaggacatacaaacattcagtccatagcaaacctcctcaaacaattgttgtgataattaaataaattaatctatttaaagcacttagaagattgctagacatacagtaagtgctcaatacacacatatatgttattgaattattaaatagaataatgcctctagcattcattactgctgttcaattttgtcttcattgttattttattttatgtcttcctgtgtaattcccttgtggcaatttcataattgctatagctttttttgtttgaccctccacatctcatgttcaaatttgatccccattgttggaggtagggcctaatgaaagctgtttgggtcatgggggtggatccctcacaaatatcttggtaccgtcctctggtaatgagtgagttttaactctattagctcccatgagagctggttgttaaaaagagcctggcacctccccctgcattctctcttgcttcctctctcaccatatgatctctacacatgccagctcccctttgccttccaccatgagtggaggcagcttgaagccttcatcagaaacagatgctggagccatgctttctatacagcctgaagaaccatgagccagtttatttataaattacccagcctcaggtattcctttatagcaacataaatgaactaagacaataatctacaaattcatttacttgattactggcaaattactcccatgagagtgagaacgttttctgtgaagttctctacccattccatgcataacacagcatctacacacagcagagattagtaacagtttgttaaaggagtaaattgatccacttttaccttctgtaaagaccaatttaaatctttcttatattgctaacactgaacctcctggttcaaagttaaaaaaaagataaggcgcagtaacaacagagtttcaggaagatctgggaaagaaagatttcctattattttttatttatttatttatttttgagacagattctcactctgttgcccaggctacagtgcagtggcataatctcggctcactgcaacctctgcctcccggattcaagcgattcttccacctcagcctctcgagtagctgggactacaggcacgtgccaccacacctggctaatttttgtattttttagtagagacggggtttcaccatatcggacaggctggtctcctgaccttattatccacccacctcagcctcccaaagtgctgggattactgacgtgaccccctgcacctggcctatttcctattaattctaggactaactacctgaaaataggataataccttgcatcactacattaatatactcatttttattgtcccctgtttctgagagtaacaacttcaaatctcctaccttctttcctgactttgacttcctataccgtcagctcttcagggcagtcttgacattggaataataataataacatcatgttcttagacaaagactgatccactctcagaaatcaggttaaaggttattttatgtgattcttttttgttttaatatgatttataaagagggagagtcaatgttgaagaatcagctattttaaaattgatccctctactggagtactaaaaagtatttgtgaaatgaacacgaataatctttataacattaaacattgcaaaacccaaatgcaaaatagtcctatttaacataaagtctttcatattgttctgttctgccatccttctatacatttgcccagacaggacagcaacaaggaaagaatatgtaaacactaatcatttctaacttgccatctgtgacagttcactgtgctgaaattagaaaggatggaatcacttttccatttccttaaggtcaccaaggacagacaagctcaggacatactgtatttgtcagaagaaaaagagatgactggtgaggtggcagtgacaaatctgttctaggttcagctcattttactgaagaatgtgtgtccccttctgacatttatcaaaagaaattcaattttataaaaagaaggatgtcaaataatagtacattgctaacactcattttgttgctgtcagaagggcagatgggggcaaaaagggaaaagggtggatggaagagaaagttattccagcaagaaacaaacaaagtcatgctaataatacacttataggcttgaatatatttctgattaaaacacctatttttgagatccatcttagtgcctggctcacactttagaataccagttttcacttcttccagacagaaggaacgacacaaagcaggttgatttgtgggttttgtgtttgtttttggttttgtattttgttattgtttgagtgccattctgctgcaccaggaaggaaagaaagctaatgaaacctggtaaaaccccaggtacaatgacatgcaccctgtgggcatgcaatcaatagttcttatggtgatgatgatgtttttctctggcagaaaagggtattttgggtcaaaaaataacccaaaagttgtgacagaggtaacggaaaaatagaagtcagattaaaatcaaaggaagaaattctaacccaaaagttgtgacagaggtaacggaaaaatagaagtcagattaaaatcaaaggaagaaattctatcaggagactaataatgaagctgacaatatactgtaacaagtaatagtgttttaccatactgcataaaaatattggattaagatacaaattaaatctctttctcagtgagggttttctgcagaacataaacaattaagctgctttctggagaagacaggaaacttgattaacagatccaaaaagacagcatagggaagatgggtttaacactaggaggtgaaacaccaactgttatccaaattgacttttccagaaacgttggataatttcaatcaaggactgaaatatactcttttctttttaagcgtcagtgttctctggacttaaacaagtcaaaggaggttcttattaaataaatgctactggtgcatatgttccagtcacagtctcctgaggtgagtatggagacactacagaaaattgaaccatgaaatagggttttgtgtctctataccaaaatttcaaatatctggaggtgtcctagctcatggtggctaagcaggcagcttgtgggagtacaggaggctacaggagacgccaggagtaaaacgacctattctgagtcctgtagtctctgtaaggtgcctatttgatgcaatctaagacagtcttatttagaatagggacccttagaagctgctaatataagtcaaagaaacaaatacttctgtgcatttttccccacaaataagggattgtcctaaacctctaagcattaaaccaggaatccagtaaaaaccaggcttattgtactccaatccccaactcacgtactgtcttagagattttcagacacaaggtgctaaaagttatatagcatattttaaaatttatctgttatcaagtgcctttcattgaacaaaaaaaaaatcaaattcaatagtacataaacaagatctttctgctccttcttggaagatttttaggagaattaaagtcatagagacaatcatctacatgccattaatattgtcatcttcacatattattaccagtattattaccagcacagctttcaaggtttgaaattttgcattgggctggccttaacatttggacaaatcctttttaaatatagggaataaataataaatttaaaaataaaatacgttaatatgcaattttttttttttgagactgagtctcacactgtcacctgggctggtgtgcagtggcaccatcttgacttactgcaacctccgcctcccaggttcaagcaattctcttgcctcagcctcccaagtagctggattgcaggtgcctgccaccacgcccggctaattttttgtattttttagtagagatggggtttcaccatgttggccaggctagtcttgaacccctgaccttgtgattctcctgcctcggactcccaaagtgctagaattacaggcgtgagacactgtgaccagccaatatgcaaaattttaacgctttaaattagaggtcagcaaacttttttcattaacagagagtaaaatatgttctgctttccattccatacactctcacacaactaatcaactctgctgttgcagtacaaaagcagccatagacaatacaaaaacaaataggggtggctgtgttccgataaaattttctttacaggcctctgcctctgcctctgcctctgcctctgcctctccctctcccctctcccctctcccctctcccctctcccctctcccctctccctctcggtctccctctccctctctttccacggtctccctctgatgccgagccgaagctggactgtactgctgccatctcggctcactgcagcctccctgcctgattctcctgcctcagcctgccgagtgcctgcgattgcgggcgcgcgccaccacgcctgactggttttcgtacttttttggtggagacggggtttcgctgtgttggccgggctggtctccagctcctagccgtgggtggtccgccagccttggcctcccagggtgccgggattgcagacggagtctggttcgctcggtgctcggtggtgcccaggctggagtgcagtggcgtggtctcggctcgctgcagcctccatctcccggccgcctgccttggccgcccagagtgccgagattgcagcctctgcccggcctccaccccgtctgggaggtggggagcgtctctgcctggccgcccatcgtctgggacgtggggagcccctctgcctggctgcccagtctggagggtggggagcatctctgcccggccgccatcccgtctgggaggtggggagcgcctcttcccggcagccatcccatctgggaggtggggagcgtctctgcccggccgcccatcgtctgagatgtggggagcgcctctgccccgccgccccgtctgggatgtgaggagcgcctctgcccggctgcgaccccgtctgggaggtggggagcgtctctgcccagccgccccgtctgagaggtgaggggaccctccgcccggcagccgccccgtctgagaggtgaggagtccctctgcccggcagccaccccgtctgggaagtgaggagtgtctccgcccggcagccgccccgtccaggagggaggtggggggtcagccccccgcccagccagccgccccatccgggagggaggtgggggggtcagccccacgtccgggagggaggtggggggggtcagccccccgcccggccagccgccccgtctgggagggaggtggggtcagccccccgcccggccagccgccccgtccgggaggtgaggggcgcctctgcccagccgcccctactgggaagtgaggagcccctctgccgggccagccaccccgtccgggagggaggtggggggctcagccccccgcccggccagccgaccagtccgggagggaagtggggggatcagcaccccgcccggccagccgccccgtccgggagggaggtgggggggtcagccccccgcccggccagccgccccgtccgggaggtgaggggcgcctctgcccggccacccctactaggaagtgaggagcccctctgcccagccaccacctcgtctgggaggtgtacccaacagctcattgagaacgggccgggatgacaatggcggctttgtggaatagaaaggggggaaaggtggggaaaagattgagaaatcggatggttgccgtgtctgtgtagaaagaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataaaaaaaataaaaattaaaaaaaaaaagttaaaaaaaaaaaattttctttacaataacagcataaaactttggcttcaggtcacagtttgttgacccctacttcatattatcatgtcccccccacccccatttctttcattcaccttctatcacagagtcacagctttgcactcacagtgtagccaagttgtagctacagaccaaacattgtaaagaaatacctccggggaacttgagaataagttaaaacttgtgctaaatcatgagtgaaatatacattgggaaacacagttaacaacccattccccaacctgcttactgggccatctttctaaaaatgcaaatttgatcctgcagctccctagcttaaaaggcttcacctgcaacagaaagccctggctttttagtttttcaccataggcttatttatggctggtcctgctttcttcccctccttatttcttctcatcccttccttctcacattctatgcttcagctacatagaaggacttataatttccagaatgatacctgctcccttgcctttcaacccatacacttatttttttttttcttcttagatggagtttcactcctgtcgcccaggctggagtgcaatggtgcgatctcggctcaccacaacctccatctcccatgttcaagcaattgtccttcctcagcctcctgagtagctgggattacaggtacccgccaccacacctggctaatttttgtagttttagtagagaaggggtctcactatgttggccaggctggtctcgaactcctgatcttagggaatctgcctgccttggcctcccaaagtgctgggattacacgtgtgagccaccatgcccagccaacccatacacttgttactcattctccttgaagcactcttctccacacatccttggccttgccaactccttgaaggctgagcttaggtgtcttaaggacttcaactcccagacacttctgtatacctgcgttataatatttttactgctggctgtgtgtggttgctcacacccgtaatcccagcacttcgggaggccaaggcaagaggattgcttgaagccaggcattcaagacagcctgggcaacatagtgagaccccatctctaccaaaaaattagaacttagctgggcatgtggtacatgcctgtactgccagctacttgggaggctaacatggtagaatcgcttgaacccaggatgtcaaggctgcagtgactcgtgattgcaccactgcactccagcctgggtgacagagcaagatcttgtctaataataataataataatattcttaccactatctacagatgattactggtgcagataaatttaaaattcttcttggccatgtgtggtggctcacacctgtaatctcagcactttgggaggccgaggtgggcggattgcttgagctcaggagttcaagactagcctgggcaacatgattaaaccctgtctctaccaaaaatacaaaaacttagccgggcatggtggcacatgtctgtggtctcagctacctgagaggctgaagtaggagtattgcttgagccctgggtggtagtggggagactggaggttatagtgagctgagattgtactactgcactcctgactccagcctgggtgacagagtgagatttcatctcaaaaaatatataaaaaataaaaaatttaaaatccttgaaagctgaaactgcattttcttgtaagcacatgatatccctcttagggtcctgctcccccatcccctgagcatgggaataaagaaaaaatcttgactccctttaggggaaaattccaggcaccccactatccttgagaaataaataaataacccactaatcaataaggtaataataagcttaaacaatagccacccaagtaatctagagtcataaaatgtttggttccctataaaaactaaagataacatcttgacatatttccctgagttgtttttcagaaacctgtacccccacaagatggaaaatgctgaccactgtcacacagacctcaaataagggagagctaaggactgaactctaatcgttgtcccttgttctaaatgtcttcatgaggggcctggagagggtcatcatgcccatagatcaaaccttaacattcctttcttctgaccccaagtttttagacaaagcattgcttccctaaccaattgtaaatcaaataatctgtgaacctctctatgacttgtaagcccccacttccagatattctgccttttgaggcaaaaccaatgtgtaacctccatgtattgaattacatatgattttgcctgtaacttctgctttcctgaaatgtaccccttcctttaaagacccttgcttgtaagccgtgggagagtttgggtcttaagtgttagctgcccaattctccttgcttaatgccatgccataaatgcctcactttctctcactgcaaatcttggtgtcaatgtttgcctttgctgcaccaggtgggctgaccaaagttgggttggataacacatggtatctggtacattgagaataatccctaatgcttattaaatgaagccatcaattatttaatgtctttaataagcttttggcctttctacttcagaatataactttagttattcccagctatgggcaatttattttcttttgcatattgtctataaatgatacccaaagaactaataggaaaaaaaattattagtcagttaaacaggtaatttaatatcaaaccatagaggaggaaaaataattgtctctctacccttcagagttcgtagctgagactctgaaggttaacaggagaaaaataaataaaagatgaataacgtgtgtacctccagtatacatggaaggcatactcagcgaaatctgaaagagtaaaatctccaggctaaatctcaagagatctcaaaagggttgtttaaacttcaggcttataccatcctttgttgaaacaaaaagagaagtttattgggaaaggctgattatgggagataggaagagtacagtatacaagaacagtttgttatgcaaacttaagtcagtcccttctccattgattaagagtatcttggatttagtcattctcttcctggtactaagagagagagagacacccttacaaataacgattttctttatagacataaatttctcttacaaaagggtaccttctactctagttttcagagcttctcctgtgtctgctgtttcccaaaataattcaattcaaaaaattctatgtcaaagaggcttatttggggtggtgtattctggtcttttacagtcacactttgagatgacgtgttctgaacgccatcaatataaaaatcttcttaacttgatttaaaatttttttcaggttgaaattagacatatagctttatgttgtcattattgttttgtttctttagagtgttaacttaaaaggaagaagctgaggaaaattaatatatgtagagagtttctttgggccaagcttgcagattgcaacacaggagcacagattgaagttgccctgaatataattcaacaagcagtagttacaagtgaaaaaaagtagttaaaggcaaaaaggggagacacagagtgggctgatacaaagttgcttgtcaggaattctcattgtttcatggaaatgacgtggagtagtgattggctatacatttttggctatagtgtgtgggttatagtgtctggtgtggcattattagcttaatttatagctacttgtagcaatagcaagcagtttcaagagattaatatatagctcaaagtgggaaataggacattattgcagtctcattttaatgtctctttgggcctggtaagtactgtcttcttttttttctttttttttttttttcttttttgagacagggtctcactctgtcacccagactggagtgcaatggcaccatctcggctcactgcaacctctacctcccagcctcccaagtagctgggactataggcatgcactaccataccgtgctaaatttttgtatttttttgtagagatgaggtttccccatgttgctcaggctggccttgaactcctgagctcaagcgatctgcctgcctcagcctcccaaagtgctgggattacaggcatgggccatcgcaccaggccaggacctgataattaaaaggcctcagataaaagttcttttctcaagagacaatcttaggaccacttgctgcattatctatcagtattaataaagccactttacatttaccctataagtggaaatattttctcaactaatcacttaacagccaggttttatttgagaagcaattaaacatttatggggtctacagaagatatgaacaaatgctatataaagacatccctaataacagactataggaaaaaaattgtgctttaatgcattatccacatacagcatgtcactctgggttactagattttagcctttcatgatctttgcattttattgcatatttattttatgactctttgcaagttaaaagtgacaaagaccctccccttaggctcctttgaatcttctttttgactaactctcactcttggtctcatccttgccccacctagtctagttttagcaagaatcctcttgaatcaatatggcaaaaatcccctgcccttggcatgtgatcactattgatgactgattaggttcctcttacttcatcctctatatcttttcacagtgggctgccttcagcaagaatcctaagtcagtgtagccataatccccatagtcttgatgtttcctcttagtaattttctatcctctgatctccgccctttaccttggccataaatccccactttttcttgttgtattaagaatgggatttcattctatgctgagatctctttttccctattgcaataattcctgaataaaatttgcttttatcactttaactttctgtctggctgtggtttgctttgacaatagacatgcatattctgtcttacagagtggagttcaatcgacttcccatctcctatgggggaaaaaaaccagttttgcctctatttgtaattccatttctttactccatagaaatgtgtgactttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaatgtgtgcctttgaattttcctttcaaccaattataatatctacccgccttccttactgaatgagtaaaataaacattttaacacatgcttatttgtatgcccacatgacagtcatgatcttaccttttcttttttctttttttttttttttttttttgagacggagtctcgctctgtcgcccaggctggactgcagtggcgcaatctcagctcactgcaagctccgcctcccgggttcacgccattctcctgcctcagcctcccgagtagctgggactacaggcgcccgccaccacgcccagctaattttttgtatttttttagtagagacagggtttcaccgttttagccaggatggtctcgatctcctgacctcgtgatccgcccgcctcggcctcccaaagtgctgggattacaggcgtgagccaccgcgcccggctgatcttaccttttctagaaaattatcttttaacaattttggaagttccactgaaatgcccagtggatttacctaccaaagccaggtaacctttgcaggcagagaaatgcacttcatgggcagtgtaagcccaggtagatcttttcttggctcacagaattgaatccaagatggcaagaaaaccttgctcactctgtttttctcattctaattctcctctatactaattttacatttttggttttgggttgtttactgtcagtaagttagtccccgttgcaggaagtaatggttgggaattcacttttatgatctgattatttgatgatctctgtaaatgaattaatagttaacagagatctctgctaggtgagagatagcagagaatctagtgggttagtcttttctgtttatctgttttctattttgaactcttgcagaaaccaaattaatgttttaagaaatcaagttcagctgggtgcagtggctcacgcctgtaatgccagcactttgggaggccgagatgggagtatcgcctgaggtcaggaatttgagaccatcctggccaacatggtgaaaccccgtctctactaaaaatacaaaaaaaaaaaaaaaaaaaaatagccgggcatggtggcatgtgcctgtaatcccagctactggggaggctgatgcaggagaatagcttgaacctgggaggcagcggttgcaacgagtggagattgggccactgtactccagcctgggcgacaagaacgaaactctgtttcaaaaaaaaagaaaagaattcaagttcacataatttagataaatttttggcaaatgatacaagcttaatattattggtttaacaaaaaatacctatgtcttctttgatttactagagaatgagaataatataatgtaggtgcttatgctacttgggtatgtttttcctaatcttaaacaggttaatagattgaataagcttgccttacttctacttcatgtttaagatgtttataaatataaatttatatttactcatactgaatcattattgtgataaactttatttcaacaataattatgttttgtgtatgtcagcttcaggacaattttcaaggtctgtaagtaacttaaaaccttggaccaatggtaagttgagttaattaatggagaatcattagatagacagacagtatttcaagatagtaagatagaatactcattactactcataatttcaagtttatatccctttacttcttattttcataagactatctctttgggtctgtactgaatgtgctgctcatttctgccactttggggagtgtataaaaatgatatgtgtggctaaggcaagctgtattgtgtgtattcacaagttctgctagtctgctgcaaaatgctggtgtgacagtgaacaattatccactctccaggtctctctgtgaaatagaagtgtgttactttggctaaaagttataatggatatgtggctttggctatatttaggagccatagtttctgacaaatacagctgtgtatttccattttttgaggaaaagagtaattttgtcccaaaggagtggagtatttttggtctccaaacccccttgtgctcttcaagcttattgagaaccacaaagaaatagaactgcctttgagatttcccaaaggactcccataaagtcacaaagatttgttcttttgccttctaaaaaggcagatgttaaaaataattaggctcatgtaacattattagggctaaaaacaaaaaacttatactgtaaaatatggtgccttgacaagtcttttttttttttttttttttttttggagacaaggtccactctatcacccaggctggagggcagtggcatgatctcagctcactgcagcctgacctgccaggctcaagagatcctcccactccagcctcccaagtagctgggaccataggcacatgccaccatgcccagctaatttttgtatttttttgtagagatggggttttgccatgttgcccaggctgatcttgaactctgagctcaagcatcttcccaacttggcctcccaaagtgctgggattataggcatgacccaccatgcccagcctcttgacatgctttgaactaaaaaaccagcctcagaaacaaagtctctctgactttctcccaccctcaccctctgtcccccaatctcagtcctctgcctctctgaaagcacagggagaggctttctctcaagttcatttatgggactgcaggaagttcctccagacagaatgcaattgtcttaggtcttctccctgtaatctcagaaaacaaagaaggttaacttgctggaatgatgactagattgggcaccatacccaaagcccagacagactttctcccaggctattgtttgttcttctcccctaaaaatcatttacttttcctctaaaattgcatacatcccccactccttctcccctatgaagagagtatttaaacttcaaccatctggcccttctttgagtatcacactttgtgtgactcccgtgcacttgcacgttaataaatttttatgccttttctactgttgatctgtctattgtcattttgttttataggctcaaattcttgaactcccagggagtggaagaaaactttctttcatccctacagtgtgttattattaatgagttacatagaaagagttgtcgaattaaaaaagatacttatgcttccctagattaaatttatatgggtaaaatcatcacaaacattttacaaactaaaatccatatgtgaagttcctagagatttgtcaatgccttcactgcctatgacatggttctatttatcagagttcaggtgtagctctgcctgataatagacaatagacaatagtatacagtagacagtcataatttcagttatttttggcatgccagctttgttaagatataattcacacacaacacaatttaaccatttaaactatacaattcagccaggcatggtggctcatgcctgcaatcccagcactttgggaggctgaggcgggaggattgcttgagatcaggagtttgacatcagcctaggcaatatagggagacctcctctctacaaaaaatttttaaaaatcagccaggcatagtggtacatgcctatagccccagctacttgggaggctgatagggggattgcctgagcctgggagatcaaggctgcaagtgagccatgatcatgctactgcactccagcctgggagacaaatcaaggctttgtctcaaaaatactaataataataataataataattaggtgtataattcaatggttcttagtatattcagttatgcaaccatcaccacaatcaattttagaacatattcttcacttcaaaaagaaatcctgtaaccattaacagtcattctgcatttccccactaaccaccaacccagaattgcctatttgggacatttcgtatagatggaatcatgccatatgtgatcttttatagctggcttctttcccttagcataacattttaaggttcatttatattttaccatgtatcattacttcattccttgttatttgcaaatattattccattgtacaaatataactttttatttatccactcatcaattgataggcatttagattgttttcactctttggttattatgaatgctgatgctataaaaattcatttacaagtttttgtgtaaacatgttttcatttctcttgggtatatacttagaagtagattttctaggtcatatggtaattctatgtttaatcatttttatggcaaccctatgtttaactatcagattgttttccaaagtggctgccccatttttcagtccactagcagtgtatgagggtttcaatatctttataccttaaacaacacttggccaggcacagtggctcatgcctgtaatcccagcactttgggaggctgaggcaggtggatctcttgagcacaggagtttgagaccagcctgggcaacatggcgaaaccacatttctactaaaagtacaaaaagctagccaggtgtggtgtcatgcgcctggagtcccagttacctgggaggctgaggtgggagggtcacctgagctcaggacgttgagctgtgatcacagcactgcactctagcctggatgacagaatgagaccctgtctcaaaaaaaccgaaaaccaaaaaccactacaaccaataacaaaaacacttattatctgtctatttgattacagcatcttaatgggtatgaagtgctatcctatcaccttgagatttacttgttttcttttctccctaatggctaatgatgttaaacatcttttcatgtgtttattggccatttatatatcttctttagagaaatgttaattcgaatactttgcccattttgtacttgggttattttattgagttgtaagacttctttatgtatactaggtacaagttccttataagatgtatgagttgcaaatattttctccagttcgtggattgtctcttcacttttttgatggtgtcctttgaagcatgactgtggtgaagtccacaattttctaatttttcttttgtcaattgtgtttttggtgttacatctagaaaggctttgcctaacccaaggtcacaaagatttataccctacatttcattccaagagttttattgttttagctcttacatttaggactctgatccatttttagttaatttttgtgtatggtttgaggaagaagttcatctttattcttttgcatgtgcatatccagttgtcatatttgagaatgatgctcattttaccaaatatgaccatgttcctataagtaactaaggttgtaaacttcatgaaaccaatgcttgcaatgtcctgttgggtaagctcacctggtacctggcttataggtttccctgccttccaggtaggtttagaaggtcactttctggcaggtccaaaagtcttagcatctttgggggacctggagaagaaagcaatttgtctcatttataggaaatgcaaggaaatctgatgatgagttcttaccttggtttcttagcctcatgatagtaaataatgagaggttttaaaagcccattccgagattgcttataaaaacttccagcaaagcaaatttaaggtctctatggtaaaggaattttcttgctacacctgtatatataatcaggccagatctgtcaatgttgagagaggaggaagggagaaaccagttaggcagcagttagggtgggtcctctgttgaattctttcaaacaaaagaacagcctgaaaaatcaagctgcaggcacagataagggaacttgcacaggggcttgcctaagacatacccaccgctgcacagataagaaaggctacacaggtgacttgcccaaacattcccgcaatggaaaatttcgtcctctgacacatgcacagtgaagggaacaaagcaatatggagtaattcaagctaaaggcctgcatgcacactaggtggatgcaatggggctaccagaaatttgtgccttatggaaataaaatgtccagccctcatcggttcctataaaaggctttgtattcaactttgaaaacagcaatcctctttcaggccccctctctgcagcggagagctttcttttttagcttactaaacttttgctccaacctcacccttggtgtctgcgcttcttaattttcttggtcattacacaaagaacttcctgtgatactttgggcaatgagaaactgctacattgtggtgcactggggagactgtaaccatgtgtatcttactttgtgatcaagaataatctttcgagggttattttttattaaaagaggagagactatacaaaaaaaaattgtgtttcaatggaaaactatggattatctacatacaacacgccttgtgttacctaatctagactttctaatttttcttagagacagggctttgctctgttgcccagactgaagtcaagtggcatgatcatcactcactgcagcttgaactcttgggctcaagtgatcctcccacctcacctcacctaggactacagggatgtgtcactatgcccagctaagtgtttgtttatttgttttgtagatctggggcctctctgtgttgcccaggctggtcgttaactcctggcctcaactcatcctcccacctcagcctcccaaagtgctgggattacggttgtgagcccctgtgcccagccagtcagattttagcctttataatctctgagctattttacaactctttgtaaacggatagactacacattctgtcttgtctgatagggtttcaatgaacttatctcccctctcagggaaaaaatacctttgcctccatttgtaattccattcctttattccatataaatctgtaccttttgacttttcctttgatccagtgtaatatttgcctgcttccctcatcaaataagtaaaatctttcacacatgttcattttttatctgtatgagagtcatgattttacctttatttcaaaagttatcttttaacaatacattacaaagtgggatagagatgaaatcagataagagagaaaaagacccatgaaaatgcataggtttaggatgtacctcatttggactctgcagagacaatgaaacaaagtctcaaagaagttgatttgccgaaagatacaaccaggaaatgggggtgagataagggtgaagggtaaacaataattaatggaaaagaaattaaaatgacacaaaacatgtgaataaatgctcaatcccataatgctctcaaatccttttttaaaaagacctatcatttttcatttaagagagtggtaaagaaatagaagtgtggtactattcagggctggtaagtaggtagcaggaataggcgcatttctgctttgtgaataagggagcaggatacactctttaggaggctatttaataatatttaaatacaagtatcctttaaaccagcatttctacttttagatgtttaattggtgaaatgcttgcacaagtatgtgatgatatatgttcaaggatgttcattttcaatattgttgtaatagaaagcttggaagcaccctagatttccatcaataaaggactgtttcagaactctgtatctagaatggtgcattttttgtttaaaaatatacatatagtggtcatcttagagggatgggactataaaactttgtactccacattttttgttttacatgtttgtattacttttgccatattttttaaaaagtaaaaatatacctataagagaatccaatcttttgaacttggtacagtatcatataaatgaactcattttttcagtgcaccaatggaagcttctcagtggaggtggagagggttgtagaacagcattctgaattggacctccatgaagtagggcatagtcattactcactagtcactaagaacattttctatgggatgtgcacaatatccagacaagaattttaacaagatccacacatgctacttgagccaatgaaacactttacttaatcaattaactaatgaaggttttagggcaaataactacgactgaagaattgatgaactatagaatgtaggtgtatgtgtgtgtcttttgactgtagttcccactgaagagttgccgaatgatgaattaatgctaaatgatccagatacacatcatataaataattacttataaatattattcaaatgaaatttatctactttaaacagctatttgtgcagttaattgattttaaactgcatatacttccaatttcaaaataggctgatttgaagtagagtcttcagtaggggcgtagcatattatgattttaaaaatttaaatcttatgttacactaaaatgctgtaggaaatagatttgatcgggcaaccaaaccgatgtcatgggtcactattcgtaagtaccatggcaaataataatgattaacatttaccacagacttattgcatagaaataatttctgtaagttatgcctccaagcaactcagtgatgtaagtaatgatttatcctggcttaacagaagttaactaaagatacggagggagaaaatgaggccagggagttctctggggcctcttttataagggtacaatcccattcgtgaaaactccatttccattacccagtcctatcccaaagaccttgcctcctaacaccatcacatttcaggtgagaattttgcataggcatttgggaagggaggacaaaaatattcagtccataacaaaattcctcattgaggttgtgtgtattgactagataaaagaaattcaacagtttccatcccaaatttgtttgctatccaatatagatagcttggtttttgttttgagacagagtcttactctgtcacccaggctggagtgcagtggcacaatcatagctcactgcagccttgaccttctgggatcaggtgatcctcccacctcagcctccttagtagctgggactacaggcatgtgccactgtgcatggatcttatttatttatttatttttgtggagacagggttttgctttgttgtccaggctggacttggacttctggcctcaagtgattctcctacgttggcctcccaaaatgttaggattacagatgtgagccactgcacctggcctcataatttctgatttatattcacaataaagctaaaagaggaaacacatgtattgtggaacaaaaagcacacaaagaagctgtttgaatgtctttttaaaatttttacttttcaatgtttttattgatgtgaaatatttgaacatatttataggatacatgtaatattttgttacatgaatagaatctgtaatgatcaagtcaggatatttaggatatccatcaccatcagcattttaccatttccatgtgttgagaatgtttcaagtccttacttctagctattttgaaatgtgtaatacataattgttaaatatagtcacctatatcactataaaatattagaacttattctaactaactgtatgtacccattaacccatcctactttacttccccccacgcacactcacagatagttcccagcctctgataactgtcattctactcactacctccatgaaatcaacatttttatgagcatatgagtacatgtgataatatttgtctttctggtttttgtttttgttttgagacagggtctcaccccgtagcccaggctggagtttagtggcactatcacagctcactgcagcttccaactccctgggctcaggtgatcttcccccctgtacctcctgactagctgggactacaggcacatgccatcatgcctgtctaatttttgtatttttttttgtagagatggggttttgccatgttgtccaggctggtctcaaactcacgggctcaagtgatcagcccaccttggcctcccaaaatgctgggattacaggcatgagccaccacacctggccatatttatctttctgtgtcaggcttatttaacttaacataatgacctccagtttcatccatgttgctgcagatgacattatttcattcttttctatggctgaatagcatcctactgtgtaaatatatgacattttctttatgcattaattcattggtggacacttaagttgattccctatctttgctattgtgaatagtgcagcaataaacacaggggagtatgtatccctttgatatgctgatttcctttcttttggataaatacccagtaatgggatagctggactacaaggtagttctattttcagttttttgagtaatcttcataccattttccataatggctgtactaccttacattcccaccaacagtgtatgagagttttattttctctgcattgtcaccaacatctgttattttttgtattttttatagtcatttttactggggtaagatgatattgtggttttgattagcatttccctgataattagtgattttgagcatttttattatacctgttggccatttgtaggtcttccttggaggaatgtctatttagatccttgcccaacttttaaatggggttgtttgtgtttttgctgttgagttgtttcagttccttgtatattctggatattagtccttgtcagataaataatttgcaaatattttcttccattgaataggttatctctttgctctgttgattgtttactttgctgtgtggagctttgtagtttaatataacttcatttgttaagttttggttttgttgcttgtatttttggggtcttagccataaaatctttgcttaggcaaaagtcctagagtattccccgctatgtttttttctagttgttttatagtttagggtcttacgtttaagtcctcaatccatcttcatttgatttttgaatatggtgagagataggggtttaatttcattcttctgcatataaatatccagttttctcagcaccatttattgaagaggatgtcctttcccccagtgcatgttcctggcacatttgtctaaaatcagctgtctataaatatgtaagtttatttctgggttctctattttgttccgttggtctgtgtttttctttttataccaatatcatgctgatttggctactatggcctgataatatattttaaagtcaggtagtgtggtgcctccagcttggttattttcattcagaattgctttggctatttaggctcttttttggttccatacaaattttaggatttatttttttctatttctgtaaagaatgtcattggcattttgataggaattgctttagtagtatggtcattttacaatattaattcttccaatccatgagcatggaatatctttacgtttgtttgtgacctttgcaatttctttcactggtgttttgtagttttccttgtagagatctttcacctccttggttaaatttattcctagtttttttgtttttgtttttgtttttgttttgtcattgtacatgggatttctttattatttttcagctaattcattattgacattataaggtatatagaaatgctactgatttttgtatgttgattttgttttctgaaactttactgaatttgtttatttgctctaggagtcttttgaaggaatctatagggttttctagatatagaattatgttgtcagtgaacagagataatttggtttcctctttttctatttggatgccttttatttctatctcttatttgattgctctggcgaagactcccagtagtatgttgcatagaaatggtaaaagtgggcatcctcgcttgttttagttcttaggggaaagggttttagtttttccccatcagtgtgttaactgtgggtttgtcatacatggtctttattatgttgaggtatgttccttctgtgcagagtttgttgagtgttgtttatcatgaagggatgttgaattttatcaaatgctttttctgcatctattaggtgatcatgtagtttttgtcttttgttctgctgaggtgatatatcacatttactgtttacatatgtagaaccatgcttgcaatcctggggtaaattccacttgattgtggtatattatctttttgaggtgctgctagatttggtttgctaatattttgttgaggatttctatgtctacgttcattagtttattgacctgtcattttctttctgtgttgtgtttttgtttggctttgttaccaaggtaatactggttttacagaatgagttagggcaaattcccacctcttctcttttttagaatagtttgaggagaattgaaattagttcttctttataagtttggtagaattatgcagtaaagccattatgttttcagcttttctttgttgggagacttttaaatttgttttcaatctcattacactttattgatctgttcaggttttctatttcttcctgatttgatcttagtaggttgcatgtttccagggatttatccattttctctaggttttgcagtttgttagtgtgtagttgttcataatagtatctgatgatcttttgtatttctgtggttatcagttgtaatgcctcctttttatttctaattttatttgggtcttctctctttcttcactggtctagctagtggtctgccaatattatttatcttttcaaaaaacccactttttgtttgctgatttttttgtatatttttagtcccataggttttagtatgctatgtttccattttcatttgtttcaagaaatttttggcttctttctttccttccttccttccttccttccttccttctttctttcttttttctttttttgagacactctcactctgttacgcaggctggagtggagtggcacaatctcggctcactgcaacctccgcctaccaggttcaaccaattctcatgtctcagccccccgagtagctgaaactaaagtcatgtatcaccacatctgcctaatttttgtatttttagtagagatggggtttcaccatgttggccaggctggtctcgaactcctggtctcaagtgacctgcccacctcaacctcccaaagtgctgggattacaggcacgagccaccatgcccagcctgatttgcttcttaatttctttgttaacccaatggtcattcaggagcatattgtttaatttcatgtatttgtacagtttccagaaaccctcttgttttttatttctagttttatttcattgtggtcagagaagatacatgatatgatttcaatgtttaaacatttgttgaggcttgttttgtattctaacatatgggctatctttgaaaatattccatgtgctgatgaatgtgtactctgtagctgtcagatgaaaagctctgtaaatgtctgttaggtccatttgatctaaaatatgcagtttaaacccaatattcctttgttgatattctgtgtagataatctgtcagttgctgacaatggggtattgaagtccccaaccattattatattggagcctattcctcactttagagctaataatatctgttttacatttccaggtgctcttgtgttgggtgcatatatatttagacttattacatcctcttgcccaggcacggtggctcacacctgtaaccccagagctttgggaggccaaggcaagaggatcactcaagactaggagttacagactagcctcagtaacatagtgagaccccatcttacacaaaattttaaaaaattagccaagtacggggcatgtgcctgagggtgaagtgagaggattgcttgagcccaggaggttgaggctggagtgagccatgattgtgccattcccttccagcttgagtgacagagcaacagagcgaggctctgtctcaaaataaaaaaagagagaaaaaagatttttatatcctcttaatgaattgatatctttatcattatataattaccttttgtctctttttgctgtttttcacttaaagtctgttttatatgctataaatatagcacattctgcttatttttggtttctgtttgtggaatattttttccatccctttgcttttagtctatatatgtcttcacacgtgaaataagtttcttgtagataagacatagttaagtcatgttctcttacccattcatccagtctatatcttttaggtggaaattttaatttgtttacattcaaggtaactgctgatatgtgaggacttattcctgtcattctgttaattgttctctggttgttttgtatatcctttgttattttcttcctctcttattttttatctttatggtttggtgattttatgtagttgtaacatttgagtcctttctctttctcgtgtgtgttttctctattcattagttttatactttcatgtgttttcatgatagtagatatggtccttttgcttccaagcacagaactcctttatgcatttcttgtaggtctggtctagtagagatgaattgcctcagcttttccttgtctgggaaagtctttatctttttcttcatttatgaaggataatttagctgggtatagtattcttgagtagccatttttttcacttagcactttgaatatatcattccgctctcttttggcctgtcatgtttctgctgagaagtcaatttttagtctggtgaggattctcttatatgtgactaggtactgttctcttgctgttttaaaattctttctttgtctttgacttttaacagtttggctacaatatgacaggaaaaagcctttttttggattgtatctgtttggggatctttgagcttcctgtatttggatgtctaaatctcttgctagaactgggaaattttcagctaatattttgttaaataggcatttctatggcattaacttctccttgccttctgggacacaaaacatttggatattttgtcacttatgatgtcccatatatcagatagcctttcctcattctcttgtattcttttttttttttgtctgattggattatttcaaaagacctctcttcaagtttttcaagtttcttctgcttgatctagtctatcattgaagctcttgattatatttttaaattttatttattgaattcttcagttccaggatttgtttagttcttttttatagtgtctatctctttggtgaatttcccattcatatagtgaattatttttctgatttgatttctttgtattgttcatctccattcttttgtatctcactgagcttctttaatgttatttttaatttctcaagcatttcataaatttctcaagcatttcataaattactattttttgaaatctgttgttggaaaattattatgttcctttggaggtttcatatttccttgttttttcatgtttcctatttcctttttttttttagatggagtcttgctcttgctgcccaggttggagcacagtggtgcgatctctgctcattgcaacctccgcctctcgggttcaagcaattctccttcctcagcctccccagtagctggaattacaggtgcccaccaccacacctggataatttttttgtatttttagtacagacagggtttcaccatgctgtccaggctggtctctaactcctgacctcaggtgatccacccgccttggcctcccaaagtgctgggatcacaggcgtaagccaccacgcccagcctcctatttcctttcattgacatttgcacatcaggtgtaacagtctcttcttctatttttggattggcttttgcatggggaagactttttcctgtaggtgaatctatggtgttggttgggtagggcacttttgctttgattctgggtgtgtgcagtagtgcaggctcataggagttcctcggctataaactcagtcagtggtgtttgtgattttctcagtagcttgggctctggttgttaatggaagctgtggtgaggtttttctggggacaggacaaccctcaggcttccaggtggcacttgctggccggtcttgcttccttctttctttctttctttctttctttctttctttctttctttctttctttctttctttctttccttccttccttcttttcttttttctttctttctttccttctttctttctttctctttctttatctttctttctcttcctctttctctctttccttccttccctttcttccttccttcctttctttttctttctttcttatttctttttttttttttttgtctgtgatggtctaagcaggccattccctaggtccccaggtggcacatgcagttgtgtgctggtggtggtggtgatggaaggctgggcaggcccatcttcaggaccccacgaggagttcccagatgccagtagttatgaatgaggcagggagatgcccaggcctccagagagcatgcttggttgctggttgctggttttctaggcctgttgttaggccctttgcttgtgtgcatgtgttcccagggcaactgttggggtggtgtggccccaggctcccaggtggtgtgtttggggcactgaggggccaagcctggtaagatgggtctgtttttaggtgtcctgttggcccacttaagtgttggctttagtgggtggggcagggcaggcccccaggcctctggaaggtatgatagggtgccagcagtggcaggtgttctgaggctattattaggccccctgctggtttgcatcctcacctgggtgactgataggatgggctaacccctgggtccccaggtggaaggtttgggaacgggggggtgtggttccagtctgggtgggcctatccttaagctccccattgttgcgtatggccacaggctgtggtgagcattgtgggtcgatccccaattcttgggcagtgtgctcaggcagggatagtagcagtggcagtgggcagtaaaaacccatcctgaaggcatatgcaagtgtgcagtagccctgctagggatgggggtgctatttgtggtagccatcccaggaaggtggggttcagactctggacagtatgtactttggctcccagtaacagcagtggctgaagcagctggcaaggatagcccggactccaggcataagcaagtgcatggcagccctgctgctggggagagcattagggttgctgtttgtgaccacagcttaaggtagatggatttcagactctggggtgtaagcactttggctccctcctccctggtgtgctgcacctctctctccccagtgtataggacactgtacgggctagattgctggggatcctgctgttctactggttccaactggcatctcacctctgtagcccttctggtggatgtggggaaatgtcactgggactccagggaggtggagatgcaggagctgtggggcactgggacaggatgtagcttggtggaagttgggctctcaaaatggtgtcatgctgcagctgcctgggagttaggagacggggtggtgtgagacccactatgagctccctctctggagcaaaactctctcatggactctagggagctcctcatgccagtctcagggcctgcagggcttgaggaactctcccatggctagtattacaggaatctgtggtaaggatgtggaccactggggatcttgcacttcccctttccttgcactgaggagcctctctgagctcccagctgatcctggctgggctgtcggtttcacctctggctccttcagtgcctcaggtgtttcttgtcactttgttaaattctagctttctctcttagatgttctgttccaagtgtgagtatctactcaccattttggttctttgtggaggagctgagtgtcttgtgcctctagtcagtcatctcaaaacgtcactgctcagacttcttttttttttttcttaaatagagacaggatcttgctatgttgcccaggcaagttggtcttgaactcctgggttcaagcaatcctcccacctcagcctcccgcagtgctgggataacaggcatgagccaccacacctggcccaaacttctcgagagtagtagtgtttgacttttgtcttctgtggtgtaattattctctaatagcttgggattgaactctgacatgataaacagtgagtgtatgctactgagagaccaaaaagattggaatagttcacaaagggatataggagactctatttcccaggaggtcctgaacaaagatttacccacttagagtaagtataggcagggatacccttgaagctagaacactaagaggtggcacttatatgactctattcttgagaaaatttattttttccccctcgtggttggttataacatcgaaatagttaaatgaaacttgctctgagttgttatttgtctgccaccctcccctttagagaaactgatttctgaataatttctcttgtacatgcattttaaaggtgtgtaattaactggtaacaggttgttaggtagctgatgaggtgtgaagtagccactaatttgttttctttatttacaactttccctgctcttgaagatgacagcatgatgtttttcattccctgcttacttcaccagattgaaaagtgatttgtgaagccatttttaatccctcaaattccattaaaaaggaatctccaagggagtcttaatcaagacataatagacactaaaatgtgatcacacaacagcacttctaatatggccctatttcaactataatgttaagcgtttgcctccagtttactgaactcagccctaacactgacctacaacttctgaaatgaaataacctctatgcagttggcaattactttattgtaaatgtttgcagctaacatactttattgctttagaatttaacatataccccaaagggataattcgttaccaaattattatagtattatcagtaaaatagtttgctttccccttcaaattgccttttcccctacttaataatatatataatttaaatcagtttaagaaattaaaatggaaacataatgaaatgagaatcattaaaaacaccacactagaatactgaaaatgaagctgaaacagaaatggctaaatgtaaaatttgtatgtaaccaaaaggggtaatttgaaaccagggagcatattgagttattggatgagtttgatgaaaataaaaactctgtccttgaagttttaaaaatattaccaaaagtaagctacagaatatgtaaagaatatatcatggagaactccccttcacccttgaatagacagttaaccaacatgcaacaaagcacagatgttagatacgtggcaacattttcctttctacctgtcagagcctacattaatacttccatcgagaacattgtggcctccaggatactattttcaaatgtagatatgtctcagagcatcaatgctacaagttgctatggtgatcacttttgtatgataataaccaatgctcactgagtttttgatttatggcaggcactgttttaagtgctttatagtattaactcctttaatcttcacaacaatcctataaatctcattaggactctaagaatcctattaggattcttattttatagacaagggaactgaggcccaattttacagttaaaagtaatttggctaaggttacatagtgttggagaaattaaaaacaaaatctcttcccaatctctcagcaaagaaagaagagaaaggtaacagttttattattgaataagcactaaaccagaatgtgatgcccatcacaggcaatatgctaagagattgcaaagacagaaagaaatctcagccttttccatagccaagcagataccagatacaacccattacatacatgttttcttttctcttttttttttttttttttttttgagatgaagtctcgctctgtcatccaggctggagtgcagtgacatgatctcggctcactgcaacttctgccccctgggttcaagtgattgttctgcctcagcgtctcaagtagctgggactacaggctcccatcaccacactcagcgaatttttgtatttttagtagagatggggtttcaccatgttggccaggctggtctcgaactcctgacctcaagtgatccacccgccttggcctcccaaagtgccaggattacaggcatgagccaccatgtccggctacatatatgttttcaagataaataattatagtaagaggtctgtcagcactatttgtcacacatagttatcctcattttacttgatattttgtggtgttagctaattggctttatccagaagaaaaaacaagcatctcatctctttataataggaggtagttttgcagcttggagcaaggtatctaccaaagttaggctcctaccttcccacagaagacaggggtactatctcctctgatgtttacatttcaaagagatggctcctaggtcttaaaagtgacaaaaggcctatcattttcaaatggaattttatacatttcaaagagaggaggaagtccttacaattagaagggtttttgttttgttttgttttgataaatgctttaagaagaaggagaggatgaaaagtctcttcctttattttcatttttttctttcttttctctctctgtgtgtgtttgtgtgtgtgtgtgtgtgttttgtttttttgagacagggtcatactctgtcacccaggctgaagtacagtggcacaatcatggctcacagcagcctcgaacccctcagattcaagtgattctcccacctcaggctcccgagtagctgggactacaggtgcatgcctccacacccagctaatttttgtatttttcatagagacagggtctcactatgttgcccaggctgatcttgaactcctggcttcaagcaatctgcctgcctcagcctcccaaagtgttgggattacaggcgtgagcccctgcatctggccttatttttaatttgcatttgtccttacaacagataataagtagtggagttaggatttaagatagtctagctttaatttttttttttttttgagacagagtcttgctctgtcacccaggctggacgcagtggcatgatctcacctccacctcctgggttcaagcaattctcctgcctctcagcctcccgaatagctgggaccacatgcacgtgccaccatacctggccaacttttgtatttttagtagagacggggtttcaccatgttggccaggatggtctcgaactcctgacctcaagtgttccacccatcttggcctcccaaagtgctgggattacagacatgagccaccactcccagccactttaaagcctttttaagaatcctatactatgccatctttgtaagcttcctacttggaagccattgaacagaggcaatatactgaggaaattaatatattcactcaacacttacttaatgagcacctactatgtaccaggcactttgctagttattaaggatataattatgaataaaacagacaacagttttgccctcatggaacttagggtctaggtggagagactcatattaaacaaatagttcttcaaggttatcaaacaaaattatgaaaactgagaagaatgaaaagtataaagagttttgagagcatattaaagagagaatgtcaactagtccaggtggtcttgagggctatttaagttcaaaataggagttttgatgaagaagaaaggaagataacaaaaggataatttgaggtataaaggaaaacaaaaaaaatctcaggacccctaaacttcttattgcaaaagaggttaagctgcgaggctgagttaggcaacaccctcttccaaatgaacagctgttactaacatgcatcagccagatccccatggaaagataaaaggcctcaagcatctatgaagggctgcccccacacatcattcataagttctttgccggtctcctataaacaaggacatgccaatttaacttaaggtcttcctaaaattaaagtctgttcagttccacactgatagtgtagtacaagtttatcttcccaggtgcagaacaaagacaagactcatttctccacctagccagtgatgcctgcataactgaatcttcctttactccctttttctcttcaaaccttcaccttatcttatgtaaaatgtagattgaccaggcactaaccaaagtcccccgggaatgtaaccattcgcccgacctcctacctgcccctcttcctacactccttcccaactttaagaaaatgtataaatacgaaaactcttgagagtctctttggaaaaaacagccacagatgtgtctgtggcttgtgtttttcccagacgtgcttaaagctggcttaataaaccttgatgattgagatttgtgcctcattttggttgtcccagctttggggtattagattgggaggaataggattaaaaagtaggaatgctaccaggcacagtgactcgtgcctgtaatcccagcactttgggaggctgaggcaggcagatcatgaggtcaggagtttgagaccagcctgaccaacatggtaaaaccctgtctctactaaaaatacaaaaattagccaggtgtggtggtgtgtgcctgtagtcccagctactggggaggccgaggcaggataatcgcttgaacctgggaggtggaggttgcagtgagctgagatcataccaccgcactccagcctgggtgacagagcaagactccatcaaaaaaaaaaaaaaaaacaaaaaagtaatgccacactttgaacacttattctgccggactgaaataatatcatttgatagcacacatagaggtggaaaaggaatgatccttttcctccccatcataaagcatcatggctgatgccccagtttgggtgctcagaaacagatgccccaaaatatgagactcccccatctcaaaaaaacaaagttgggcactgttgattaatattttaaatgcttactcattatttttctagtttattcctttaatattttatttcattttttatttacacaagtagttcatagatatacaatttacacaaggtgctacagattgaatgtttgtgcccccctccattcatatgttgaaatcctagcccacaaggtgatggcattaggaggtggggcatttgggaggtgaataggtcatgagggtggagccctcatgaataagattagtgtccctataaaagaggccaggagaaatccttcaccccttccatcatgtgaggacacagtgagaagacatccatctttgaaacaggaagaatgcatttcacagacattgaatctactgataatgttgatcttggattacccagccttcagaactgtgaagaataaatttctgttatttataagactcagtgcccttataaaaagtccccacagggacaaagacaatagtgttctttatttatttagtagagacagggtctcactatgttgcctaggctggtcttgaactcctggcttcaagagatcctcctgccttggcctcccaaaatgctaagattacaggcacgagccacaccttgccaacagtgatatattttatcttacttttttccccactctattcaggaacttctctgtgattccagatgttcaaagtatttcatcacagctttatttgtcttaaatccagatgtctttcgttaaatgaaaaaatgagcaaccaccaacaagctgagattatcttcttccaatgagcaatgagtcagaactgggctggactttcagtgatccttttaattttattttgtttaaatgctattgggagtaaacccatgaatgcactgtgaccccagaaaggcatgaagggcaggagaggaagaattagctatgagcaaatggggaaggcaggcagtgagctgctttgcattaaaattctaaaagttggttgtggcaggggacaagtgcccggagagaaagagaatgtaagggaagtgagccaaataataatttctctcaaacctagcaaaaatttgactgagatttatgagagtttaaagccctccctctatgcttactccatgtctctttatataatttttttttctttttggtttatgtcccccttcccccttggatttaagctaaatttagactttctttaggattaaaacaagcttaataaaagttcttggagcaggatttttggagtgagagtttaaaggattaattcacctgtcacgtgactgctatatagaggaggatcacagaaatgtaatcacgagtttgcatttattattgtcaaaccaggaagaccccttgcctgaaccgttatataatactttctaaactataattttcaaaaagggacatttatgactcttgccaaatataaaatatagacatgtcacacatttccttttttttcctttaactcattaattaatcagagaactattaagatactgaaaacagttcagaccaggtgcaatgacttacgcctgtaatcccaacactttgggaggccgaggtgggcagatcacttgaggtcaggagtttgagaccagcctgaccaacatggtaaaaccctgtatcccatctctattaaaaatacaaaaattagctgagcagggtggcacttgcctgtagtcccagctacttaggaggctgaggcaggagaagcacttgagcctgggaggcggaagttgcagtgagccaagatcacaccactgtactacaaccagggcaacagagtgagactctgtctaaaaaaacaaaaaacaaacaaacaaaaaaacccaaaaaattcaaataaaaatttgaataacaggtatgtgtgtatgtaggataccaaaaatgctgaaatgaacttgttaataggtgcatactggttaatattttataggtcttaaaatgtcatgtttggggattatctcttctaaaagttagaaatcaattgcaactctaccagacaaaaatttttatttgcatttttttttcttagacagagtctcattctgtcgcccaggatggagtgcagtggtgtgatctcggctcactgcagcctctgcctcctgggttcaagcgattctcctgcctcagcctcctgaatagctgggactacaggcgcgcgccaccatgcctggctaatttgttttgtatttttagtgcagatggggtttcaccatgttggccaggatggtcttaatctcctgacttcgtgatctgcccaccttggcctcccaaagtgtatttgcatttttttttttttttttttgagacagagtatcgctctgtcacccaggctggagtgctttggtgcgatcttggctcactgcaacctccacctcccgggttcaaatgattctcctgcctcagcctcctgagcagctgggactacaggcacgtgccaccacgcccagctaatttttgtatttttagtagagacggggtttcaccaggttgaccaagatggtctcgatctcttgacttcgtgatccgcccacctcggccttccaaagtgctgggattacaggtgtgagccaccacacccggccatgtgtatttgcatttttatggaaaaaatattttgtattactacagaaaagaaacatttgggttgtcaccaggttttttcaacttaactattttccctataggttgtgaaacagtctagtcgatcaaagattatttaagatacaatattttttgtgtgtaaaggaaaccaaaaacattttaccccaaaatatacttctttgacatatttcaagatggttattcagaggccctgcagacaggaatagtctagcataaactaaactaaaatcctaaacctccccaaatgactgagtgggccacctcttggccaaggggacccagagaagcctgaaaaactgaactcctggtcatgatgggatgagagtgttacaggtagttaggtctgagtggggcaggagagacctcttccctgcacccattagaaatgtcggatggttcggcaattatcacattgcctctctaatagtgataaattggctatttcctgagggtccacacctgtcaacattaaagtattaattaaaggcagaccccagggagaagaaacttcctgggcatgcacattaagagtcaaaaatggcgaagtatgatcttccgggtacacttcactgtaaacaggaagaaagcctcagatgggcatgcatacaacttcctaaaaacactgcgcatgctcacttcccaagggtaaggagggctctgcacatgctggcagccaaccctaagggaagaatcatgagaaagaggcaagcctatgaaagtcctaggatcacagttaaaacagagcactggacctctctctactcctcatgcaccctcctggatctcttccaagtgaactttcctttctttcctgttctaaggccttttaaataaacttccactcctgctctgaaacttgccttggtctctttttctgctttatgtccctcagttgaattctttcttctgaggaggcaagaattgaagttgctgcagatgcgtagggatttgctgctggtaactcagggtaactcagatctcttccaccactaacaagaggtcaggcaagcctcattatctcctccttcctttggagttcagaaacatcataacactaacaaaatggacttttttttttttttgagacggagtctcactctgttgcccaggctggagtgcagtggcatgatctcggctcattgcaaactctgcctcccgggttcacaccattctcctgcctcagcctcccaagcagcttggactacaggcacccaccaccacgcccggctgattttttgcatttttagtagagacagggtttcaccgtgttagccaggatcgtctcgatctcctgacctcgtgatccacctgcctcggcctcccaaagtgctgggattacaggcatgagccaccacacccggcccaaaatggactttaagttaatagtatcttaacttaaaatattcctttctgttgactccaaatttttagacaaaactttacttctttaaccaattgcaaattggagactctctgaacacacctatgacctataaaccctcgtgtcaagataatgccacctttttgggccaaatcagtgtctaaccatttatggattgatgactttgcctgtgacttctccttccctaaaatgtataaacagagttgtaacctcactttgagtgaggactgctcactcaaagcttcttgggtttgtgttttttcccaggccatggtcattcctattggcccagaataaacctctttaaaatattttacagactttggtttttctgttaacacctgaaaagctgccttttgtaaaggagatttgcatctgtggagaaaattgacattggtgaaatagccaggctttctccgaggctcccctcccttttcaggatctaggacagatgaaccaaaccacaggctatcaactattctttctgaaagcagctccaaaattacctgagatatttcacctgcataagatggcctttgcttgacatgcttttccgctcttcattctcccataacctgtgacaccaccttccacagagcccggagaaacttggtcccaggcccttggtctttgggctcattcattttccctcaaaatcatatttacttctatacctccccatctcccttctccccagtgaagaagatatttaaacatcaaacatctgtccctcctccgaattctttgagacaaagtctcatcctgtcacccaggctggagtgcagtggtgcgatctcagttcactgcaacctctacctcccgggatcaagtaactctcctgtctcagccacccgagtagctgggattacatgcatgcacgaccatgcctggctaatttttgtatttttagtagagacagggtttcaccatgttggccaggctggtttcgaactcctgacctcaggtaatctgcgtacctcgtcctcccaaagtactgagattacaggcgtgagctaccacgcccagcccgaattcatattttgtatgactcccatgcatgcctgtgcacacagtaatctgttatgcttttctctgtgggtggcaagccactcaggtgccgaggcaagagaccgagggcacgagctgttccagtataataaaatatataaaataagaagttatactagatataaatcttagatatgattatatatgactatcattaatcattagtttgtagcaattactctttattccaatattataataatcctcgctctacaatcataacctaggaaaaaccaggccatacagagataggagctgaggggacatagtaagaagtgaccagaagacgagtgcgagccttctgttatgcccagacagggccaccagagggctccttggtttagcagtaacgccagcatctgggaagacgcccattgctaagcggaccgtggtctagcggtagcgtcagtgtcaaggaaaaacacccactacttagcagaccaggaaagggagtctccctttccctgggagagtttagagaagactctactcctccacctcttgcggagggcctgacattagtcaggcccgcccgcagttatccggaggcctaaccgtctccctgtgatgctgtgcttcagtagtcatgctcctagtccgccttcatgttccatcctgtacacctggctctgccttttagatagcagtagcaaattagtgaaagtactaaaagtctctgataagcagaaataatggcgtaagctgtctctctctcctctctctctctctctgcctcggctgccaggcagggaagggcccccctgtccaatggacacgtgacccacatgaccttacctatcattggagatggctcacactccttaccctgcccctttatcttgtatccaataaatatcagtacagcctggcattcggggccactaccggtctctgcgtcttggtggtagtggtcccccgggcccagctgtcttttcttttatctctttgtctcatgtctttatttctacactctcttgtctccgcacatgggaagaaaacccaccgaccctgtggggctggaccctacatttctctcctgaatctgtattttgtgacagaggtgtagggaccaagggacaacttctcctttggtctctgaaggtacagtgaaaaattaactgacaaaaaccagattaacaggagaaaagacatacacatttataaatatgcatggagggaacaatcatagcatgattaccccatcacacaatgaggtacggatggttatacagtttttcttaggggaagggagatggataattttaggggaatagcaaataatttttaggggaattcaatgaacttgaagaacatacaatggtctgagatgaagtttgttgggtttgcagagcagacaatggcttgtgactaaagtctatccaattgtgttgacaggctttggtgtttcagctaacgttgcccaggctggtctcaaactcctggcctcaaataatcctctttggcttcccaaggtactggaattataggcaccaatgcacctggccagtgaccaactttaacagttagcatttgaactttggtagttagtactagaatgttaaatatcttaaagtgatttttctccaaaatttgaacttgatatcatctctatagtttaaaatccttcaaatagcttctcatagtatttcagatgagtaatacaatgttttaactgagtcagcctatttttctagctttatcttccaaccattgcccttgttcacaatttgaggagtggaaagatggggaaggggagggcaaagatgcgtcaatagtaggttgcatcactgcactgttccctcctctccctcctcctcggatagcatctaaaacaggtaagtatcagcatatcgactggaactctccaaattctacctctactcctttcaggaaagagacgttctccgcacacatatcagctctggagcttcttgttatgtgggatgattttagggggaaaagtgagtcctacttttccagggtttttttttttttttttttctctttaggggaagcttagtccattgtgtgagtctatagttattgggtaaactcaaatatccagatttatgtcaaatttccatatatattaaatggaaaaagtgcctcaaaatgttaccatactcaagctgtcctaattcctaacattgaaataaatcttatttttaaaaggtaatcctgttttaagtaaaatggatttcactttggacacaccttagtgtaaattcattgattcattaacaagccccagttacattcctaagaccacacggctttgtttctgcttccacctagttcccacacacaaggcaatcatcacaactcttattgtacccactaattttcaatggaagccaggagtggaagccaaagacacttctctccactgctcccacggagacataccatatgggcgtgtgtgtgacatgggtgattcaaaaaactgctgtgcccccaatctgatatgctttgccagaaaatgggtcccatttttataaatttctatttatgtgaataaaacctgagagaggggcacatggaattggggaatctgtgggttggggttggtgagaagatggggaaagggctttaacacagggtgttgctcaaatacattaagcctggacaggacatcgaagtaagggggattgatgaacgctggcacctgggaaaggagaggcacttagagagggtggtgcctgcagagagaaggcttttgcagaacatccaacattaactcagtccacttcacactttaaataagagccagtgttattcactcccaggggtgttcttagtctgaagagagcagttctgtgaacatagatgagggagaaaaagaaaaaaaccctgtatcttcctacattggaaaagggaggtccacaagctttaccaaagggaccagtggctcaaaagatagtttaagaatccctgagtcttagcgattttctcattattatgtacttacaatactatttttttcttatcaacaatctctctagagactttttcaatttattcttttaataacactttatatttttgtggctctctgtatatgtcttttgatatacttcttacaaagtctgttctggtttatagggactttgaaagaatgggctacctggagaaaaatatccgcagactaaggtacagctaaggacaagagccctaatttcagtttagaacattgtgatggacttgttgagagcatttatggtgcattcaaaatctgcaaaaaggccaggtgcagcggctcatgcctgtaatctgagtactttgggaggccaaggtgggaggattgcatgaggccaggaatttgagaccagcctgggcaacatagtgagaccatttctagaaaaaaaagaaaagaaagaaagaaggaaagaaagaatgaatctgcaaaatattttaccaacacacccaccagttttgcccaaatgccagagaagaaagaaaaagaaaagatgaaggcattataaacacgacggtgtgcagcattgctatcatttatctcaggctgctcaatactagcctcaattcatcttctcccaggaaggaatgtttgtaaattgcatcagaatggttctggactatcaggaatgctgggcggcctggacacctggaagcagttagagaagctctcatttgcaatgtcttgttggtttcttattcttgaatatattagccaagggggaaaatgcccagacatttgtgctcacagcagtacgtgatcacatctctttttgcatgaagtattttaagagggaagtgatttctttaagtgcctgattatatgaaagttgtgtatctgtcatcaagaggtcataactgagtgttgggttaactttctgctgcagttatttttaagcatttctactcgatattcttccagttgtgtagtttcacattttaatggaaacaacacagctcaaaacacatcaagaatattttaggccgggcgcggtggctcacgcttgtaatcccagcactttgggaggccgaggcaggcggatcctgaggtcaggagatcgagaccatcctggctaacacggtgaaaccctgtctctaataaaaaagtacaaaaaattagccgggtgtggtggtgggcacctgtagtcccagctgctcaggaggctgaggcaggagaatggcgtgaacccgggaggtggagcttgcggtgagccaagatcgtgccactgcactctagcctgggcaacagtgcaagactcggtctcaaaaaaaaaaaaaaaagaatattttagtgattagagagcaagtttagattatatttgtctatgcattttggaaatggtagaaaaaatgtttattctctgcaagactatttcatactctgtcaagaatgttcaagaaaaaaacagttttctttcgtttctaaataatcaaataattactgttcacttattttcttgtctaacgtaaaatatataaactggggtaaaaaatgtcagtgcaaaaggcttttagattgtctatcattttttaagttttcctaaacctttttatatcaaattaatacatatcctaagatataaattttacttgataatataagaaattttctttattgttcagattacttagtttattgctatctttatttattggcagatggctaaaatttgagaaatgtttaagaatttaaaacacctgtagatgagacatgattaaatttaactcctttaggctaagagaagcctattttctagattacctttccaaatacacttccccaggatcctagaacacaacttagtgacatttcagagagttaacaggaacattgagtaacattgttagaagtgtaaaaatcaatcaagaaatcactcactttgggttgtcaggttcaaaagatacgtgagttcagccaaagcctacttgtaagaagccagtagattgctctcttgcgagaagcatatgattcttttccaagaaaagttgaaatggtgtattaaattgctttattttttatttaaagtagatctcctccattaaggctcctttgagtaacattctaaaagtgaaaagaaagctttgtatcggagactattcttattaaaaagagtaatataaatattatatcccaaaattctagggttactgggatggggtggagataaggcctaggatatggaggcagttttcactggttacaactaatcaggctgggcttggtgattctgttgggcaattttgttttatgtatttttatagaccagaactaaacattttaggaggaggaggaggaagaagagaagataggagaatatcattagacaagcccagccacctaggtcaacatacaaactaattagagtagccaacttcctcaatcctacgctgtctttcaaaaagcattaaaatcttctcccccatccactcccatgaaaatattttgtcacctggtgaagcttccacatttttcagtgagaatctcctaaatgaagaagataaagtatttttttcagtcacttccagacgagaggattttattcagttttcttttctctttctttctttctcttttcttttttttttttttttttcccagggtctccctctgttgcccaggctggagtgcagtggtgcaatcatggctcactgcagcctcgacctcccaggctcaaatgatcctcccacctcagcctcccaagtagaggggactataggtgcatgccaccatgcctggctgatttttgtattttttttttttttgtagagacagggtttcaccatgttgcccaggcttttattttctgtggtttacatttcaaaaatgatagggtttgtaggggtggggaaggtgttttttaaatataaaatacatttttcaaaatcccctcccccccaccacataaaacaagataaaagacaagcatctctctactaactgactttagaacctgacatttccacattagttcaatctttggattaaggcaacaaagggatcctgtttcaatgtaattctactggtacttttatagatgtttatcagattggtccaaatgcctagtacggttcacatttgaaaagaaaaccaaggtacaactcaggtagggctgcttggtgagggctaccttagataaggcaccactgagagggtcccaggcaactatggaaagacgactggggagtccccaaagaggggtggcttgtgccttgttttcttttatagctttgacatttgtgtagtgccttgaaggactgagttatatgtgacagacttttctgcttttccctggaggctccaaaatagtcatctgagacggagtaaatggaaccagctgatatggatttataactcattacaaatctggcctgctactttttgcattattggatgtgtttcactaggtctgttttctggcagatgtctggcatgaaaggctgacttccatttttgccagcgttatttcctgccttcctttcgactacaggacttacaaacatctggcagagaaaaggcaaacacagttatgagtcacaatgtagaaagtcaacagtaggcccaactcatattcttgtgtatcctactttgtgtaataaggcgcattcaaaattctaaaaacccacactattttaaatcaaataatattctgccattgacttttggttttttaagatatatggtcctatacaacataaatcttgaagatttatgttcaaaacattatgaagatctatatatttaatagaaaaattaaactttataataaaataacagcaacaaaaggttaaaaatattttaaaaaacacaattgctataccaaatgaaaaagtggctattgtcagcgaagaataggaaagaacacatgttttttaaatgttctcaaagaacaatttttctcaatgtacaatttattgtcccagtttatttaaatattggcttttttcttatcttatcttatcttttcttttcttttttgagacgaagtcttggtcttgtcccccaggctgaagttcaatggcgcgatcttggctcactgcaacctccgcctcctgggttcaagcaattctccagcctcagcctcccgagtagttgggattataggcacctgccaccacgcccagctaatttttgtatttttaatagagatgaggtttcaccatgttggccaggctggtcttgaactcctgacgtcaggtgatccgcctgcctcggcctcctgaagtgctgggattacaggcgtaagccaccgcgcctggcctatggttggcttttttctaggcatctttaaactaaatttaataatggctgacaatagcacaaaaactccaaacccaaccaaacaacagacagacagactccacccccatttgagaatttgctctactgcaaagcactatgctaagagatctagacagattgttctgttttatccttacaacaatttactattattattgctggtgaaaatgtagaagacatacagaggtatgaatttgaagtactaatgagtcattctgcagtatttctcagtgaatattgctcagaccacctacaccagaatcatctgagacccttgttagatattcattttcttgggtccccaacactcagaaattctaattcagaggtttgaggtaggaatctggaatttacttaagaagcactttgagtgattctgatacacaataaagtttgagatcacttgtgaatattcattgttaatattaattgtatacttttttttttaaacggagccttgctctgtcatgcaggctgaagtgcagtggcacgatctcggctcactgcaacctccttctcccaggttcaagcaattctcctgccttagcctcccaagtagctgggattacaggcgtgtgccaccatacccagctaatttttgtatttttaatagagacggggttttgccatgttggctgggctggtctcgaactcctgacctcaggtgattcacccaccttggccccccaaagtgctgggattacaggcatgagccaccacactcggctaatgtatacatattttaacatagaaaagtataagtaaaatggcccatgcttcccctcttggcataaaaataaaaatgtgtattagacaattaaagtaaaacaaaaagttagaggtaaaggctccccctttgccacgcccttcatcctaacacacacacacacacacacacacacacacacacaaaatctccctcacccctaaataactgtgattaagtttcttgttaccccctaggaaaatgttagcatttacgtagatatactttgtatcaagtgaatcatactatgtttactgttgtgcatcttaaaacttactacatatgactcaagatctgtctatgtaggacatataaaaccctaactcattcatttaaactgctgcataatatttcattaaatctacgtactaaaatttaattatttcttactttcagtttttttttactattataaacagtgtttccatgaatatttatatagagctatagatatctctcttggttgtgctatcgctttaaaagtgtaaattgggtattataattacctaaatagagacatctatgtttactagaagcctagagccttcatttaaacttatttctgcaagaatggaaagaaaatttcttaccaaagttcatattaaagcagctaattagtgttttatttgagttggcttaattgtagaaacacagagaaccctatcatttatgaatttaagaggactacaaatgcaaaagaatgaataaaattaattggaataaggcaaaacggaagaaaatggagcaaatgtagcaaaactctaagagaaaaaggattagagaagattcagaaagtaaaatttaactgagaaagaggattattagaaggaagactataaaagcaactgtattaattcattttcatgctgctgataaagacatacccaagattgggcaatttacaaaagagaaaggtttcatggacttacagttcctcatggctggggaggcctcacaatcatggcagaaggcaaggaggagcaagtcacatcttacatggatggcagtaggcagagggagagcttgtgtgggggaattcccacttataaaatcatcagatctcagccaggcatggtggctcacgcctgtaatcccagcactttgagaggccgaggtgggcggatcatgaggtcaagagatcaagaccatcctgaccaacatggtgaaacctcgcctctactaaaaatacaaaaattagctgggtgtggtggctcacacctgtagtcccagctacttgggaggctgaggcaggagaatcacttgaaccttgggaggcggaggttgcagtgagccgagatcacaccactgcattgcatcctgggcaacagagcgagattccatctcaaaaaaaaaaaaaaaaaaaaacccatcagatctcaggagactttattcagtatcatgagaacagcaagggaaagacctgcccccaggattcaactacttcccactgggtccctcccacaacacatgggaattcaagatgagatctgggtggggacacagccaaactatatctgcaacacagtaatctgcagtgattatttcaaacataccaaagttattcagtgtatgcatttgttcatgcactaatttactcaatgaatatttatcattcggcactgtgctaagtttgaggatatagggaaggaaagacatatttcctaccggcaacgagcttactgttcatggaaatacagatgcaaaaaaaaaaaaaaaaatcaattgcttttaaaaagcagaaaaatagtgttcctgacaaagtctaagatgttttcaaagaagaggtttccaagttgcatctaaggtagaagtaacatgtgctgcgtcattgaggaatataagagcagagtgggttagaaacccacatgtagttcgtgttgccacagtggaaagcataaggtgagaactgcagcagtgagaggtgatgtcgctaaacaggagctgatgctagatagggacacagggccagatcctgaaaggtttcgtttgcatgctagaaaactgagatttttatcctgtgagcaatagggagcagccaagaattttgaatataaatttaacataatcagattcacgttgtaaaaagccctctggagactgggtggagttgaaataatctaggtcacagataatgagaacgtggtgatctccagtagttatggggctaggccaggaaatgagaggactcctaacaggcagactcacagcgtcttggccattgattggatggtgaagggaggtgggggaaataatttatgacattgccaacactggggaaatggatgtctgatagtatcattctttgaagtaggaattaatgaaaggggagcagatctttccaaaatctcttttagatgttctccaccatatcagaggcaacactcttacacacacaaaaaatcatcactttcccttgactaatctgaaaatttataggtaatataacctacttatatacatatttaaaaaactttaatacaatagctcaacagtaagataaagtataaataaaaggaaagtaattgaggacaaaatatattaatacataaatgttcaggcatgactacataaaggcataatgaagaagtcagatgtgtttgcctatatgtgaagtcattgttagtgtcccaaccacaggtgcaaatcaacacacctctgtaatgcatgtcataaagtcttggaaaagagctgtgttagttcattcttgtgttgcaataaagaaatacctgagaccgggtaatttataaagacaagaggtttattttggctaacagttctgcagcctttacaggaagcatggtgctggcatctgcttttggtgagggcctcgggaaccttccactcatggtggaaggcaaaggaaagctggcatgtcacatgtggagagagggaggaagagagagaagagggaggtcctagactcctttaaagaaccagatctcacatgaattaactgagtgagaattcactcatcacccagggaatggtactaagacattcatgagtgatttacccctatgatccaatacttcccaccaggtcccacttccaacactgaggatgaaatttcaacatgagatttggaggggacaaacatccaaaccatatcaagagcttgtcttggttgcagtattggagaaggctccataacactgttgacatttcagcttggcgtttcaagaaggaatataattttgaaaggcagaactagaggaagaagaaaggggtgttcccaatacagagaacagtacaaatggggagagaaaaaggaaaatactgggtgttctttggctttggctttggctacggcagaggttgcgtgtagctggtgtacgaagctggagagatgtgttcccgctagtacagggagggcttcgaaagtgtaccaatgagtttagactctaataatcccacgtgacctcttgctttggtaggttgtttgcattcatcatcatcaagaataattctattttcccatatatattgaactgattatctttaatctttccctgaccaaattatctcaaattctaaagtgatgacatacaaattaatgatattttgttttctaaattgataatgctgctttaaagagagtttgaaggtaatgactacatataaaaatagatttcatataaagtcaggcttgaaaggatcaaataaagtatttggtgctttttcttctggataataatctgtgaagaggacatttattatctctgctggtagtgatatcagagggagagtaaaaagcatgtagatgatagtgccaggctgagagaagagaatagattccactggacaacttcctaagggaaggtgcatgttaacattctatcatttaaatcacagaagttttcttttgaaagtataaagatgtattatataataatatttaacaatcctaagaggtttgttaattatccttgctgaaagacaacagagataagtttcgctcaagcaatattcttctgagaaaaatggacctctgtctctccctttcttattttgttttattttagcctgaagtgtcccattacgttttcaatgccttatatctaccttctcttcaactgtccatttggctaagaattcagcccacaggaatcaggaataggacatttaaaactacttcacgcattttaaatcttataaataattgagatacagttgatggttgctaggctgcagttgaattccatttcatcctatcccattataatgtaatttaggtttgtttagttgttgttttttttgcttctttttaatcctatagggaaaagtttttgatgattgaatgctgtatttgatagtacctattatcaggcaaggactttgagatatttcataccgtttcttttcatatcttcaaataaaagaatgtgtgaagttcccatgctagccacaccacggacaacgttaaggagaatgaaaatgagcagggcctgaaagttgctttctttggtcccaaagtgactcttctggacacccagaggtaagggcactaaactaagttacatcagtttatcaggtggaaatcaacaacaggtgaattaaacgtcaacagtgaaacaccattgcatcttgttctttagcccaggaactccagaaggattccatcttcagagggcaactctgattggtggttacgtgtctaaagcaggagtctgcaatccacagcaggcaactacagactaaagtctttggatcatatccagccagtcacttgttctataaacaaaactttattggaacacagccatggtcattcattccatattgtttatggccgttcttcccctgtaacagcacagttgggtagttgcaacaaagattgtgtggttttcaaagcctaaaatgtttactatctgactttttatattaagtgtttgctgtgaccccaggtctaaaatattaggttatacaggctgctgaggccccaactaatctcagaaaaaacacatgctatgattgatttttcttctgtttgccatgttcatggaggaggagtgccatgtatttatcagccctgctttttccccttccccaagtaagagctgcatgatggaacatagagatgtaaaagaatagatacagcatcaaaactaggaatgagtagacattgaatagtatttcaaaagagttggtggcagctatttgggaggctgaggcagaagtattacatgagcccaggagtttgggtctgcagtgaatcatgtcacactactgccctccagcctaggtggcagagagacagatcctgtctctaaaaaaaaaaaagaaaaaataaaagagttggtagcaaggatgcaggaagtgatgtcagggaaaagtgatgaattgtcactgggaatcattgaaaagctgtaaaaccaaacctatcattacaaatataagcatattaagtttagttttctgttctatggattgaattatatttattgggaatataaaaaattcggaagaaaactctatgactttaataaagggaaggaaagaaggcatagtggtaggaaagagctcaccttacctttaaaaagagtggctctctctttctctgtatcatctttcacatccatacacatatagtcacacattcaatccttctcattacacaaagctgtggatatcctgggaataatgacacttatttgcattgagatattggagccagaactggaatatatctagttatctagttatttgtttgaagtgagcttaaatacagtacttgtgaatgggaaaagggaatattttcatgactctgtagatcctacaggcatattcctatacctcagaaagtcagaatagaacctaagaaaagacaatctaaaagtgtcttaatatttttagaatatggcgttagggatgcttgttagttgaaatgcaaaaatctcaacttgtggaaagatacaaatgatccatcgattagaaaattaacaaaataagagcagttgggaagtcagcaatacgccttgaggaggaatccggctaaataaatttaatttctttctttggcaccctgacaaagaggaagcaatagatataatatctccagacttcagtaaggcttttgaaccatttcacatgacatttcttttcaacaagctggtaatacatagcttggatcatagtgctgtcaagtggctgaagagttgcaatcaaagagtagctatcagtgacttcttgtcatcctgagaacatttatcagggggtgtccatccataagggctggttgtgggccagagttatccacagggtgatgaaagtaagagcaagttcaataaatttgctgataacaccaatctggagcagctgcttacacctggcaagatgggaacagctttcaatgaccttgtttaagctgggctggtagagtgagacgatctcagagccaggatacctggccaagacacagtgggcagattttctatgcaggaagacttatggcatgttgcagtaaaactgggcagtgttttatttctaaaattttctgaagcactataattaattaacaattctctatgatgccaagtggtttagaattacttttattatactagtttcccaatttgcaaagtagagactcaaaaatcttgtctcataatattattttgaatgttaaataatctctggaaagtacctaacagatattgagtgctgaatgttagtttccttcctcttccctattttcccaccctgttctagtgggaccagcactgggaagaaaaagccctaactacaatacagaaattcaaaagaaaaaaagagacaaaaacaaaacaaaagaaacaaaaacattggcattgaaccttaaaccacactctggcatacctaaatattactgcttaattaataacagtttaaccgtcaagtagaatacgtttgaaaggatatttcaaatttatactagtggttataagattttctagaagttcaccttcagcaattatggaaggtggagaattattgctttttttacatggtagatcctaaaaaaggttagttcctgcatgatgggcactcaatagctacttgttttattgccctgtgtgttgtcagagaaatgtattaaaagtatcagcacttgataataactctaaagcaggtgctcttaactcccttgggaatttgatattccttgagaacaagaaacaaaagccagtgcaacatttagatcacagttttactcacaggtccttatctaagtctaggtagagaaaggcaagataagtcttaagttgttttcccattagtaaatgtgactggacagaccctggtacttggagcaggagagtgacaggttaagtaatgggaaagctggctgaggttcatggtcaatgtcttgcaaaaataaactaaaagatatcttagttgtaaataccttctgcccaaacaagatgatgtgaaaaggatcctgctccaaattccttaaactcaactgaggaaaatagagagccacagtcagagaacaaagtttctagcctattaacgctctctcccttcatcctcacgctcagcttattgcttttattacactgaaacccattgactaatcaaaagggagcttccaggctgggcgtggtggctcacgcctgtaatcccagcactttgggagaccaaggcgggtggatcacttgagctcagaagctggagaccagcctggccaacatggtgaaaccccctctctactaaaaacacaaaaattggccaggtatggtggcacgtgcctatggtccccaagatggagtttcgctctatcacccaggctgtagtgcaatcttggctcactgcaaactccacctccccatttcaagtgattctcctgcctcagcgtctggagtcactgggattacaggtgcctgccaccaggcctggctaatttttgtatttttagtagagatggggttttgccatattggccaggctggtctcaaactcctggcctccagtgatccacctgcttcagcctcccaaagaactgagggccaccatgtggggcctgagtttcctatatttttgtctacatttcctcttgtctgtgtcactctttaatgtactgtaattagtctttttttccctctgctatactcagactcctattagcaagatactaacaacctccacatggataacaccaatgattaattctcagtccttgttctaattcacctgcccatagatcacttccccttatttgaagcacttccttcttttttcctcctagaccccattttctcactggcagctcctcctcagtcttctttgcttgatgcttctcttcttgacctctaaacattggtacatcctaagattgtcctcagacgtctccttttcaatctctatgattaccctctgggggattttatccagtctcatgattttataaaccacctactcactgacaatttccaaatacatattatcagctcagatctcactcctgaattccatacctctctatctaactgccttcttaatatatccatttagatgtctaagtgacatgcaacataacatgtccagaactagatccttggcccatacccctaattgttctttcccagaattttccatctcaataaagtcaacttcattcttctagttgttcatgtcaaaaaacatggagttggcctggcgtggtggctcacgcctgcaatcctagcactttgggaggccgacgtgggtggatcatgaggtcaggagatcgagaccaccctggctgacacggtgaaaccccgtctctactaaaaataccaaaaacaaaaaaaattgccaggagtggtggcaggtgcctgtagtcccagctactcaggaggctgaggcaggagaatggcgtgaacctgggaggcggagcttgcagtgagccgagatcgcgccactgcactccagcctgggtgacagagcgagactctgtctcaaaaaaaaaaaaaaaaaaaaaagcatggagtcacccttgacttctctattttcagccatgtcggctctacctttgaaacatatccagcctgactactcccactatcatcatttcctggtagaattttgcagtagtcttccaccagtttctctctctaacccccgcaccaacctctccccagccctaacacacatactctagtttccagagtagcctaaggaaacctactaaaacttaagttaaattatgtaaagtttctgctcaaaacactccattttctttccatctcattcagaacaaaattctgtcttttccctgatgcacaaggccctgatccacacagcccagttctgggaacttatctctggcttcatctcgtaccactctctctcattctggtgtctccattctggtgtctccattcagaatggtgtctctcattctggtgccctccttgtattcctctaacatcctgtacacacttctgcctcaaaacccttgcccttgctactctgagtgtctggaactcttttcattcatcaatctgcatgacttcacttcatttaggtccctgctcagatgttacatactccaaacaccctacataaaattgctcagatctacgtcatctcatcattctccatcctaaggtagggtaactgctttagttttattcttagcacttatcaccatctgactaacatacgtttatttgcttgttgtctatcttcttccactaggatataaacttcatgaaagcagggatcgttgtctcttttattcactttatcatgtcagcacttattgaacagaataggtattcaaaaaattttttttggatatggaaggttgcataagtgctgcctattgcaactgcttagagctacaacctttgcttctggagactgagctggaactagtattacttgaattactttaaaataaatccaaaacacccaaatttatatctggaataatacagaatgaatgtgcaaagtaagtataaattcttgaccaagactttttttgtggatatgacttccaaagaacaaaaccaacaggatgtgtgtatgtatagagagatttattttaaggaattggttcatgaaattgtagaggcttgctgagtctgaaatctgcagtacagactggccagctggtgacttagaaaagggttacaatttgaatccaaaggcagtctctggcggaattcctttttgctcagggggtggtcagtctttattctcttaaggcttacaactgattacatgaggccctctcacactatggagagcaactacttcactcaaagtccaccgattgaaatgttaatctcatccaaaaaacacatccagagtaatgtttgatcaaatatctgggcaccatagctcaacaaagttgacacataaaatgagctattacatgtaggttgttacaaatatgtattttggatttgcctgacttgtctccttatttatctataagttccttgggtacactggtttgcaggagagtaggtgatcagtaaatatgtgacatattttcatatagcaagatcaagggaatataacgcatgataaccaaaaattattctcaccactaaaggtctccattatattttaaaaaatgctaaattgctcagttacttaattttctaaagtgggtcatatttgattatttataccctttaaataagctaggagatgagtatggaaggtcttccaataacacttttactggaggttgcctaacagaatttggggacttgcattggcaatggcctacaacattgatgttataaatgaattttcttggcaggggggaacatacaaagctataagtattgggcaaaagtctcaagcctcacagaaagtctacacagagtcttctacaaagagtcttgtgatcatggctgtattagtccgttttcatgctgctgataaagacataactgagactgggcaatttacaaaagaaagaggtttattggactcacagttccatgtggctggggaggtctcacaatcatagtagaaggtgaaagtcatgtctcacatatcagcagacaagagaagagagcttatgcagagaaacatcccattttaaaaccatcagatctcatgagactcattcactatcacgagaacagagcaggaaagacccacccccataattcaatcccctcccacctggctcctcccatggcatgaggaaattgtgggaattacaattcaagatgagatttgggtggagacacagccaaaccatatcaatggcaaaccatgaaagtttagcaactgttctgatcaataatacaaacatataggtttggagatcattgaaaaatatgtaaattcccataataaaaggaaatatgggatatatgtatttatttatatatgtgtctgtgtgtgtgggacatgtgcctttctattttattgaaaactgtgctcttgaatagtgaactttgatgccacatagtattttgcagctaatccctaaaaggtaagatgtcataggctagggtaatggtttatagtcacttatgtgccaacatagatttggaagccaataaatgcctggcagtaaatgactaactaaataaaaaattttaaaaccctcatgtgggaaaatctaatgccagcattttcccagcagttgatacagagtttccacaatggctgtcttttatcaaggaaaaagttgatactaaatattctgttttagtgtagattccacaagaactgtagaaatatggggtgaggaaaataccagcaataagaacatgattatcctaaaagactgacaccagtagctttaattttatatttctacttttcacttagatctctgataaattgtaaatcagatatcagctgaggtcaccctgtcctttcagatttaaatacagttggcttcagtctctttgtcttctgtcctgtgggatgcataatgctctccctgatattttcatgaagtttttcgagctcatgtttctatggacatatctgctcagagtctcccttctggtgacctcttagttcactttcatctgatgtcctggacaggattctctagagagacagaactaataggatatatacagatatttgagacatgatttgttagataaattggctcacacaactgtggagactgagaagttccatgatatactatctgcaatctggagaaccagggaagctggtaacatggctgagttcaagtctgaaggcctcagaaaccaggaaagccaatgatggaacctcctgtctgaggccagaagcctgagaatatggggactgctggtataagttctggaatccaaaggctagagaacctggagttctgatgtctaagggcaggagaagaagagtgtcccagctccaaaagagagacagaattcaatttctgttgcctttttgttctatccaggccctcagctgattggatggtacctgcccatactggatgaaagcagaacttccttacttagtccactgattcaaatgctaatctattccagagacaccctcacagacatgcccagaaataatgctttcttagctctctgggcatccctcaatccgaacaagttgacaactaaaattaaccctcacacccccaacccttaccactgctcttgtcttttctcagccgtgtgctgacccagacaaaatggactatagtcccctttccttctggggaaaatcatgcagataaagcatttgggtgtgtagcagattttataaaagatgtggggaaacagagtggttaaatcacagcaaggcaaacaacttaaatatacatggctggagccgtctgtcgtagctctttttcctttaggatccctcacccatggcgtggctcctttcccttctctgctttaactcaccaccaaattcctattatttcttataaagagtggtcttcttacggattataccctctgggcctcatcttccctctgaaagggatctttcaaagtatagacttaagccagtgacagcaacactgtcagctgttaaaatggtgttttcatctggtatctgaaaagtacattggaagtttctattccaaatctctctctctctctctgtctctctctcactctctgtttctttctctctcaacatggatcttcatgtaccaaaatactgaaatattttctgtaggttttttttttttgtttttttgttttgtttttgtttttttttttttttttgcatttcatcttttccctgataccataagcatccacttttgaagactgtccttttaaaaattctaccattggctgggtgtggtgcctcacgcctataatcctggcactttgggaggctgaagtgggaggattacttgaggccagaaatttgagaccagcttgggcaacatagtgaggacttgtctctactaaaaataaaaataaaaatattagctgggtgtgatggtgtgcacctgaagtcccagctactcaggagagtgaggcaggaggatcccttgatcttgggaggttgaggctgcagtgagccactatcatgccactgactccagcctgggcaacagtgagaccctgtttaaaaaaaaaaaaatataccataatatttttatgcatttaaatggatcattgtgtaggttatttgtaataagaagcaattagtgtgtctaagtagatttatagatagacttatatttccaaaatattccaaaatattgttaaaaatgttctgcttacattacttaaattattatatatccagaaaattagaaagtaaagtctcaggtatgttggaaaattccagaggcatcaaagtttaaattaaaggtgcttcagttggaatgtccctcagtaggtgaggactatttgggtagcttcaacaacatcactaacaattagttattggtaaacccaaagacctcaattaaatagttgtttgaaataactcttttttgttggagcaaaaagtacatttcacttggtggaacatttgtatccagatggagctatcagatctcagagaattcatttcctttattttggcaaagattcctctaagtgtttactgtgtgacaaacactgtgttaagctatacatgaattaaataatttagtcctcctcatgactccacgaggtagctatttttatctccatttcacatacgagaatactgaggtttaaggttagctaactcatccaagatcacaagatgttggcacacccaggtgtatcagatagggcctggcaagaaacagttggcacacttcaacagggtacctgaggagagtttaatgaaggaagtacttatcaaggaataagtagcatcagccaggaatggtgaaacacacaagggctagcagcaggtctccaggggcacagggaggagcacttactggaacttggaaagacctgcagccacgggagaggagataccctgcagaagctgtagtcgtctttttttgtttgtttgtttgtttgtttgagacagagtcttactctgtcacccaggctggagtgtagtggcgcgacctcggctcactgcaacctccctctcttggataccagtgattctcctgcctcagcctccagagaagataggattataggcatgcgccacccacttggctaatttttgtatttttagtagagatgggatctcgccatgttggccaggctgctctcaagctcctgatctcaagtgatccaccctccttggcttcccaaagtgttgggattacaggcatgagccactgcgcctggcagaagctgtagtcttaggtagagcaaagctgatagtgccatactatggcccaaagagaactgacagattacattgctgagcaatttctcatcacatcttttcttctcctgctagtggctcctattgaccaaactcaatgagaaggcagagggcaaagaagcctgactgatctactctgtaaaggtgagcctccctgggcagagtaggacaaagaagtttggagagtgggtctggaggagaaacagaccattcagcataccaggtgcatctgaatccagagcctaagcccttgaccaccacactatcctcttgccttggtaggtgtgttgataatttccacagaagggggatgctgtataaacatgatacagtggaaggaatactagagtaggggtcaggaaaatcaaatactgtgaagtgtggaagtgcctggcacagagtagaaacttaatcaatgtaaatccctcatcccctcccattgtgcatcatgagcttcccaacacagcccataaaatctccaagttgtaatgctgaaagaagggccacaaccttgtcaatgacgcaaaagagctttcatcagactgtgcataatttagaatgtgaatctctgagaaatgagagctgatgagagcagactttagtaatcccctaaactctcaatcatctgtgttttggtaaaacaggagcactagcagatcatattctgctgtataccacaagtctggcacacttctgtgtagtggcctgtggtgggcagaataatggcctcctaaagaggcccatatctgaatcgctggagcctgtgaatatgttaccttacacagtcaaagaaaggctacagatttgattaaggttaagggccttgagatggggcaagattatgctggtttacccatgtgaatccaatctacctacatgagtctttaaaagcagagaaccattctcagctgtagaaagccagaaatatagcagcgtggaagcagattttgaagatggagaaaggccatgagccaggaaatacaagtagcctctagaaggtggaacaggcaaggaaacagcttctgcaccagaacctctgggaaagaatgcagtcctgccaacatctttcttccacaccagtgacacctatgctggatatttgacctacagaactgtaagaaaataaatttatgtgagttttgttttttgttttgttttgttttggagacagggtttccctctgtcacccaggctggagtacagaggtgcaatcacagctcattgcagcctcaaccttcccaggctcaggtgatcctcccacctcaacctcctgaggagctgggactattggcatgcaccaccacacctggataatttttgtattttttgtagagaatgggggtctcaccgtgttgcccaggttggtcttgaactcttgagatcaagcgatcctcccaactcaacctcacaaagtgctgggattacaggccgggcacggtggctcacacctgtaatcccaggactttgggaggccgaggcgggtggatcacctgaggtcaggagtttgagatcagcctggccaacatggcgaaaccccgtctctactaaaaatacaaagagttagtcaggcatgatggcgggctcctgtaatctcagctacttaggaggctgaggcaggagaatcgctttaactcaggaggtggagattgcagtaagccgagatcacgccactgcattccagcctgggtgagagagcgggactccgtctaaaaaaaaagtgctgggattacaggcgtgagccactgcacttggccttgtgttattttaagctactgaaattgtggttacagtagcaatggaaaatgaatgcaagcctcttcatctttttgtttcagggcaagagcacctcagtatgtaaatttcttgatatatgatgactgacactgaagtgttcaacaggctccaaacatcaatctttaagcattgaatctattcaagttctagcatagaagttttttattcaattgcataccagcgttacttgagagtagactgatgcttcacattgttgttgttgtttttattttttttaaataactctgcctcttcactagaaaaaggttttgttttggatatcattaaaacagtcaggggagcatagcccttgaaaagatctcagaactagtaacctacctcctgaccgtgcctaagtagaggaaccaaaagttttttttttttttgggggggcggggggtggggacggggtttcgctcttattgcccaggctagagtgcaatggtgcaatcttggctcaccgcaacctccgcctcccaggttcaagcaattcttctgcctcagcctcccaagtagctgggattacaaacatgtgccaccatgcctggctaatttgttttttttgttttttttttctgttttttgttcttatttttaatagagacggggtttctccatgttggtcagactggtctcaaactcccaacctcaggtgatctgcccacctctgcctcccaaagttctgggattacaggcatgagccactgcacccggccccaaaagtttttgaaaaccttcacgtcaaccacagagccttcagtatactgtatgttattttgtacccaacccatggttctggtcgcacacaaaaatgtctgtgagattcctggtcaactggtattcaccatggagttcataaagggctgatgttcctcaaataccagatgagtctaagtaagtactactttatgtagccatacatgaagtggaaattgagtttaagcccaagctacctgtgcctgaggggaacaaataattagaggggtttagagaagaccaagttatgcaggtgtttactgtaattctctcattatgtatatgtgaaggtagcccttagaccctcaagtgtattgggaggtattaataataaccacaaagatggtcctgtgctatggcaaatgcagaactttcaaagtactattcagcctggagaagaaagctcatttccagatccttccttctgtttttcaagtgacatcacataggaggatgagaatttgtctttgtattaagcttcctttgtcatgtctacttcagacatgatctctgagtttgaagtcccaggattttagatgaaaagaatctttgagttaagggagggagggggccactgcatgagaatgcctgtttctaatctcagagtacccacatgctgaatggctgattagacaaaagccacagaggggaaaatcagctactctgggttaggggattcaaatttcattgtggtggacacctatttatcttttattgtagtcaatttcccaagggagaaagggcaaatgtgtccctcctatgccaacattgtagcacccccaacggagcagacctcaggagtatcctacacagaagaaaggagcagtgaaacctatgacaactgatttttctctgaaaacaatgttatgtgtatatttcatttcttcatctctccaaaaacttttgtaacaagtatgttttttgcaactgtggcaggtatactagagaccagctcctataacctaatgatcatgccaagtatttctgttatatctcttaaaaatggcttttcttctcatctcccaaaacaatttttttttttaaacacagggccttgcctgttgatgattttctcacacttttgtcaagtatacttttttttcaactcaatgtctaatatcacaaaaacctggcactttaaacttcagtttctaccaaaggtataatgctttttaaaaagaattctgcctagtgttcctccagtgtagcaattagcattctcttagcggcaaacatcaaaatatccaaataaaatggtttcagtaatagggatggttattgtctctcataacaggaaatctggagggagctgactccaggtggattgagaggttcagccacgcctgcagtcttatccatccttttgctccactatcctctatatatttgttttcaatagctctaggtatccgctccttacacaaccaagttccacttctgcatgtgtttctcctattaggaggaaagaaaactatttcccagctggttccagcagagaagtctccttttaagtcttttgccaaaataagtctctaaaccagccccaggaaagacgatgagattgccttgtttgctttagattgatcttgattagtctactgagcctgagcacgattttcttaagcatctcattcccaacaggaaagcaacaaaatcggcattctattaataagacaaagaagagaatggctcttgtgtggacaatcaacaatgtcttccacatcacagaactctttagtatgcattagaaaaacctagggtggtggttacaagagcagattccaggtgtcaaagagattttgattacagatgaggtccaggagggtgtattttcaacaagaacccagatgtcttggatctagtcatccaccagccaaagtttaagacactgccctacagaaatgagaacaaactttccttaaaaaaaaaaaaactttggccggaagtgttggctcacacctgtaatcctagcactttgggaggctgagacaggtggatcacctgaggtcgggattttgagaccggcttggtcaacatggtgaaaccccgtccctactaaaaatacaaaaataagctgggtgtggtggcgggtgtctgtaatcccagctactcaggaggctgaggcaggagaattgcttgaacccagggggcggaggttgcagtgagctgagattgcaccactgcactccagcctaggcaaaaagagtaaaacttcatctcaaaaaaaaaaaatcttgttaatacatcaataaatattcacttttagtacctggatgttactgatccacacaagtacatctactgttagaaagtaaccattcttaagcaaaacaaaggacgtctgcctgcatagggtgatcagaataatgtccaaatgcacaaatgataatgagatgatgcagataaagtgcttagcatagtagactatgaatgtgccaatggaaaattataattttttaacctgtcgagttttgttgctactagatctttgcatcattatttcctgctcaatagttgtctttgttcaaagtgtcagtttcatagaacataccactacttgaaatcttctttatttgttcttttagtctgtcatcctcactaattatcacctccacaaggaagggctatgtcttgttcatccctattgcctaattctcaagtcctgaaattttaagcatttaagcagctgttttcaaatttctaaataagacacctttccatgtagatatgatctaaactatgacatacaactaaattgtaagaaaaatgtcaaaacatggtttcttttatcaatagtttactataggaagttaagagtaaaagtgaacaatctatgatagtgaattaataatgactttaggaaaaactaatagtacccaagtaaatcttccctttgacaacttaattctgaaaattatgtatgactttgaaaaattgaataaatcagcaatttccagaaactactgacaattagtatggttgcaacttgattccccaatccagggtgtgcctaggaaataattagtagaactggcctttaggtattcttttttttttttttttgagacggagtcttgttctgttgcccaggctggagtgcagcggcgtgatctcagctcactacaaccttcacctcccaggttcaagcgattctcctgtctcagactcccgagtagctgggattataggcacacaccaccatgcctgactaggttttttgtatttttagtagagatggggtatcaccatgtcggccagtctggtctcaaactcctgacctcaggtgacccaactgcctcagcttcccaaagtgctgggattccaggcgtgagccaccacgcctggccagcctttaggtattctaatgtgcattccttctgaaaggagtttatcactatgttgaaatttctgtgttctaaacccacgttatctgataaaactttctgtaatgatgaaaatattctacatctgcactgtttagtaaagtattacccactaactgtatgtggctactaggtacttgaaatagtatgactgagaaaccgaatttttaatttagtagccacacatggctagtggcttccacattgtagagtgatgttctggacagttttttgtaagtaggcacaatgtatagcaacacgttcctagagctttaaattttgaaaatggattttcccaccatcgcttatttcctatgactccaatttcccctttttacttttattcccttgtcagtgaactgcttagctgctggctccaaagtttcactaccaagaggatgcagaagtatcatagtaggggcagtaaaaacattacatatattataaaaaagccactgtcctgggagtgaattctgagaaatgcaatggaagacaaaagggggcaggaataaaaggcaagaggtttccttgatgtgttcccctgtgatttaagaccttttttttggttttgtttttaagtcagcaaatctatcaagcactgtgccaagggctacgggcaaaaggatgggaatggatagagatgggtaaactaacaatcacatcaggaagtgaaacacagggtaagttacagaacaccgtaggaatgcaccaggcgtcaatttcctcagtctttggggaagaggagtgatgggggtaccatgaaaacaaaaagtgatatctaagctaaacctttaagtgtgatgccaattagattggatgggagagatgacagaagaagggaagagggttagggacagagagaaggaaaatacgtgctgtagaagacccgaatatgccactcccaaatatgccattttgacataaggatgattttgagctgaaggcaactgaagaaatagatataagaaatgttctctccttgctcccatttgtctaaaagcaggacgtaaacttatgaaggtaaaggtgtccctcctctcttctctaccaggaagaacaaagattgagcaccaaaggcaactttagacacttatcagccccggagaaacatgtatagcaaaattctacttatttgccttcctacaatttaccacccctagagactcaaagtccttctcctttgtcttgccacttctctaaacatttatttttctttgttgaagatgctatatgtacaaatctacataatgattatccaatctctgttttcattgggaagcaagcaggtctgccaaaaatctgttacctaaaagcatgatatagatatagaacatctggatcaattgagaacaaaacaacccaaattacaaatgtgccacataggtatgaagcagacagttttccccacttaccattagaaaccaattttctaaagctgaaccagctttagaaaaccaattttggagtttttaaaaactcatagttgcagtgtgaatactaaaagcaagtggaaagtatagattataattatagataatggttaaatttgatattaaggacttccatttgaaaacaaagttaggaatagatgtgcataataaagatgcatttagatttatttaaaaaatattttaaaaaattaggcaccatgcttgttacatttgccctaagctgaagttggcaatgagatctgtttagagaatatgctcacctcttaaaaaaaaagtggaataattttcagcatagtagtatatccccctcagaatttattatttaaaacaatatttttaaaaaatttagatttagaatattaacacttcaaaaaatcaggtgcaatgcttattatatttgccctaagcttcagttggcaatgagatctatttaaagaatatgctcacctttaaaaaaaaaaaaaaaaaagtggaataattttcagctatagtagtatatccccttcagaatttatgctacatatgtgcactacctgttttattatctctttaaatcaactcacattcttttaaacaaatgtgatttgaagctttaaatcactacggcaaattaaaaaacattattgcttgttatgaataaaagataagacataaataaatacaaatgaagactaaactatgttcttacattctagctggttaccattgttccctaaatgctgtgttaaaaagagatatcaagtaccagaaagatgtttaagacaaactgaggcttttatcttggtataatcaaaaagattaaaaagaaaacaaaattatttcctcattgtgattcaacatatacttaatgcagtttctgtggcaccacctaaaaccatcaagagtattaaacacagctgaagcataacttatctttcccacacaattgatattgcatgtcgtcttcctttagattgatgtaaaaaaaaatctgtcttatcaaaaaaatgtagttagaagataggaatgaaaaataaaatgtctgtctttgctaaatgctaaccaaggtaacatctttgggatactccccactgacctgttttgcaatatttctgcaaactatatttgtgatgtatattcattgacccactggctcatatatttgtatagcatctgccttctcttcaattgtgagttcatttccctctgcactattactttggctcaccataggctctaggtacccaagcatggaaaatcatcatagaagtggtcagcaaagtgtgagatgcaataacacccctgtaggagtatccattgacctcaaagttgagaagcagttctgcccagctagcccctctccactgctggccaatgcatcaagccagcaaccaggtacttacaacatgagaaagataggaatggtaaaaggtaatatggcaaggacaaagaccatataaggtttttgtggaggactttccttagaattggaggtcagccattatcttgcaagaaaggctgggctgctctacctgactcgtggggtgttccaccactgcactctgagcggcattaaccagggcagcaggtagcaatcacctgggggtatttaaaatgcccatagccagcctcatccccagaaactgtgttttaattcatgtaggatagggccctgctgcaataaatagctcctcaagtagttatgaggtgtagtcagggttgagaaccaagaaagcatcatactcagcagacagctcccagcactaggcagcaagggcaggaggtagggatggtgacagactccttcagggttaaatgctaagacagtactggtagcttggttaggccagctttgctgtcagtgtgctgagaagccagcagcctacattgctaggctggaagtgactgctgtcataatttataagataatgttttaaagaaagagctttaaaaaatcccatgtaagttttaacttagtttaacagactaagtatctgttaagccttaagcatcttgatctttccagtccatatgtcatggcctgtttacccagctagttcgttcttttctccatttctctatttgcctgttgttaagctaaagttatgtttgtacatttagaagatgggatgagatccatgtgtatctaaaagggcacacctctccaactatgttctatatgataatttctcatttttcactggttacttaaagctgttactaaaacaacatgtatgaatgttggatagatagaacactaaacttaaattaatttcaaaacactaataagaatcagatccattattcagagtcagagataaaaatatcttcacatgctctaaaagagtaacttcttgataggaaaagtcatcccattttcttttaaagcaatcagaggcatcatggtgtcatttttaattctggcagaatcagtacatcctctccttccacgggttggagctccgtgtgctgattctgagtgacaggaacaaatgtcattccaaccaccatcacagcacatggaggattcctgggtgtaatgctggtctcctcccttgctggggtattgcaaagcttaattaatgtttgcaaaacacatggaggaaattgtatagaaattactatgtaattgcaaaagatcattgaagggaaatgctagtaaaatttactgggagaggaggaggatttaattggtaagtcttatgctttactttgaaaatcatatcagacagaagtgaattgactttgtaagtgccaaaaataaaggaaattatgttgggtggtctataaattcaagatattaagtttcatggctgaatttaatttcgtttgaattcataatactacaaacctaaccaactacattaatttgttacagagactaaaatctgcttgtatgtctgtctcctaagaaaacccaagtgtataaggatccttagttttccaagaagttcaaccagaaaagatagcctagccaccttgatggtaactggatttactttgaggtgtttccatttaaccatagcttttggatgccttgtcaaagcagcatattatctttgttggattacttcttgggaaacttcagcaatattggtaatgttttgcattttcttagttttttttttttctgaagcagaacttctgagctgagcttatttatctgataacgtaattttataaccatgtaatttgtactgttttttttttctcccagtacatattttggtacaatgtcaaacttaccacatttcagggctaatgggttaagtagaataattattctaactaatttgtaggcaccaaggtttgcaaacctcaattagagttgaccaaggggttactgtgtggctcaaggcttgaataactgagggctgagcagctcaactcagggctgagtttgctgtcaggtccaaagcagttctgttatacacctaatctgcaggagctagagtccagatcacaaggaccaacccttgcccaggctgtggcacaacctgactgtagggagaattgagtaatagctgcagcaatccagggtttgccaataactttctttaccaggaaaggctgttcattcaagacattctcagtgtggtttaaggactgtggctagatgtcagatctaaggactcaggtggaagggagcaaagagacaaggttctccaagaaaaggggtcttgttagcagttgcagtctcagttatgttcaatcctcggagcaaagggtagaaacttgagacattgtaattttcaaactaaggcatgttgcttagactgggattcagagaacccaggaatggaaacaaagaaataaggaacaggggcatatgagaacccagagacaaattatttggatgggagcaagtgacaggagctggctagtatgtaccgttgctctacagtgctcatctggttaggtcttgtccctgcttacaaatcatgagtaacttgaatgttttctttggcacaaacgagaaaatctaagaatgttgaactttatctcagctaaggaaagcagcaatggtagaggtaccatcccaccctttgtaatccttttgtgtgctgagaaaaacacatttaatcgtggtctaactcctgcctacatctccagataccctcttgccatccctccagcaaaccctgtactccagcctcacagtctacttgcattttaccattggtactgtaaggatggaaaagtgtgatatcttttctcacctatcataaaggtctcagctgacaagcctatgacaaaagacagattaacaagtataagccaaaaagtatctgagacaggtctcaatttagaactttattttgccaaggttaaggacaatgcacggaacaaaaaatagaaaatcacaggaacagtctgtggtctatgactttctccaaagatgaatttaagggtgccagtatttaaaggggaaaagtgggtgggagggtatggtaatccacatgttgcaagagaaaaggagcaggtaggggaatagccaattatgtattcttctcgtgttcagtaaagcagcattttacataagataaggagaacatagagtagctatctgtggagatacgtaacctgttatctgtagctgtccagttaggaacaaaaggaaaggcagcttcttgcatgactcagctttcagcttagttttttcttttggcagagtgaattggggtcctgagtatttattttcctttcacataagagaaagccataatacattgatttagtcacagttttatgtgacatgggagccttcagaaatgaagacccaaagatctgggagaactgtttttatgcaaagtgtgatgaaagaagtgactagttgtggagaaacatgattggtcaaaagggtactatctaatggtaataactgagggggaaaacccagcaaggcctgactgttcagattctccttggcctctctgtgtagcattgctttctccccaatttagggcatgactctgctggaatgagggtcttcaagggagaaagttttacttggaaggggtcccaatccagacaccaagagatggctctcagatctcacacaagaaagaatttggggtgagtccacagagtagaatgagagcaagtttctttaagaaagtaaagaaaagaatggctactccatagagcagctgcaagggctgctggttggatatttttatggttatttcttgatatgctaaacaaggggtggattattcatgggttttctgggaaaggtatgagcaattcccagagttgaggatttctcccctttttagaccatctagggtaacttctggaccttgccatagcatttgtaaactatcctggagctggtgggagtgtcttttagcatgctaacacattacaattagtgtttaatgatcagcgaggacaatcagaggtcactttcatcaccatcttggttttggcaggttttgtctggctcctttactgcattctgttttatcagtgggatctttgtgacctgtatcttgtgccaatgtcctatctcatcctgtgactaagaatggctaacttcctgggaatgaggcccagcaggtctcagcctcattttgcccagcccctgttcaagatggagatggtgtggttcaaacacctctgacaaaagcagacagtgacctttctagggtttatggctggctttgggggaaaggagttctagtgtctatgacctccctttggggaagagaaattctggttttcatgacttgctttcggggagaaagtagggaggatccaggagggtgggaggtggtcagaatgatgttgcttctgagtccttccaaagtccttccatttcaaagtaccgtactttggggtattgtattcctagccccagtagttccaagttcttttgggtatccctgcctttgcacaagctactcccactgggcagaactcattgccctcgttctctatccagctagtcctgaatcatccttctagactaagttgagctatccgcttttcagaagcctttctcagcctcatctgggactcatagcattgtgtttactgtcattagagtacttgctgtaccagtttatgtatacagttttcgggggtcagaacatgataccccaaagtatggcgtcttggtatgctgagtatttttgagctgaaggagacaagagggccccagaagcaagaaagtctttctccttccctcctctctttcctcccctaaagcaaaccataaaacctggaaaggtcactctgacctacctcccctttagtaggttataagaccctttgaataggtaagccttactggttttccctcattagaccatacctttttgtccaatcatgtttctctacaactatccacttccttcatcagattttgcatagaaatatttttccctaggtgtttggatcttcatttctgaagactcctgtgtcatataaaactgtgattaaatattataaatttgttggccagggctggtggctcataccggttattccagtgctttgggaggctgaagtgggaggattgcttgagcccaggagtttgaggctgcagtgaaccatgatcaccccactggactctagcctgggtgacagaacaagaccttgtctcaatctatcaatttgttgtgcttttctcttgttaatctgtcttcttttataggagtgacccttgcaaaatgggtgagaaaaagttatctatttgcttctacactgtgttaaaactcccatttgtttaccttaaaacaggcaaaaacccttttagactctgagctacacagtggttggggaaaaggttctcaataagtttgctggaaaaacctgcctgattaatcatcatagattgagaggggaccttgtatggtaacaaccacctctctgctatttacgtggaaatgagcactactgctgctggctccaatttgattgatagcactcaggctttgcagattggaagccttaattaaatgtcaaaagggactacattgcgaactgtgaattgtcttttaattacagtaagagagcaattgaactatatgatccggtaattgtttaaagtgaccatgctgaatccttagaatccccctcagtttctttctctataggatgctgcatgacagcccagagcaggcattaaaagggcaaaagcagggcctggagcagggaaccttaggctacctaaatgaaaggatccctccttactttcttttccctcgttacccacccttctttttccttttttctttcacacttcagttccctcattcccaacttttggtcattaccacacaagatgttttttataattcctgccatgtctatgtaccattaatagttttatataattcatagtttctttcattcatgtacacaaaaagcaaactttgtatgactaccttaagcaataaccagtattacttttcaaaggttgccttaaaaataaataatgagaaattctggcctgccggaaaacagccccacccttacagagcagaagaatttgaaaagggttcttttggagcctggtggcctctagaggctcttccttcttgatgatctgctctgtatgagttgaaaggcagtgtttgaaattacagtacaattcaagctctatctaaagccaggcagccaatatgtccccagtagtgaacaccaggaaccaccactgatacctgcactgcactgtgggcaacattgctctagtttccagtctcaaaatagataaaaagtgtcttattattatgttggtcatcctctgtcaagtaggaagtcctgatttttcacttacatgccacaaacattctgattaacatcttgattttacttttccacccttttaaccacctcagatactttgttctgggaacctctgtatgtctctttaaaaaccatacagctagaatttggaactgacatttagcaagcacctactttaaggtaatttatacagtctatctgtattcatcattgtaatgaccttgagaaataggtatcatccctattttacagatgtgaaaattttgcttaacgttatagatgtaaagattcaaatttttcatttgtacacccctactttgtgctggctccgtgaatctgctggaatttttttttggttgtcacatcatggctgagtatcatagcagcattgtctcaaaattcttacttgctatattcccagtgataaaatcaaatcagctctgcctatgactaatcttcagttcgctacgaccatttcatccagagctggcagaagggtttcatctgtgttctaatgccaaacaataggcagaagctgcctggacctttgcactgggagactgtttctgggcttggcacaaaaaagtgattaattagaagtgtctgctctaggttcgggagcagggagtgacagcacaagtatcatacatttgccacgcttgatgtaatcttttctggaattatagttgtccccacttattcatggttttaatcacctgtggtcaactgtggtccaaaaatagtaagtcaaaaaattcaagaaataattcacaaattttaagttgcatgccattctgaatagtgtgatgaaatcttgcagcgtcccactctgttttctatggatgtgaatcacccctctgtccagtgtatccacactgtctacactacctgcccattagtcgcttagtagctgtctgggttatcagatcgactgtctcagtatttcagtgcttgtactcaagtaacctttattttacttaataatggtcctaaagcacaagagtggtgatgctggcatattataattgttccattttattattagttattgttaacttcttaatgtgcctaatttacaaagtaaactttgtcataggtatacgtgtagaagggcaaacatcggatataaagaatttggtactatctgaggtttcaggcatccactgggagtcttggaatgtatcctccttggataaggaagcactgctgtacttatggggtcagtcatttcccagttagtatttacatgtgctacattttctcctatttatggcttagcagtggtctttttggtttcatattacttctttggctatccaagtttaaaaacttgaatccaattgtgtgaaggtgctgggaaacctagttatttctcttcttcatgtaatcaaacattatctgtataccgaaggtgatatcaaataaactaatacaggtattccacagaaacaaccagtaggactatccctgcattagattttataatctgttaaaaataaatttcacaagatatccaataaggatttgccaatttttgtgcttgtgattgctaaatacaaaattgtttgcctctgacaaaacaagtccaatattaaataggttatataatccatttgcaatttcgtatataaaattttcccaagtttgaagactagcttaggggtttaaaaacaacctaggttgattgtcataagaatttcaccatttaactcattggctagatttcaataaaagtgattttttaaaaaattatggctttcaagccctctaaaatcagttacttttttaaatttacgtatgctttagataccagtttacaaattgacttctgagaagaacatgttttctgatatctatacaaagaaactattaaatcattttccctgaaatgacttaaaaatgtaaacatagaatgtagcaagaaaggagtgaaaacgtgtacatattctcttttttttttttttttttttttttttttttggagacggagtctcgctctgtcacccaggctggagtgcagtggcatgatctcagcttactgcaagctctgctttctgggttcacgccattctcctgcctcagcctcccgagtagctgggactacaggcgcctgccaccatgcctggctaattttttgtatttttagtagagacagggtttcaccgtggtcttgatctcctgacctcgtgatccctcccgccttggcctcccaaagtgctgggattataggcgtgagccactgcgcccggcctacatattctcttatatacctatgatagggttatgtcttgatagcctgtcataagttgaaaacatcataagtcaaaaatgcatgtaatacacctaacctatggaacgtcatagcttatcctaccttaaacatgctgagaatacttacacttgtccacagttgggcaaaatcatcaacacagagctatttcatgataaagtgttgaatattccatgtaacttagtaatctgttgaaagtgaaaaacagaatggttgtatggtactttaagtacagtgtttactgaaggggtatcactttctcaccattgtaaagccaaaaaattgtaaatcaaaccatcgttggctgggcatcgtggctcatgcttgcaaatcccaacactttgggatgcgaaggtgggtggatcacctgaggtcaggagttggagatcagtctgactaatatggtgaaaccctgtctctaccaaaaatacaaaaattagccgggcgtgttggggcacccctgtagtcccagctacttgggaggctgagacaggaaaattgcttgaacctgggaggtggaggttgcagtgagctgagatcacaccactgcactacagcctgggtgacagtgagactccatctcaaaaaaaaaaaaaaaaagttggggatcatctgtattaaggttataattaaaattctggatttattgtgttctagaataaggaaggcagaataaggaagtcacagtaatttttttcctacaaaaaaaaacttaagaggatgaagttctaagaactattttatgtattgagtcattcataattggaatattttatgcttagcattagcatactgactcttaattttaaaatgttggttctggaaacagaatttacctgcttcaaattaaattattttctttcagaattttacttctcccaagtaccctaaggcacattaaataagacagcacaagtcatatggcagcctctagagaatatttatcttaattgcattgatcttacttcataaggttaaatacaatttttccccaagttatatatcatttttattgaggttaatgttgagtcaagatctaatttcagcagcttcttaaagttatttgaactgtttcctccagctacatgatacttattgttcatttgaaatttcaattcaccatgccttactccactcatacatagctggatatgctttttaaaatattgtggtttaaaag

SEQ ID NO: 865 - DNA, 3353 bp, Homo sapiens
gaagttcattaaaacaattggattgacagatgaccagatcagtgttttcatctttagcccgcatagtccaaagcaaatacataaatcaatgagaacatcttgaggaaccaagtggtctggaatcctttggtttatcagaatttcaattactcttattatttgtttgatttagcaaagccagcctaatttaatttgtacatttatgataatactcttttggtgctagataatcatcttgtagctcattaggtaattttcataacaaatatttatcatcaaacctactcaatcccagcccagccagcggaggtgcagaggtgaccagcgtgcctcttgttccccaccctctgttcacacacagagcccaggcacaggactgggtccatggaacaggccagatgcaatggtcttctttctatttgtgcacgatttcttcctcaagtactcatctcctccctcttactagctgttgaaagcagaatcatagcttcctcactcacaaactatccagagagttacagagatttttataaaccttttggcatggtgactcccttgttgtaaactctgttattatttgcttcctctcctgtttgccatgatatcatagtttggaaagggggctcccaagggcaacagctaagccttccagaggccatgaaaggaagacaaaggaaatgaagcactcactgagcacctttcatgggccaaagatctcagccacatctgcttcagattcaggattccctttatcctctgcaggaagctgagggagaaggtattatcttcctcttgcagatgaagagtttgaggcttaaagagggtgagagtcttgatcaaggtcaaggtcacacagctggtaggctagagctgggattagatcttatatccacagagttccgtggccagtgctctttctgctactctctgctgcatcccccgaaggcagcagtgacacaggtggaaggatgaggtggcagcaaccacacctggccctgtgaacagtgcagtcccagaggggagtggcttcctaacgccagcctgcctccaggaatctgctcacctgccacacacttcacccacccgagggcctctgctcctcaccatggagtcccatctgctctctgacctggagagccccaggaggatctgcagctggtcatacctgttagcttcaaggcagcctcctcttgctggctgtgatctgggagtcctgctgggtttggagggagccgtgctgggcaaagcagaggccggtagctgcacctggaggaaggccatgctagggaccccttcccctggctgcacagtccctaccccgccactctgtccctgtgagttgttccatgggaaaggacattgcatttgtgtctccaggccggaaagggaggagagagtgaaaggtcctgaaggggaaagcctccagtgcagagggacccatttgttcccacttagacccccgtccttggcacagccttgggcactgttgttggctgaataaaccttttctaagggtcttctgaattcaccctcctccacactctctggctctgtctgcatacacagtttacttcttctctgttatttctgtttgtgtaggagattttgggggtcagtgggggtaagggccagtgagttagaggaatccaggaggggacagtggggagaaaagaggaacctgggcctctctaatcgcctttgctttcccctgaaatctggcttggatcctgctgtttcgctacccaagtttcatggggctgttaggtggccacttcgctgtgatccatggaagtctccacacattccatagctgagagcttaggagctcaagagtccagtggtgcactgagccttatcctcacggagcaccacggagcagagcggggagcagctgctgaggtggttgcagggaactgggctccagcccaggcctcacgtcctccctctctgcctctcttctctcaccggcagtctctcatctgtaggtggaggggttcaccaggtgatttctgaggtccctcccaaccccagtatttcttaatttctgagcttccttaagaggtacactgcagcccttgcattcctttgactggaggcgacacaactcttcaaagctacaaccgtgttcttgtaaatcaacctgcagcctctctagagtacatatggacacataggtatcctttaaattcctgtgaacattttacatgtattttcttagaattggcattggccctcacatgaggccatgccctcactatgaacccagccctttaatctctttctttgtccttgcagcccagcctaagggctgtctctccatttccaggtactgctgccaccgtttatgtatccaagtcactgcagagccagttgctgttgaccagctaatccagtacagcttgattcagcatatatccaacacctgtatgtgtaattcactggtttagggctcagagttatcaaagagagctgtgcatggtcccagcccttgaggaacccacagcctggtaaggattggacagtgacagaggtggcatgtgggagggaataaggcaatgcacagacaacctaattctaggaaatcaaggactctcttttccaaaatttttatgggtcccattcccactggccatgctgggcctggagcatgtgtggatgtggccacataggaccctctgtccaaagcagaaaataggagctcattcatggccctggggctggagacatggcttctacctgccttttccacttgtcacagcgagagaggcttctaccacatattttgctggggtgagaccatatactgcacatctgtggggtgtggtggaaggagctccagagggcagcctggaggtccaagacccagcccggcctttgcactcactggccgtgttagcttcgtcatgtcctgacctctctagcatgtcctgacctctctaggacagcatacatgtcctcatctgtgcacaaagtggttggaagagttcatttctgaggtcccctctggatttgctgctgtggctacccaaactctgttcaaccccatgagctcccgacttcatgcacaaggggaaaaccctcagcctccagcctccccttgagcctccagctccctcttctaggtgggagggtccctctctttgggctcctgtgggaaagaagcaaacactatcaacccttactggtctcctggaaaatggtccctccaggcttctttttgtcccagcctggcttccttccctcctctcagtacacctgtgcacatgcttgccttctccctaacctcatcccaagtgccactgtgaatcagggaattgaaaccgtttttcatattaagcaaagcatctgccaca

SEQ ID NO: 866 - DNA, 1551 bp, Homo sapiens
gaagttcattaaaacaattggattgacagatgaccagatcagtgttttcatctttagcccgcatagtccaaagcaaatacataaatcaatgagaacatcttgaggaaccaagtggtctggaatcctttggtttatcagaatttcaattactcttattatttgtttgatttagcaaagccagcctaatttaatttgtacatttatgataatactcttttggtgctagataatcatcttgtagctcattaggtaattttcataacaaatatttatcatcaaacctactcaatcccagcccagccagcggaggtgcagaggtgaccagcgtgcctcttgttccccaccctctgttcacacacagagcccaggcacaggactgggtccatggaacaggccagatgcaatggtcttctttctatttgtgcacgatttcttcctcaagtactcatctcctccctcttactagctgttgaaagcagaatcatagcttcctcactcacaaactatccagagagttacagagatttttataaaccttttggcatggtgactcccttgttgtaaactctgttattatttgcttcctctcctgtttgccatgatatcatagtttggaaagggggctcccaagggcaacagctaagccttccagaggccatgaaaggaagacaaaggaaatgaagcactcactgagcacctttcatgggccaaagatctcagccacatctgcttcagattcaggattccctttatcctctgcaggaagctgagggagaaggtattatcttcctcttgcagatgaagagtttgaggcttaaagagggtgagagtcttgatcaaggtcaaggtcacacagctggtaggctagagctgggattagatcttatatccacagagttccgtggccagtgctctttctgctactctctgctgcatcccccgaaggcagcagtgacacaggtggaaggatgaggtggcagcaaccacacctggccctgtgaacagtgcagtcccagaggggagtggcttcctaacgccagcctgcctccaggaatctgctcacctgccacacacttcacccacccgagggcctctgctcctcaccatggagtcccatctgctctctgacctggagagccccaggaggatctgcagctggtcatacctgttagcttcaaggcagcctcctcttgctggctgtgatctgggagtcctgctgggtttggagggagccgtgctgggcaaagcagaggccggtagctgcacctggaggaaggccatgctagggaccccttcccctggctgcacagtccctaccccgccactctgtccctgtgagttgttccatgggaaaggacattgcatttgtgtctccaggccggaaagggaggagagagtgaaaggtcctgaaggggaaagcctccagtgcagagggacccatttgttcccacttagacccccgtccttggcacagccttgggcactgttgttggctgaataaaccttttctaagggtcttctgaattcaccctcctccacactctctggctc

SEQ ID NO: 867 - DNA, 77909 bp, Homo sapiens
tctttctcctttatcctcctacaaattttgacctagagaagaaacaggtaacagaaaagggtggaagaagagggaaaggaaggcttttcaattgctcttggttaacaaaagatgagcccctttttggattgcaggctggagccaaccattttctgatttacgggtagatgaacgttatcatgaggcctactcaggaaatattgagatagaagtgatctgagaggctgctttatcttgggtggcctgattaaagttctgtccatttattaaaagtagctatagcaaatgaaatgactggtagacacctggcctatcagtcccggttatcaaaacatccttgcttccaaatctcttagagtattcctactcatcgtctcagtactgtcagccccacaccgtgacaaatggttctaacatagtattaaatataaatttgtctcctgtcactgcttttgccctgatcttatctgttaccattttattttattcctttctttttcctcacctcagacattttacagagaggaaattattctatatatgtatatggatttatatatgtttaactttttactttataattttcatttgcaaaactctacacagatatttcaagacttagaatgaggttatgtcccaataaacccatcacacactgaaaatgtcataaattgaaaatgcatttaatacacctaaactatcaagcccatagcttagcctagcctaccttaaatgtgctaagaacacttacgttagcctacacttgggcagaatcatctcacacaaagggtattttataataaagtatcaaatatctcatgtaatttattgaatactgtatattttgtcaaaattgtgacaatttagtaccattgtaaagtcaaaaaattaagtcaaatcatcctaagtcaggactgcctgtacttaagagttttaaagatcttcttaactggaggggaatgcattatgaatggaatgcatagaaaaaggaggtggaggaagatttgggagtaaaattcttatagagcatgagggtcttctctggtttggacaaatggagtaagagagaggtcctttgaaagagatagatggaaaaaaacagaacacatgaaagccaagagaagaaaatggcatttcaatcatagtttaagacagcagaatggtgacagaaggactgtgattctactgagggaagaagacagcctgggactggggacctctctaggcatcagaatcatgtcaacaggagtaggagaggaacaattgagagacagagttaatgggatttcttcttctttattttggatctagataacttaaagtggaatttaactgattactaaagtgggaacatcatcataaaaatcaacaaaaacattaataagctaatttctaaaactttgtaatatcttaatcctaatctagttctgagggggcaccactgtcattagaaacttgtttcaccataaatgggaatgagacaatgtgtcaaaactagtcaagtagtaagataatcaataggaagataaagatggatcaaagacctaaacaagaagttaagataaaatatactaggcaaccacagcaactgagaccaggtcagcttcctaccatgagcagtccccaacagggtgtgggtaatgagatcctgaactcagtgaggtgactctgcaacagtcaatcctctcaattcgtggacatggatataactcatgtcatgaactgggtcagtgaagcaattatgttttctgatgccaatgctctccctgaaactgtagcatcaaagaaaattctctacaagtaaggcagcttgaaatacctgaattcggagagaaaggaatcatgagatctattagaggtaagttcaacacaagctctgcataatattggactcatctttaagtctgtagatataagaaaactctcttttctttaatatcagtgggggccgggcatggtggctcatgtctgtaaccccagcactttgggaggccaaggcgggctgatcacctgaggtcgggagtttgagaccccagcctggccaacatggcaccctgtctctactaacaatacaaaaattagccgggtgtggtggcgggcgcctgtaatcccagctactcaggaggctgaggcaggagaatcacttgaatccaggaggtggaggttgcagtgacttgagatcacaccactgcactctagcgtcagcgacaagagcgaaactctgtgcaaaagaaaacaaaacaacaacaaaaaatagcagtgggatataagaaaacttcattttttcacaatagcagtgttaaatggtgtaacagtttaaaagcagtgtggtattagacagcagtgtaaaacttgaactatgttcaagttttagttcttctgtattctatatgacttaaacccttagttttaatatttttatctataaaattgggattataacatgggctcttacccaattgcgggattgaatgcctcagttgtaatgtttcaaagtgtctattaattgatatttgtcatttaaattaataaaaattaatataaatatttatgatttctcccaactatgagaaaaaacaacattcccgaaacaaacagaagaactcgttagattagaaagggcaaacatttcccccgaagtttatattgtatagttgtctctcctctcctttctctaccaatatattttttaaaaattataaactaatacgtttcttaaatttataatatatgtgctgtctaaagacatgattctttaaaaattttttcatttgttatttttggcatttttgtttcaaatttattggcttgccattacctagaattttgactttggcttctcagtagcatacaatatattttcagaatttagaaatcagacagaacaggactgctttttttctttctttctggtagttttgcatgtgagaagattatcctggactttcctgtttggtccctaaatctaatgacatttgtgtgtcagagaggtttgacacagaatgaagaaggaggaggcaatgcgaccttggaggaggagattgcagtgatacaactacaagtcaagaagctgcctgaagctggaagagtaagaaattaggacatatttactagtttaaaacaacacaaacgcagtcagaagtctgacatagatattaatgggcaaaaatcgacatctcagcagtttgcttttttttttggaagttctgaaggaaaatccattttcttaccttttccagcttctagatgctcctgcattccttggtccaaggttttcttcatccatcttcagagccagcaatggtggagagaggcctcctcacatttcttcacctcctcttctgcttcctcttctagttttaaagtattacactgggctcataaggatagtttttctattttaaagtcagctgacaagcaccttaattctatctgtaactttaatcttcctttgccatacaacaaaatataatagtcatggcttctgggaataaggacgtgggcatctttcaccatctttacttctataattctacctgtaaacttaattttctttgtcatgtaacatatttatggattcaaggaagaaggaagtgagtatctttgaccatctttactcctgtataaacattccaaaattcctctaaattatctttaggttcttaatcaccgaagcaggtgaaaacacttccttcaggaattctctcctactcccttgttttgatgggtaggtattcatcttgcatcctcctataacaatcttcaatgcccttaacccttgcacatattgtactgaatttaagccgcccctctatacttttctattacctgtaaaatacgtccttccaaaattcttaactgttaaactccttgaaagctgttctagggtgcttccatttgctcattttcacttcattaatttcactacctcaaataaatatttctgtctttctagttttccgtgacatttagctattgtgtaactataaatacagacatattagtttagtattcttgatgtctgagttcatgtatacctatttctctggaccctgacttgtcttaatttttaagcttctctgggaatagtgaaattctcagttgttactccatagtagtttatcatacatactcactacttgttagcaccaaatgcaggatgaccacagtcatcttcctccaaaatacaatggtgagatagatatgggataaatattcccatccaaaaagggagaaataagaaaagaagggaggctgggccccaggcaagcccaaaacctggcagggcaaactatgagaccttaagtcttgttaataatcttctttggcctgatgagctgacttctggacccactagggtgacaacatcgaccccatgactcagcaaggccctgcccaaatcactgctccttggggttgagatactgccccaaaggctctgctgtgcatccccctgcccacaactccagatggcccattcccacgacttctgttggaggccatctgccttgctgaaacctaagcagtggcccagatagtctccaaatcacctttggggttcttcttcccctttattgaaggacagcagacattcacagtctttcttcattctgtctcactttgtgtttccattagtcccagttgtcagggtatctgctggtaagagcccatctctagtccttgcttctgttgagatgggtgattgaatctgtggttcttatccaccctaatctctttatcaaatggcaagtgtgtcacaccctttgtgttctgtttccaatgtactttcatatttcttctaatgtggacaggatgagaatttgccagatctttagttctgattccttttgcttaacaattccattttcaactcattttttttcttctcttctcacattttaccataagcagtcaggaagaacgaagctgctccttcaacattttgtttagaattttcctcagctgaacatccaacgtccatcctctcaaggttgacctgtcataaaacatgagaacacaagcacgattcagccaagctctttgccgctttgtgatcaggatcttcttttctccgttgcccaataacatgttcctcattgctgtctgagactgcatcagagtcaccattcatattcatatttctacccacattctatagctcattctttgtgtattctctaggaattttcaactctccccttttctttttgagccctcaccggaatcacctctataagtcacttaatgataacagcagccttttctagcatgcagctcaaaacccttccagcctctccactcattacctagtaacaaagctccttccacatcgttaggtgtttgttgcattagcacaccacttctcagtaccagtttctgttttagtcagtgcggaccgctataactgagtaccatagactgggtggcttgaacaatatttacttctcacaattctggaggctggaactgggttccagattaggctgccacaatggtcaattcttggtgaagtctctcttcatggtttacaggtggtcgtgtttttgttgtatcctcacatggtcaagagagaaatcatctatcttgtgtttcttcatagaagggcaataaccccattcatgagggctctgcactatgatctaattatctctcaaaggctccccctcccacctcctaatgacattacactggagattaggatttcagcatatgaactgggggagacacaaacattcagttcataatactggaagagagtctgatttctatgatttggcttcttcgttgatatatttcaggctgaaaatggaggaagaatgagagagggacagaaagatttagcaggaaatgttatggatgatgcctgtgagtagtttatattatttcttccgacatttctttagttagaactcagtagcatagtcattcctatctgtacctgcattactaagaggaaggcaagcagatttggtggtagcttttttttgttttttttttggccacaaaaggaaagagatccgatctgagattcacagttgggttctaaataatgcatcatataaatgctaacagaggtaggagtttgcaagagagtagttctgaagatctaagttttatagatccagggaggtgacatgccactaagaaaatttctttctccatcctcctctcgtacatcttatgagagccaacataaagacgtcaagtagctgggacaggggaagaggatggcaagatgaaaaacatgactggaaaaaggcatcggaaggtttcctgataacattctttctactttgctatgtattcacctttctgtagggaaggtgtaaggaatcctaaatgatagtggatgtccatataataaacgttaatgcctcctaaatggaaaaaagagtcagatataagattccgcactgataagtggtactatgaacactcagagtcatcctggcattaaaagtgttttgcttcgttagtatttttaactttcacagtagccttataaagcagttctaattagatcagttttacacaaataaaaattgagatacagagtttaagtggctcatacaatatcacaaagcagaattgagtggagctagggctaagtcccacgttagttttactacaaagccttgtacttcttctttggtgatattgggaatatacatcaatataatcaataatatggatgtatactttatttggaaaagaatcaaatgttatcgatctttagaaagctatttaccttaagaagaacactttaaaatgttaataggttacatttagtgagaatcaaattacaaatgtttatttcacatcgataatttcaagggaaatgaagatacagatttgaatacaactgcaaagcatggaaagtttttgtaaaatccaatgtattttaacatctttttcatgtaacaaagtaaaacttaatgcatttaaaatttactaagagaaatgcattgctcttggaataaatcattttaatccatttttatatttgtatttggagagagtattaagcaatgaaatctaccttaggtttggaggattgatttccctaaatgaatatcttgactctcttttactgcacaaagaagggggatgatggaaattggtatagagttccacatgagccacatttgcaaaagtaatccttaataacatagtcagccatgtctatttcccagagtagatttcagaattcttttttcagttttttaaaaattacttgtttctgtgttggacggaaaactattcatgacactcattaaaaacagtaaggaagacttcatttgagagaggctaccataataaggttttgtaatagaggagagagatggggctcaattctgaatataacaaggaaatgtgaaaatctgtagccaagtagctggatcagggtaaaggtggggagccagtgggggaaaatgcaggagtttgggtggattctggctaagctgacctaccatgattcttgctgaaggccagccaggatgattagacctcacctctgggatggtggaggaggagaaacctcattagatatcaacggtgaccagatattgcggatgggggattattgctaaactgacttagatttcttgctaaaattggacaatgtacagataaatacgaaagttcaaatgtcagggtctaattgagaggagatttaggaggagcctgactagagttcagtcaaggagagaatctttgtcatttgtcaacatgatgctaacatttcttgcatctgtaacaaaatgcatggtagtataaccaaagcgtttttcaactgagtttactgaaaagccaaaattcagagacataaaatttagaactaggtcttctgaacaaaattaattttaaggggaagtagaatactaatgaactctattaccagaaatatgtcaaagtgtgcctggataattgagaaaaggttctaagtaaagcaattagtccaaaacataagatctcagagaactgaaacttcattctatttgttactactctgaaagatatataatattaaaaaagggaatatgacagaaaaattgaaaatgaaattgagtaagaaacagaaaaaggcaactgtttaactctgaagatcagtgagagcacctgcgaaatggaactatcaggtttaaaatatagagcactcagttaaaactcaagttcatataaacagcaaattaaggttttcaatgtaagtctgttctacatattgcatggaacataattatactgtaaaaattatttgtcttttattttaaaatcaaatgtaactggtcatcccgtcattgctgctaaatctggcaaccctatgaagaacagatcattgactatcttttattttgattactactattaaattcttatcttccactttcacattttagaatggtggtctgacttaaccttcatttgtgatcatttctttctgattttacttggtatactaaatcttctggtagttgttgccacaggattaacatttttgtaagcacttagttaaatacctcagcttggctgcttcaagaagagagcacatagttttacaatgtgttatacacagataattcattcttaactgtgaattaatttattgaaggcaaaggaagtattaaatatactctcatgggtcaagaattgcaaattgaggaaggtttttcctaatcctcatttctcatactattttatttctcctagtctcatttgtctcttcctgattcttggatctattcctctccatctttcattttcctcctaactccttaaactgagtcaacaattggaaacttcccttccacctctagttcactcctacttaaggtaaatctgccccaaatgtacccatcctgttgaacttttattacatgcttgtcatttatatatagtggcctaaattcaaagcaatcaaggtctctaaaaatgcatattgcatgactataagcacttgctgcatctttactgcttctcagcagagaaactgcttacaatgtgtgttggtttaaagtgcaatgggaatacacacagagaaaaacacatgtgataaacctcttcaagctaggtctatttttgaactgtgtccaggccatcttacaacagaattctgttagaataaacatatctttcatatatgttgttgctattccttgtctttacctcacaatttcctatctcttctcaacctccattcctactacaccactcaaacaactgccaagtcaacaagaatatactaggtccttcaatccaaaggacacttgttacttctcgcatttgaactctctgcagcatttgatactgccaccattccctctctctgcaaacaatcaccttcaaatatacccctgtcagaggcgtttaaaccagcgtggctctatcttgaataggggctgggcaaaataaggctgagacctactaggctgcattcccagtagcttaaggcattcttagtcacaggatgagataggaggttggcacaagatacaggtcacaaagaccctgctgataaaacaggttgcagtaaagaagccggacaaaatcctatgacaaccaagatggtgaaaagagtgacctctgaccatcctcactgctcattatatgctaattataatacattagcatgccagaagaaactcccaccagtgccatgacagtttacaaattccatgccaatgtcaggaagttaccctatatgatctaaaaggcgaggaactcttagttctgggaatggtccaccattgcggaaaactcatgtataatccaccccttatttaacatataattaaaaagtaacaaaaagtataagcagctgagtagcccatgctgctgctccatctattgagtagtctttcttttatttctttactttcttaataaacttgctttcactttaccctatggacttgccccaaattctttcttgcacgagatccaagaaccctctcttggagcctggatcgggacccctttccagtaacagcactataataccttttcctttaatcactgtaatgaaataattgcaattacaaaaaagtttgaaaaataatagaatgaacacctatgtggccaccatctatcttgagaattaaaacattataaatacagttaaaacttcctgtacatcttgttaaaagaaaaactttaaaacaattagatttagcagagtttaactgagcaaagaataactcactaataggcagcccaatgaaatggaataggttcagagagattctaggctacctcatggctgcagaggatttatggacagaaaaaggaaagtgatacacagaaaatggacttgaggtactgaaacagcctaattggttacagtgtttgcctgattggagcacagtttcaacagctggccacaactcatgattggtacaagagtaagttacagtctgtttacacatctgattaagttacagttcactatgtatggagaaacctctagcccaaacttaaaatatgtaaggcggcacactccatcaagttagaactattttaaaccagaaagcaggaagatggctcactgactcaaggattttaaaagtataaagctatcctactaggaagagatgatttaacactaatcactgataattcacttaacccagtaggttttctaacagggaatccaaatctaaaaggccctaagcatcagtgtttatatctaattgattatcacacaaaagtcaggcctgatttaagagagattcctttcaaaatagggcagcacttattgatagatggctcttcccgggtaaatgaaggaaaaagacaatgggtattcagtagttgatggggaagctctcgcaggcatagagtcaggaagattgcctaataattggtccgcccaaacttgtgaattgtttgcattaaatcaggcttcaaatcacttgcaaaaaaaggaagggattatttatactgattacttattagtgatagtagatcgtcttactcactgggtggaagctattcccttttcaagcgcaactacgaataatgtaggtaaagcattgatggaaaatattatacccaggtttggcagataatgggactcatttcactgcacaagtcattgagaaattaactcaagcactagacataacatgggaataccatactccctggcacccaccttcatcaggaagactggagaaaatgaaccaaactttgaagagtcacttaaccaaattagtcttaaagactcggctgccatggactaaatgccttcacattgccttattaagaattcaaactgcctctcagaaagatgctggtttatctccttgtgagatgctatttgggttgcccttttgacactccactgctgacattcctatgtttgaaacaaaagatcagatcttccacttgctcttccctcagaactaaaggtcttttagcacaggtgccacccctagagttcctagcacaccagcatcagcctggggattacatcctcatcaaaagtcggaaggaaagaaaacttgaaccggcttgggaacaaccatacctactgtttctaaccaccgagaccgcagtccaaacagcagaaagcggatggactcatcatacccaagtcaagaaggcatcgccacatccagagtcatgggccattgttctgggggagagtcctaccaaactaaaactaagatacctcctttattccttccagctgacaggacatgagccgtatggtagctctcttccaagaccccgcagcctggggtaataaattctgccaagctctccctctttctctctctgctattccctgaagcctgacaaccctgcgggtcagccccctagggccatccagcctccgtcgcccgatgccaattttaccttgtgactctcacaacagggggaaaatttagcattccttggagaccgaatgggatgccgtgagcttaagcccttccaagagcttagcaaccagtctgtccttattccgtcccaataacacagcccccgatggaacaattacaaaagtatttacaacgccttacctcttactgttcttatagatgtacttattcctgtaggtagactctaaaaagtttgaagaggaaaaattatgaaaatcaagagggagaagttgttggaaacagcgagttcctcttctgaggttacacttgtcctctgttttcaaagcctaacttccttgcctccttgcccctagttaggataaacaaccttccagccatttccaatctgtaacccacatccattaacccacatctgttcccaatctgtaacccacatccattcccaatctgtaacaactcacatctgttcctgatttggtacccttagttccgaagttgctctgtagcccccacccctgctccatttgaagtagtcaatgaggatcagcttagattgtgtcgtcggaccccaacctatggagactggacacagtagcagggactgactatgttagagacacaaatccttcccttctttgttctgtgcactctcgccattgctccctccatgaggcccacccttctttctttttttttttttttgagatggagtctccctctgtcgcccaggctggagtggagtgcagtggcacgatctcagctcactgcaacctctgcctcccggattcacgccattctcccgtctcagattctcgagtagctgggactacaggcgtccgccaccacacgcagctaattttttgtatttttagtagagacggggtttcaccatgttagccaggatggtctcgatctcctgacctcgtgatccgtcctcctaagcctcccaaagtgctgggattacaggcatgagccaccgcacctggccaattctctttattgtatttttattctctattttatcatattttatcatatctgctctaattgctattatttctttccttccgctagctttaggtttaccttgctcttcttttactcctcatgtgtaaagttaggtttttgatttgagatctatgtagggaagcctctctttaactgcatttttcctctactgtcacaccaaaacaatgatcattgacacagaagaagaattatgtgaccaaatatgtggggagtttttcctcatgcattaaccagcagacaccagctgagtgccttctacttcagttctgacagtaccaggttggaggctcagtcactaagattgtcccccataccctcaaacactagttgcaagtttctgaacaaatggcttcaagttggggttcccacatctccttcttataattgggttcatttaattttctggagtagctcacagaactcagggaaacacttgcatttacgagtttagtataaagaatattgcaaaggatacagataaaaagatgcatacaatttagtatgggggaaggggtgcagagcgtccacgctctccctgggcatgccaccctccaggaacctccacatgttcagttatttggaatcccttcaaactcactcctttttggtttttattaaagcttcatgatgtcagcattccttcccccaaagtataggtcatgactctttctgttggaaggccttaagacccacaataagaaagctgaggaaaggctacagtcctgcctgggggcaggtgaaaagaaggtaagaaaaggtcagcagcctccccctgtggcctaacacacccaacattataacaaaagactgtaacaaggcctatggaagttataagccaggagccttgggtgaaaattaacatacatatcataacaccaaaagatcattctttttaatgtatgtatttacagctataaattttcctttgagtacagcttatactgcattccctaagtgttggtgtattatgttttaattttcattcatctcctccaagtagttctaatttcccatgtgagttatctttgacccattggttaagagtgtgttaatttccacaaatttatacattttccagttttccttgtataataatggaataattatgacaatttcttgctatactgtagctagaaaagatacttgtacaatttcagtctttcaagatttattgagattttatggtggccattcaatcacaaataggttgcatgctggatgacatttcatgtgcacttgagaagaatgtgcattttactgctgctgggtgaaatgtttatatatatatgtatatatatgtatatatgtatatatatgtgtacatatgtatatgtgtatatatgtatatatgtatgtatatatgtctatatgtatgtatatgcatatatgtacatatatacatatgtatatgcacatgtatacatacgtgcatatgcacatgtatacatacgtgcatatgcatatgtatacatatgcatacatacatgcatatacacatgtacatacatgtatatacatacgtacatatatgtatatatgtgcatatgtatacgtatatatgtgcatgtatgtatatatgtacatatgtatatgtatatatgtatatatgtacatatgtatatatgtatatatgtacatatgtgtatgtatatatgtacatgtatgtatatatgtatgtgtgtatatgtatatgtatatatgtatatgtatatgtatatatgtatatatgtatgtgtgtatatgtatatatgtatacatatatgtatgtgtgtatatatgtatacatatatgtatgtgtgtatatatgtatacatatatgtatgtgtgtatatatgtatacatatatgtatgtgtgtatatatgtatacatatatgtatgtgtatatatgtatacatatgtgtatgtgtatatatgtatacatgtatacatatgtgtatgtgtatgtatacatgtatacatatgtgtatgtgtatatatacatgtatacatatgtgtatgtgtatatatgtatacatgtatacatatgtgtatgtgtatatatgtatacatgtatacatatgtgtatgtgtatatatgtatacatatatgtatatgtgtgtatatatgtatacatatatgtatatgtgtatatatgtatacatatatgtatatgtgtgtatatatgtatatgtgtatatatatgtatatatgtgtgtgtatatatatacacacacatacatatatgcttgttaggtctagtcgttgtatagggtggttcaattcctctatctccttattgatcttctttctagaagtgttaagcatcattgaacgtattgtattgaagttttcaactactattgtagaactgtttatttctcactttattctgtcaatgtttgcttcatatattttggggctcagggttttggtgcatatatgtttataattgttatatctttttgatgaatttgtgtcttctctcttttatcaatatataatgtcctttaattgatatataatggtcttttcattttttaagtttttgacttaaattatattttgtctgatattaaaataacaacttcatttctcttctggttactattggcatgaaatacctttttcatcacttcactttgaatgtgtttgtgtctttgaatctaaagtgagtctcatgcagacaacatacagttatcatttaaaaaaatttcattctgccaattgctgccttagagaacctaatccatttgaatttaatgtaattctgacaggaactaacttttgacattccaacatttttctatatgcatcatacctttatggttctcatttcttccattactgccttcttttgtatttagttgacttttttttgtagtgaaccattttgttttcttcttattcccttttgtgaatatatttttagatattttgttagtgactaccatggtgattaacatcctaaatttataacatctgtcttaaattgatgccaacttgacttcaataacatttaaaacctctgcttctaagtactccatatttctcacactttgttgttggcccatattacatgtttatatgtgtataatacaataaacatatagttatttttaacacttagatcttttaaatcatgcaggaaattaaaaaatgaaattataaacacaaaatacaacaatactagctcttatattttctcatgtacttaccattactgaagatctttatttcttcatatgacattagtttaatgtctagtgttttttcatttcaacctgaaggagtccctttaacatatctcagagggcgagggcaggacatactggcaataaacttcctcagcttttgtttatctgggaaagtcttttttttttttttttttttttgagatggagtcttgctctgtcatccaggctggagtgcagtggtgcgatctcagctcactgcaagctccacctcccaggttcacgccattcttctgccacagcctcccaagtagctgggaataccggcgcccaccaccatacctagctaattttgtctattttttagtagagacagggtttcaccaagttagccaggatggtcttgatctcctaacctcatgatccacccacctcggcctcccaaagtgctgggattacaggcgtgagccaccgcacccagcctatctgggaaagtcttaatttctctctcatttttgaaggacagttttaccagacatgatattcttggctgacagatttgggggttttgtttcttcttctttttctttcagtactttaaatatgtcatccaaatgtcttctggccttatggtttctgttgatgagaaatcagctattaatctttttgaaggtccattgtatatgacaagttgcttctcccttgctactttcaagactctctttgtctttttctttcggcagtttgaccagtttgtcttggtgtgagagttttttgagattcttggacttttagattcatgcctaccatcaaatttgggaagttttgtttagtatttatttacctattctttcttctacttcctctctgtctctgggactctcaaaatgcatattttggcccacttgatggtgtcccacatgtcccttaagctctttttacttttcttcattatttttttctatctgcttctcagactcaatttaaattgtcctattttcagatgaactaattctcttgcttgttgaaatctgctgttaaagccctctaataacgttttcattttagtaattgtattttcagatgcagtttctgtttggctctattttttgtaatttttgtatctttattgatattctaatatggctaacacattatttttcatatttcctttcattctttgtccattactttttaaagcatatttaagacagttgttttaatgtctttgtcaagtaggtacaacatctgtacttcctcagtgaccattcttttaatttcttttgcttatttttgttttgtgactatcctgaatgatttttaccaagactgtgttccttattgttgatgatcactggagtctcttttccttactttgtgttaagctagtgtttttgaatgccaagcactaaaaacagaaataaaagacaaaacacaaaatctgcagcaaccaacacaaccaacaacaatccatctccctcagtatttgcagattgtttctgagcctgggcacgccgttaacacttagccagatttgcactaatcctagagatcagcccaaggtgaaagtttaggttcttttcaaggcatgtgtttcgccctgagcatgcatgcggctttctaaacttccctgcattcatttttttaaacaccctaatttcccaaagaaactgtcttcagtttttgctaccaggccttatgctctctacttcatgtttcaactataatgttgtgacccatgcatttgagggttgttatttcagctaacagtgtttttgaacaacggccactgctttaccaacctgaattcaaaattaagtgaaacagagttgaatgctttgcatcagtccttcagggaatttcttagacagattaaaacagacaaacacaactgtttgtgaggaaggtcatctctgcttcccatggaaccagggcccaagggcccaagctacgaatgtagactgcctaccactacctcaagacaaaaaaaaaaaaaaaaaaaaaacattgctgcatccaggaggaggtagggggaaggcaggtaaaaatatcacaaactttactgttgtttcaaagttgcctttttcttgactcaacatttgcttagttgctgtaaaattctgaattttttcagagtcctgaaaaagttgattctgacagtttctatttattttttgatatttctctaaaagaatgaattcatgaagctgcctactccaccattttgttaatattgctctttgtttttgtttgtttgtttaagtaaatgtactcaataataacatatacataagttcttgttaagatattaacattttaaaaacataaattctaagagttttaaatataaattactctgcaaaggaaaatagctgataaataacagaaaggaatacatatttcagtatgttatgtaaccagaagattggtgtggttaaagaaaaacattttaaaatgtattacctaccattcaataaagaaaaagtgcaaagaaaatgcatagttgaaaaaaatcaggctatattatggttttatgtgtgattaaaagccaaaaccacatctagtgccaaacacatgttcctaaaattcctatatactgtctcaatgaattaaaaaaatctcaacgtaatcatctcctaattgtgcttttctgagggaacattgttaattgtctacctgacaaacattgactttttcctcctctctgccataatcttgattttatttagttaacatgagatcttgagcttcaccagccttgagcttctccaactccggagagtaaataatgcttaccattgtaacccagtgatggtaaatttgtatctcttgagtgtgattgctttggacatacatatcactgccatactgatcaaacaaatgactgagggtagaaatatttcattttacccttcatagcaaatattattacagtcaacccttaaacaatatgtgtttgaactgtgcactgttccacttatacatggatcttccacctctacgattcctgagacagcaaatccaactccccctctttctccttctcagactactcaatatgaaaacaacaatgaaggatgaagacatttatgatggttcacttccacttgattaatagtaaatatatttctcttccttatgatttaattaaagttttctttcctctagtttatttttttgtaagaatacagtacatcatgcatataaaatgtgttagttgacattattagtaatacaaaaatggttaattgactatttatgttattggtaaggattctggtcaccagtaggctctcagtggctaagttttgggggagtcaaaagttatatgtggatttttcactgtgaagggatcagtgctcccaacctctgcattgttcaagggtcaactgtatattatttgtaataggcacattacaaattaatgtaatgctttacttaagtacaaactactatggtctatacgttttgaaaaaatggaaagttttgatttgaaactatttagataatttaggtggaatgtgtttggcccttagatattaatggttattcttcattttctacatccctttggtctttcttttttcttcttcttttatttatatatacattttgcatttaacgtgatgctggatggctcaacaagtagaatacattcattctggtcagctgagctattttttcaaaaaaaccaaatcgcaaatttctgttttttttaatggaacaaatgcaattcaacattccaaagtaaattaagtcctcaatttgtattggtgctattaggttcttttcttgactggactgaacttagtagattctctcaaatacaaaaaggatttttagattacttattaaagatatatctatgcataagtggtaaatcagcatgcatataccatacagcaatatagtattaacaacccataggcactgatctcagacatcccaagtgcctatgggttgttaatagtactattaacagtgtcatagtactagtactagtaatagtactagtaatagcaatagtactagtactagcaatagtactattattattttaaaggtaaattttattttaaaataaaaatagtaatagtaatagtactattattagtgttaataatactaatagttaatactaacagttaacactaatagttaatactattgacaacccataggcactgatttcagacatcccatgcataccacttacgcataagtagtaaatcagcatacatataccatacagcaatacagtattaacaacccagaggcactgatctcagacatcccaaacaggctgataatgcaaatgattctttcagaaaccattgtatttaccttttgaagaaaatacctagatagtggaactgaacacaaagaattattaactagctgaaattacagccagggtttgagacagaaagtgtacattcagaattcattctcttaaccacaaaattatgctgccagagaaaatcagcaatgttaaacaagtagaagaatgttacatgataaaaatgcattttcagtaggctgtttacagtaattccaattccaaggtaaggttttgcctttttaagttggacggctgtgagtctaccacttggttattatgtgtggtgagacttcagaatatgaaaaaatgcttaagcttatgctttcatttgccactattaaagaaagaacagtagagtaattccataatagtactagtttacaattactttttttgtgaattagtcataggaaacttcagaattctgttattttcagggctgaggttgaattcatttgcgctttaatatcaactgctggtctttctgcaggcagtcactttcagggtagaattactgggtttcagggtagcttttcacactctacactatggccctggggatgggttgactaccaacaaaaggttgctaaactacttttttggggcatgctcagagttattgtccctttaggactaaagacgcaccccccacccccccccccgccctttggttgtaaatgttgactgacttcataaaagactccaaacagttgaaaccactcttccttctgcactgaagatgtttgcattgtttgttaaaatggattaatcagatttaaattttaaacaccatgtcctagaattgtaacaagctaattattccatttaaagtgcataacaaactaaacttcctgttaagtggcatttttgatccaccaattatctggacaaatatactgatggtcagttttctcatatgtcctgctttcaatttacttcatgattcaattaaacagttgtcagtacatgacaagaaaaataagctccctggtccatagtggccaagacatatcattaacattgatatctaatacacaagttattgcacattgagatatcttaatagttggataacattcttattttaaaacaatatgtgtggattggagattttgcaatctaggcacaaaagatatcttctgatcccttccgttattcagaaagtaattaaaatcaactaaatagattacaaagacaagaagagcaaaaaattgtaatctcctggtgaacatattatgaattggagccaattactggtatgcatttctattacccttggcctttgtaatctggaagctataaacttcaaaatgttcaattcagcatataagtcattatattagaaaattccatttaaaaacctatagaagttaaaatgatttaaatatagacataaaatagtaagcatgaaggtgttcaatatattaatcctgtaatctaaaatattatttgggcaatattcttaatctcttaaatattgattaaatggattttacaggaacaaggtaataaaatcatttttgagcagcgatttcatagttgtgaatgaaaatatgatgcattataaagtgcaagtgactccagcatcttcagaatgtgaacaggctcttgtcccccattgccgaattttacattcttcaatagatgattctctcccaaaacaaaacacttcattcagccatattggaccagtacctgcaataatgaggtataactgcattagtaagtttagagtttagtgtttctctttgagtggggcaaagccattaattccttcactaattaaacaaaaaagtgttgattattttctgtatgcaagttctgtgctctctagtaggaatcaaaaattaatctcctgcttcagaacactttatactctgttaacatgtaaactactaaaatgcaaagtaagaagagctctaacaaagttacctacacagttctataaaagtagagattaagaatgtttttttaaggatttgacaaattagttttattattaatctaaaaataaagaagaaagtttgagccttaataatcatgggtacatgtaataacctgatgatccaagcgtatctgtatgtcaaagggtcttggggtatatttgcacataaaataaaccggaaaaaggaaaacttaatatcagcatcttcctccttttgttatcttcccgtgtatttcaatttatgtgtgcctggtttatcaaatacattatctgtttttaattaaagtagaactaatctaatcagcaaagggcctacacaccatcctgtaaggaaatcatggattaagaatgctactgattgcaaacacaaacaaacagcaagaaaatgacaaagcaaaggttttcctgagctgatcaattgtaagagtgttaacagtaagttggagagcccaagtattttttgaggtgtttataacagtattgaggcttttttacttgaaattttaaggcagaagaaggaaaagaaaaaaggaatatgatctcaaaatcagaaaccttgccagggacactttttagttcccaaattatcttactaggcatggcatgtttcctattgtgtttgtgattgtatgtgtgagcatgtttgtatgtgtatacgtatttgtatatctgtgtttccttataagtatataaagtctataaaaactttttgaaagcctcaaagggctacttaaaaatacaggcaaataaaaacaattgcacaaatagtaagactattcccatgttaatacaggaggaagccgaagtacgagacatttataaattatatctattatatttattgtcatttataaattgtataaacaaacagaaattaaacttttggtgaaagccatggctctgtcataatttggagagtgcgagaatggctccatgaattgtgaacccgggctactgtgatgctttcgaattgtattttgtaggtctactcagtgaatttagatttcagcagtgcagaatttgtacaatccaggaaaaggaaactgagagtgggaattctcccaatgtctacagcaccagcaaggccatcccaacatgaatagcaaaggaaagaaattatttagttgactaatgtgctgacatgtaagcacatgtttttagaaattgcagtaagggaattcacgaatgttagaataccaaggttgtggtcctgataatgaaaatttaagtccagtcttttaagaatttcttatgtggcaggaaacacttatacatgtgatgtattattccatgcaatcctcaaataactttcaaaaactgaatgccattattgtgtcattttactgttgaggaaactgaaaatcagcaaggataaggaactgtacgtgctcaaagtcgcacaggattctcaccctgtatccaccctgagccactgccttaaatcaatgacttactgcaacctccttcattattagacttacttatttagcaaatctcctttggtgcctacacgagtgaacaagaccaaactccatactcttgtggactgacttcctgggagggcttatgttctaggtagatgaagcaactgagatcacatatacaatcatgccagagcaaatactggcatctagagcctctgattcttattctggttatttttcctctgaggacacatggatgtgacaaatgtattgtggaatttggtatctctgtcttttgctatgtggaacagtttcagacacagtgaaaattttttaagtgcttgtgtataaggtaatatgctaggtcttttcacatacatttctaaatttactttttataataaccttgttaaataatgataattatctccatttcatagatacataaactgagactgagaaagggtgtatgactttctcaaatttacaaagaatagatccaggcaacagaacatgatgacacttaaagcttagtgatattcatgggttacatagatgtctagatagaattatagaagtaatttccaaagatttgttgttttatttttatattaatatattcaagactattgagcccaggggaaaaatttatttaatacacattttccgtctcattccaaattgttttctgcattaaaaagttaatgcagatagtataaaattcataaaattttatccttgtgtaaaccaatgagataaaaaacaaatttgtttttatttctttagataataactgttattcaaggatcttcgttgttggggctgtcactgttattattttttttgtgcctctgaactattctttctattcggtggaaagctatacaaaaattacgtgtgtttcttagatatgtttttaatctctaatcctcttcctctctttctctctctctcatctttccacctatatacctagccatatatatatctatgatttcctttataatttgagggttgtagggattgatattgattatatattttttttaagtttttttttttttttttttttgagacagagactcactccctctatcgcccaggctggagtgcaatggcgtgatctcggctcactgcacttccgcttcctgggttcaaatgattctcctgcctcagcctcctgagtaggtgggattacaggtgtgcaccaccacgcccagttaatttttgtatttttagtagagacggggtttcaccatgttggccagaatggtctcgatctcttcaccttgtgatccacccacctcagcctcccaaagtgctgcgattacaggggtgagccactgtgcctgacctcctcttcacctctttttaaaaaatgaaagatactgatatttctttgggggatttgggtatctttaatcttaccagcatttccatgaaaaataaaaggtaatcagtttcatacatcatccagatatattataaaatgatgagatttgagatcagctgctgaatagataaatgggagagcaaatatcattaatagttaaaagtgcctgaatgtgtattttcattatttctagtcatgactgagtgacataaatttgtatgacttttaagcctagttgggaagtgttttgtgaacagtgtctccattgagaaaaacaatgtaaattaaagttgaaaacaccttgggaatcaaagtagagaagaatgggtcaatatagcctatagtttggattgtagttttgtgcttatagagaaaccactcatttttcctcaattttatgatatgcagaataaaggagtaaggctaacatagctttaagactttgtctacctttaatatttcatgatactaagattctgaagaagcaagctctttagaaatgaagatcttaagtataaaggacttggaaggatgttccatctggtggagaaagcatggtatgagagaaaggttaaggcatgaatcttgacccttcttcccactcccacccacccccaaccacccccaaccaccataatgactacgtaaatttgtacaactttgatgacctctgctagccctacttattttctctatgaaaaaaatatgctatttttctgtgattacccagctgtatggaccagccctatactactttccataatatttaacattcaaatgtttacattttaaaacattcaacatgcaaggagcagtatgtaaaaatttgacttgtgaccctttgatatatttatttatctttgagattatatttactcccattcattaagggatagttcagaggtatagaggtgcattttttgattgccttctgtttacccttacattttttttttgaaaatttcacatagaaaattgattatggtatgtaaaagtggtaataaaaaagcaaagaaaagacagctaagaataacttttaaatggcatttatgtttatatattacttttgtttctcttttcaggtttggagtttcagcactataaactcaggagaagaagcaatagttactccagatcttacttccctcatcagcatccatacaggctcagatatacctggaacaaattcttggaggtaccactgttgtatgataaaactcatccaagtttgctgcagggagaccacaggcacaatagctgggaaagcctggatacggggcaaaaagtgactcactctcctttccctgccctgtgcattgataaacagtagatgcccctcagtgcttccttaattaaacttgttttgtctagtcagaaaaaaaggtgcatccaaatgagagaacctatttaaaggagcatgcttgaaactttattcctataagtcattttacctgcagctgcaaaactaattgttcttaaaactaaggattctatctgctaagccaggtttgctatttaaaaccagaaaaaaatatgtggagactgtccaaaaattatattctttctataatggtgcattataaaaagagggttcatttaaattgttttctggctgggcacagtggctcatgcctgtaatcccagcactttgggaggctgaggtgggtggatctcgtgcggtcaggagttcgagaccagcctgaccaccatggagaaaccccgtctctactaaatatacaaaaaattagttgggtgtggtggtgcatgcctgtaatcccagctacttgggaggctgaggtaggagaatcgcttgaacctgggaggcagaggttgcggtgagccgagattgtgccactgcactccagcctgggcaacaagagcgaaactccatctcgaaaaaaaaattgttttctttttgtttcaattttggtaatgatgtacaatatgatatgaacctgattcttctcactttcctaagagaaggataaataattaaaacaatgcatgtttctcttttagttctttactcatccactcatttttctaagtttcttttcttgtctctactctgtatttaaaattgctttttcttttcctcttgagtgaaactgtgaatttaaggtggaggagtgaaaaaatcaggaatgttttaaatagctttccataaaaacctcgtttgccatgtctaatccccaatcagtgaataatgtaagcctgtctcttaaaatacaatatccagtgaagtagatcataaaacttacttttcaaatcattttcttcagaacaaataatgttggttctatttttttctctcagctcattttgctttattattttaaaattctcataattattctttagttgtttggtactgaactctacgcagggagtggaaacaacagctaagtcaaaccaggtgcagtggttcacacttgtcattccagtactttgggaggctgaggcaggaggattgcttgaggctaggagttttagatgagcctgagcaacttagcaagaacctgtctctataagaaattaagatttaaaaaaaaattagccaggtatgtggtgcaggcctgtggtcccgagaaactctgcaggctaaggtgggaggatcgcttgagagcaggagtttgaggctgcattaacctgtgattgtaccattgtattccagcctaggtgacagagtaagaccctgtctataaaataaaaaatctaagtcatattagtgggatatctactttgaattagccttggaatatcactgatgtcaatatacaatgtaatagcgatctcactctttcaaagagaatagcaaataaatgtgtgataacacagtttgtgttgctgctagcagtgatctccttcagtagtgagcaatacaacattgtgagtcagattttgtactgggtgctttccatatgctagttaactcaagcttcaaaacaaatctgccaggtcagtattattctcattttattggaaaggaaattgaaattctgaaacacaataaccacagctaaaatttaaacttgcaattttttaagttagaaaactcctaatctttccagtttgcttcactagatgctgaaaaaatgtaaaaggaaaccaaaatcctgacccactttattgtttgatgataataaaactctgggacaatgtatagaatcaccaactaccataaacaaacagcctcctgaaaatttagacaaattatgtcaagaaaacttgagagacttatctccacatagccaagtaagtaacttcacatgagactaaactctgtcattctattccttatttaagtttaaaaaaaaccattttcttcttagtatctcagtatacttattatcttcctttcttaccagttctttagaccagaaatccctactttatagagatataagcaggaatgaataaaagttttgaggaaaatactattttactcatgagactaagccttaaagttaatacaattttaggacaatagtcttcagctatgtttttctcacctatgtttgtaactccagtggaaaaatatctttgaagtccatggcaaagcttcatgctcagagaagaaataaagctagagatgacgtcttgttcactttcatactacaggctgtatgttgccagcacttactagctttccttgaattaaagtacatatactactactgttgctctccatttgattttctctttgtaatagatgaaaaagcctcacctcagccactgtactactgggctagtttcttaaagcaggggtccccagcccacagaccatggaccaatagtgtccatggcctgttagaaacaaagctgcacagcaggaggtgagcagcaggtgagtgagcaaagcttcatctgtatttactgccgctccctatcactcacattaccgcctgagtgccacctcctgtcagatcagtggcagcattagatactcataggaacacaaaccgtattgtgaattacacatgtgagggatctaggttgcacgcttcttatgagaatctaatgtctgatgatctgaggtggggctgcagccgtgatgctagagctggggagcggctgcaaataaagattaacattagcagagaggtgtgacggcacagagacaatagtaaatcaattgcttgtagactcatatcaaaaaccctgtcagtgagtggaaagtgacaagctgcatctgatggcaggctttagagtcgaaagtgagttgatgtacttcagttgtacagctgcttttggtgcctttaaaggtatgtttgagacaacttcaaatttccatacattctggattaaactttcgaagcagaatatcctgaaattgccacaaaagcactgaaaagcctgcttccatttccaacatgctatcttagtgaagcagggttttctacagtgatagcaaccaaagtgagattatggagtagactgtacataagcaacacacttcaggtgtcactgtctcccatcagccccagatgggaccgtctagttgcaggaaaccaagctgagagctcccactgattccacatagtgagtggaataatctacatcataataagttgtataatcatttcattatatattacagtataataataatagaaataatgtgcacaataaatgtcatgtgcttgaaccatccccaaaccttctcccatccctggtctgtggaaaaattgtcttccacaaaactggtccctggtgccaaaaaggttgggaaccactgtcttaaagaaacaatgctaaatacagacttgtcagatctctgcataatataagcatcaaaataattcatccagactagtggtattttaggatacttttcttttttttatactgagcttgtctgcattgattatattatctaaataactggcaaattttatacttcattttgtcaacaaaagcacatcttgagaatccaaaacatcttttatttctaaagctgaagaatcatcagtcatttaccaggtgactaagagcatggataagactcgttatgtcctctattagaactgtgggtgtccccttcatagatggtaacagtcacttgaaatgttttatacaattatgtattttaaataaatggtctttcattctgtggatgttagttatcatagaaatggattctgttcccacaaaacaatttggaaacgtgggctgggtggcgtggctcacacctgtaatcccagcactttgggaagccaaaaataactaccaaatatacaaaaactagccaggtgtgatggtgcatgctggtagtcgcagcttctcaggaggctgaggagggagaatcacttgaacccaggaggcagaggttgcagtaagccgagattacaccccgcactccagcctgggtgacagagggagatctgtctccaaaaccaaaaaaacaaaaacaaaaacaaaacagaaaaccaatgtggaaactcagattgggagctcagtcttgttaaataactgatggcatcattcaattctctagggatgaagagttgaggattttttctttttcctcttctccagaaaaacaaaaaagaaaaacaaagaaaacaaaagcaaaaatctagctgttgaccttgagaatatcttactattttacttttggagataaattttataggtgcaagaatgatttcaaacccacacttttcaacctgggaaaaatgttctaaatatgggacagggatggaaaatttggaaactccacagatctctctgaagctgtttatttcctttgtttcttctatgtaaacctttagggtgcaagttaaaaactacggccaggggctgaaactggctacagaagttctgcacattaccagtctattttctgacatctcctctcttcatgaaattaaattatccttctgggacctaaagactctagaacctgagacttctgcttaaatccatctcttaaacctaatatgataattattatcattatttttttagacggaatctcactctgtcacccagggtggagtgcagctcggctcactgcaacctccacctcctgggtccaagtaattgtcctgcctcagcctccaaagtagctgggattaccggcgtgcaccaccatgcctggctaatttttgtatttttagtagagatggggtttcaccatgttggccaggctgatctcgaactcctgacctcaagtgatccacccaccttcagcatcccaaagtgctgggattacaggtgtgagccaccatgcccagcctaatatgaaaattattttaggtaaaatagtaaaggatgtgattgtgacctattattaacgctatgcaggtatttaacacaatgcgtggcatatagtcattactcaataaatcatagcatattagcacttggtaatatcttctaggcatttgagaagttcatcttacctttttctacttttctgtaaaaatttgtttttcagagacaggtcttgctctgtcacccaggctggagtgcagcagcgtgaccatagctcatgtaacctggaactcctgagcccaagcgaccctcccacctcagcctctgtagtagctaggactgcaggtgcatgctatcacgcctggctttttttttttttttttttttaattggtagagataggatcttactatgttgtccacgctggtcttgaactcatttattccagtgatcttcccacttcagcctcccaaagtgctgggactacaagcgtgagccactgtaccaagcctagactatgttcctgtcactactttattctctgtctttagagaatgcctacatttcatttttttaaaaacaaaattttctggccaagcgcggtggctctcgcctgtaatcccagcactttaggttggcgaggcgggcagatcacgaggtcaggagatcgagaccatcctggctaacacggtgaaaccccatctctactaaaaatacaaaaaatgagccgggtgtggtggcgcgcggctgtagtcccagctactaggcaggctaagggaggagaatcgcttgaatccgggaggcagaggttgcagtgagccgagatcgcgccactgcactccagtctgggcgacagaatgagactctgtctgaaacaacaacaacaaacctcacaagattttctttaaattaccttgtccaaagtgagctgccttgtgcacggcttgaacacctgggtatcccaagctcctacagacgacctgtccaacgcgcacttcccagcgatcgtcacaaattgtaccccactggccgctgtggagtatctccaccctcccctcgtgagggccgctcccaccgaccagtcgaactttcgtaaatggagctgtaaagttaaaaaaaaaaaaaaaaaaaaaaaaaggcaagcaaggactaattatgtacatactgctttacagcactttttttttaaacacaaaaaaatgtttagcacattttccaaataacttcaactattggaataaatattaaactttctagcaccacctattggtaaagagtttaactgcaaatattgcagctttaacagctgttaagagcaaaatccaatctgtcttacatgtaagttatatatacgaggacacgtcacagattatattccaacgagtttgaattttgacagatacaagtttattgtcacttagattttttcataccattgaaaaattataactaaatggttcattattttcttgacatacaaacatacaaacttatcaacatacaatgcagagattttcaatactataggagggcgaggagcagatattttagaatatcataaacacaaaaataggtgatcaaacttcatatcttttcccaagggaaacaagggaactatagtgacaaccttcatttagaaatagcaaagactttccttgttgtgaggttcctggattctgtaacaaagatttttgtgtttttcctctttagaaaaaaatattaacgagataaaaaatcagacaattttgtttatttttagaagtgattcaaatagtaaactacaaagaaataaactttgtttataattataaaagtaattttgttctgtaatgtctaatcaaaatgaccatatgtacaataaacttttgtaaaatcttgatcatgctacagaaagatttacataaatatgaaatggctcttttctatttttaaaaaccaatatatatgcactttgacctagtgacagattaaataaaatagtgcaacaaatattataagagcaattcacttggcgtatgaaaaatctctcaacagcctgtattattctgctaagtatttgtttagaaaattatttggctaaagaacagaatgaaaggcagagatgaaaaattatttttaaaaatttagttaatattaaataaaaataatattttctaataatcataaaaactaataaatgtaattctacgtaaacaaaagatagcttttcaaatataagtttgaggaatgttatattataaaaaagatgtaattttcataacaaaaatatctctctaatgtgaaaatggagttttaaggaatgggtttttggagctcaattaattgaagaaatattcagtaacttctttttctccagtttgaattcattttgttagaacggtaatctaataacatttaaagttactagattactgtttcaacaaatgtttttaacttatgcttattactgttttaacagtaatttaataacatttaaagttattagattactgacaatttcctgtaatgaaattgagtgacctgagctatgcagaaacataaaaggtggcatgttactatatatataattataattattctcttgattcttccaaaatataattcagtgctaaatactgatttagtgtaagcatgcctgagtggataagtccttcttcacttaataagcataagttaaaaacactttaaaacatgaaaataatttgttattatagtatttcaactttcatttactagtaaaattcctgagtggcccaatcatttcctgtaattgcctaaagaaaacgagaaagaaaaatccaagaatggattgtgagaagcctttacatattagagacatgttttattaactagtgtgatatccaaatgtttatttttatacaagtcaaatatatccaaacataatatatttatcatgcatgcatgctatgaaaaatcaggcatactcaaacatttgattatatgagcatcgttgtcctgttgtccaaacaagtgaatgtaagcattctcactgcccattgtttacctcttactccttccaaaatgtcataaatgagccttgcttgtcctggagcagtggttctcaaagaataatatgcagcagaacaagctcccaacagctaattctgttggtccagggaccacactttgagaaccactaacctagatgattgcagtatatatttagaagaggagacatattatatcagaaacagatagtgctgctgatacaatcctttcatctcatttattgcaaagggaatggctgactgtaaatttctgccaaattccgtatgctcaagggatcctgagggggagtaggtacctctattcaaattctttttttttttttttttttttgagacggagtcttgctgtctcccaggctggagtgtagtggcgcgatctcggctcactgcaagctccacctcccgggttcaagccatcctcctgcctcagcctccggagtagctacgactacaggtgcctgccaccacgcccagctaattttttgtattttttagtacagacggggtttcaccgtgttagccaggatggtctggatttcctgacctcgtgatccgcccgactcggcctgccaaagtgctgggattacaggcataagccacggcacccggccctctattcaaattctttagggccaaatatgcttgggtatgctgatccatatctgtcacctgaaatatttttcagttataaataaactattgacaggtgaccacacattgctgatccttgaccatctctgaagtaatatagaggaaaggcgtctcaataggtcagtagactcatttgagagttggcttcacctactattcaactgctctgttttggtgatgtagaaaagttcattttgtcatcaaccttgatcataggattttctctgtaagactgaaggatcaaaacttctctgaaagtagctaattcactgtcacaaagatgtaaagaatgtctgtcgtttctttggcaacaagctaatatatttagtcagatagggctttttttttttccatttgggtatttttatcttgtatataaagatttcagaagacatgtatatgtgtgtgtgtgtgtgtgtgtctggatagctgtttcctctttatttgtgtagacattttctacattcaaatcaaataaacacagataagcatagactatgtgcctaaacgatttcgtgtattattattttttaattggtgaaaaaacagaaacagaaactaaagtaatttaaaccaaaaccaaaataataatgtattttaaggacactggatgtttcatagaacccaaggataagattatagttaggtatctgcaatagctgacccaagacccgaatctgcttaggagtctccaacttgtactcaagcttctttctgtaggttgctttattattctttttttgttgcaagctagatatctttgctctcctgttcacttgatagaacatgtctgttaacagctcctaagtttatattttacagtttctttcttgatgacagttactgtctctttctcagtgacagactgacagttctgacactcacctaacttgatattttacagcctatttcttagtgatagtttctaaaatatccagggaagttcttctatggcctagtttgggccaaatgcccacctgtggactggacaaacaggccgagtcacttgcatgaacatggcattcccacagtgagaatggggaggcatttccttgttgaaagagttttgagcagacaaaaaatcttaagtccattccataaaagatattttaataatcttggtgcatttatgcaaatatttgctgtttctttacagaaaaagtttgggaatccctggtagaattacaaacatagtagacgagaatgatagaggatttcctgggaatactcttgtcaagtgacttgtggaataaataaggtcatgcttaatctctgctcacctttccaacctaacccttgagaaattctccccacctgcactgctttgtctttttactttatatataactactcacattttccaaataagtctcattctcctttatttctggggctttggttcctgtctggaatgttccttcttcccttcccacttcccctctcatttctacactctcaatctccaaatttcgattggttactcaatagcactattacagatgctataccaaactgcagtaaacttgtttgttttccccagtagactgaaagaaacccgttatagtcatcttttcagcatctgacaagatgcaagttgtcactcagtagtcacttgaggaagagttatggcatgaatgagtaaataaatgaatggtaagcttctcttgatacatgaactgcattacccagtgagattaaattggcaaatgcttaaaatatcaaatcatagaagaaactgaatttaatatttcataagtcttcagagggaatagaatatagtttctatgagtagaaacagaaaaatcatgaaggaaagattgatttaactggcataaacataagtgtttttatggaaaaaaacccatatggctggctactgagagcctctccaaatacgagcttttggtgggaggctctgatcagagaagcctgagacattagaaaatctgatcttgtcagctcagtgagcagatctatctcttagaggcagactaatgttaaacagaatcttgggactaaatgtcaattcaatttacaatgagaaatgtaattgccttaaaaactggaatatttgaatctgcttgacaaggccactttctccccttgggaaatctgcatgggaaggcaaatcacagtgagtgaactcttagtttaattaatttattaatttacaaagagacttagcagtgagattttgcttctgggatggccaatgatctttcgttaacacatttttctttatatatgttaatacattcagtcaggtaaaatgatttgacatatctctgctgattcattgaatgttcattctatagtttaactttttaaaggcaatctcactattcttatgtcccatttctttacatctctatgacaatgagttagctagtttcagagaagtttcaatcctttctttaggaaagaactgggacataagaatagtacatacatatgtagtaaatgcacaaaaacatgaacggaaggaaacaaactccaggataaaggtttaccctggaaaggaagacaggtagacatactggtacttcaactctgctcataacattgtatttcttttaaaaatttttaaaagtttttctttagagataaggtgtccctgtgtctcccagattgaagtgctgtggtgcagtcatagctcactgcagcctcaaactcctgggctcaagtgatcctcctgccttggcctcccaaggtgatgtgattacaggtatgagccactgcacccagccaaaattatatctcttaaaaaacaaatacttgtaatcaagatggtaaatgtgaacatttcaaaggtccaagtggtacacatgactgtgtattagctatttattataaatattatttcttttctttatttttgaaatatattttatttaaagaaggaaacaacacattcactgcaatgttcacagagccatacctgaaccctgcacaaattatttaaagtgttccatatatgagtctacccttaaaagttagagaaaagatactacgaatctattcatcgctgttagaaagacaacattcaaacttgaaaagtcagggaacatgtaaggtcttctttgcatgtgtcaattaccactactcagtggaaagaaataatcgaacatagaaatgacttttgaggagcataacagttattatcctattgtttactcatagtcatgatttcctttttgtatcatttattggaattaggatttagggttaaatttattacaatggtagttatgatatttgagatgcaaacataatacagaaattaaaaaaaaatctggttgcagtttgacctgaaagttctcacaacatggcaaaattcctttaagaagataactgattctttatttaagataattaccttaatgagatacttagcaatgaaatgtgcaacccaaatatcagatacctgaagaaactgagttaaatttctctagaaaatttctctagaaaaataacataacatattgtgttactcctaaagccagggagacaagtatttgggacagagtcaagaggagatatttttgtattttttgaagagacgggatttcaccacgtagcctaggctggtctccaactcctgagctcaagcgatttgcttgctttggcctcccaaagtactgggattacagacatgagccactgcacccggccataggtataattttgcacagtttacttaatggttctaaatcctcatggggagaacaccagagtgatagattccttgtggggattaagtaaaggaggtatataaagtgcttttcagagtgtctggtacagagggttcattctacacattataggtattattgatactattatttcttaaaaattcaaatttctggcctaatgatggggaataggtgatgggagaaaaaaagtatcatatattaaatagcagtttctcaactactttgtgcttcagaatcccaaggagaacttttggaaatcacatgtatcaaggccacagcacaaactccctgaaatcagaatatctgtgtgtcatgtccaggcatctttatatgataaaagcctcacgagtcattctgatgttcaccatatcctgagcccaacttctagaacaatactagaatacatatgaccacttagagagttacaaatcattcgcattatggaagaattaaactaatacatcgccgcccaataagcaatcagcaagactatttctaaacatgattgaacaagatagtgagtttgatccactttttagtgccctggaccctgcattctgagatttttaaagcaaatcttgtcttatccaccatttggtaattatcttttcgggttaggcaatgagtatatcttatctctacacacaatagcttgtcaaggggaaagctcaggatcaaaagtagagacagagttattttgaaggaaaaaatgcggcattctttcttagccatggctagatgttaagataatgccacacaagagctgacttcacaatgaatataacatatctaaagagaaagagagagcgagactgagtccaaatgatttactttgaacacctggatcctgctatgcctgaagccatctgtgggaattgtaattcttaattatgtaaaccaatagactctattttgtgattaaagatgtttctgttactttccacttaacagttcttacaaatatctccatggtgattatttgtcaaagaatattagaagtgattgcccaggtcatcctgtttgtcattaatcccatcaccattggttattgtctgtttaaacagcattattctggtaatttttattatctcatgagacaatgtaaaagaacatcactgaaatgtaaatacacaatattggcagtaaacaaaagtgaaattgttctcataactataaaaacaccagaatgcatcaaatttacttatggtgcaatttaggccctctttaagaacaaagttacagaaacatagacaaagaaaactgaattcatcctgaaacagttccagccgtgtgctgcagagatcctgcccacagacagaggatcaattcttgataccttcctattatgtactgaattgtgtcgctccaatattcgtatgctgaagtccccaatgtgactatatttaaagatagaggccatatggaggtaattcaggttcaattaggtcataagggcagaatcctaacttgataggacaggtgccctatcggaagagataaagacaccaggagctcagtgctcacacagaaactgcctcatgaagtcacaatgagaagggggccgtctgcaagccaaagagaagcctcaggagaagccaatcctgcccccagcttgatcatgggcttttaatgtcaagaactctgaggaaataaatgtctataatttaagctactttatctgtggtattctgttctgacagcccaagcagactaatacgttttcttttttcacttatgttatgtttttacttgcaaacgagaaatagcatacttcagtgcatataaacttaaaaatacaagctgcttctttaatttataggtggagttaagctaccatacttgctatgttgtgatttgaacacactgaaaatctcttttccgaaaataatcactttgtccctaaaacacctactttaaaagctgatttttattcaaaaatgacataagtacttacgaaggacctattagatgttttaatacgttaataataataatatgtttgttagcttacactctgtgattgataaagcacatgtccttttggtgcagaaatagtatttctaggtgcaggtaatgtactgggtaacaggattaagtgagaatgcaacagggaagagttcgaggtggaagatgttttataataaaacataatcattttataggggaaataagttttgctgtaaatcatatgaagttttagtgaaaatactgtacacagaaactgaatatttgtatgcagttaaagaggtttacttgttctttgaactttctaggaaataaaaatgcagaattatataaaacgtcattaggaaatgggtcattttgctaaataattcacattagaattcctttatataggtccctaaaatacctgagggtccaatgttttactttggcatggattaagcaggatatgagtaagaagtagaaaatgaaaataactacagcatccgggaaaggattaagagtctgtaggctaagccataatgggggaatttcttggagactccatgtgaaacaagccaactgtgtcgttctaggaaatctcgtcttaagattcacctcaggttgggtgccgtggcttatgtctgtaaccccagcactttgggaggtcaaggcaggcagatcatttgagtttagcagttagagaccagcctgggcaagacagcaaaaccccgttccctacaaaaaattttaaaaaacagctgagtgtggtgacctgtgcctgtagttccagctacctgggaggctgaggtgggaagatcacttgaggacaggaggcagagattacagtgacccaagatcatgccactgcactccagcctgggtcacagaaagagactatcccctcaacacgccctaaaaaagatttacatcttaagggcaggacatttccagagacgatcggctgaagggggcaaataataggctgtgagcccatacaagtccagtgcttgaatttgagcaaaataaataatcttgtgtgagtatcaggctaaatttcttactgcagaataggaagcctggagttgtttcttcaaagggcaggaaaggtacttggtactcaggctatggaggaaagggaagtggagtgttgggcctctgcttcatctgcattcctgcacataattgcatgaatttccacttttgctgctgtgaaaaatggggctgatgtttttccttctaattggttctggtgagagtgaggctgtgagagtcagctgggatagggactaagcaggacaagtgctaactgctggatccataattgatttaaatctctatttcaaacgacacaacatacaggtatatcctgttttattggtcttcactttattgcacttcacagatcctgcatgttttacagattgaaaatttgtggtaattctgtgtcctgcaagtctgtcagtgtcatttttccaatagcatgtgctcgctttgtgtctttgtgtcacattttgcaaattctcacagcatttcaaacttttcctttgtttcaaatgctttcttctgcccccacttagatgagcactgtattttatctttaagtatattaacatggtgacaaattgatttatttcattttttaaaacttttatattaggttcaggcgtacctgtgaaggttggttatataggtaaattgcgtgtcgtggcaatttggtggacacagattattttgtcttcgaggtaataagcatagcagctgagagcttttcgatcctcaccctcctcccaccttccaccctcaagtagaccccactgtctgttgttcccttctttgtgtccgtatctactcaaagttcagtccccacttataggtgagaacatgaagtgtttggttttctgcttgtgtgtgtgtttgtaaggataatggcctccagttccaaccatattccttcaaagaacgtgactcattcttttgtatggctgcatggtattccacggtgtatatgtaccacattttctttatccagtctaccaatgatgggcatttaggttgattccatgtctttgctattgtgaatagtgctgtgatgaacatatgagagtatgtgtttttatggtagaacgatttgtattcttcgggtatatactcagtaatgggattgctgggtcaaatggtaattctgttttaagttctttgataaaccaccaaagtgctttccacaataactgaactaatttacatttccatgagcagacgataagcattctcttttctccacgaactcgtcaccacagcatctgtaattttttgactttttaataaacagccattctgacaggtgtgaggtggtatctcattgtgcttttggtttgcatttctctaatgattagtgatgttgaacatttttgcatatgcttgttggccacgtgtacgtcttcctttgaaaattgtctgttcatgtcctttgcctattttttgtcaggtttattttttgcttgttaagttccttacagattctggatattagacattttttgatacatagtttgcaaatattttctcccattctatgtatctgtttactctgttgatagttttttttttttttttttttttttgtggtgcagcagctctctaattaggacccatttgtcaatttttatttttgatgcaattgcttttggcatcttcatcgtgaaatctttaccaggtcctatgttcagaatggtatttcataggttatctttcagagtttttatagttttaggctttacttttaagtctttaatccatcttgagttgatttttgtatatggtgtaaggaaagagttcagtttcagtcttctgcatatggctaatcagttatcccagcaccatttattgaaaagggagtccttttcctattgcttgtttttatcggctttgtcaaagatcaaatagttgtagatggttggcaatgtttctgggttctctattctgttccattggtgtatgtgtctgtttttgtactagtaccatgctgtttttgttctgtacccctgtagtatagtttgaagtcaggtaccatgatatctccagctttgttctttttcttaaaattggcttggctctttgggctcttctttggttccatatacactttacaatagggttttttttttttctaattacgtgaagaatgtcattggtagtttgagaggaatagcattgaatgtataaattgctttgggtggtgtggccattttaatgataccgattcttcctatccatgagcttggaatgtttttctatttttttgtgtcatctaggatttctttgagcagtggtttgtagttctccttgtagaagtccttcactcccctttttagctgtattcctaggaattttattctttttgtggcaattgtgaatggggttgcattcctgatttggctctcagcttgactgttattggtgtacagaaatgctagtgatttttgtacactgattttgtatcctgaaactttgttgaagttgtttatcagctgaaagagcttttgggtcaagactatggggttttctagatatagaatcatgttgtctgcaaacagatagtttgactttttctctttctattttgatactgtgtatttctttttttgttttgttttgtttttttgagacagagtctcaccctgtcacccaggctggagtgcagtggcatgatcttggctcactgcaacccctgcctcccaggttcaagtgattctcctgcctcagccccccaagtagctgggactacaggcacccaccaccacactggctgatttttgtatttttagtacagacgggttttgccatttggccaggctggtctggaactccttacctcaggtgatcttcccactgcagcctcccaaagtagatgccctatatttccttatcttgcctgattgctctggccaggacttccaataccatgctgaacaggagtagtggagagggcatcattatcttgtgctggttttcaagcagaatgtttccaggttttgcccatttaatatgatgtcgctgtgggtttttcaaagatggctcttattattttgagatatgttccttcaacacctactgcattgagagtttttaacatgaagaggtgttgaattttatcagaagcgtttgctgtatctattgagatcatcatgtagtttttgttgttagttttatgaggtgaatcacatttattgatttgcaaacttttccattattagtaaaatatggggagattaaaacagtttgtggaaaaaagcaattaaaaggtaaaaatcacaaaatataaattttacttctcaacataagctccatcaagttcaagacacttttataggtgatgatactagccatttagtccattcctaaagacctgaggatcttaagaatttaactatatcaatgttgtaatcttctcattattgaaagaagaaaaattggtgtcctttaaaaatattttgagagtgggaagctaaaagaagtcagaaggagccaaatgaagattgtaaggtagatgcccaatgatttcccattgaaactctcccaaaaattgtcctagtttgatgagagaaatgagcaagagcattgtcatgatggagactccctggagaagctttcctgggagtttactgttaaaactttggataactttctcaaaatactctcatagtaagcctaggttaccattctttggccctccaggaagtcaacaagaaaaatcacttgagcatcctcaaaaactgttgtgagaacctttgttcttgactggtctgcttttgctttgactgtaacacttctacctcttggtagccattgctttgattatgcattgtcttcaggattatactgggaaatccatgttttatcttctcctataattcttcaaataaatgcctcaggatattgaccccacttatttaagatttccactgaaagctctgctgttgtctgcagctgatctggacacaatagttttggcacccatctagaaaaaactttactcaaccttaatttctaagtcacagttgtgcaagccaaaccagttgagatgtctgtggtgttggctgttgttctgctgtctcagttcttttcaattaaggcacaaacaagatgtatttttttcctcacaaattgacgtggatagtcagctgctgcagggttcatcttcaatattttcttatccctttgtaaaactgagttctctttttgtcaactgctgattcctttgggacattgtgcctataaacttttcataaagtatcggtgatttcaccattcttccaaacaagtttcatcataaatttcatgtgtgttcttggttccattttagcaatatttatgtggctctgataggggctctttttaaatagataccttattgttcttagtgcatcaaattagattctattcagacatgttataataagctagcttgttttagtgcagaatttttgaaatccatgtatagtgttttcctaatacatattttccatgattttttgaagaccccttgcatttgttatggcaatcagtgacctttgagattactactgtgattagtttggggaaccacaaaccatgcccgtaaaagatggcaaacttagttgatatatgttgtgtgtattctgactgctccaccaactggctgttcccccttctgtctctcttcctctcctcaggcatccctattccctgagacacagcaatattgaaattaaacaaattagtaaccttaacaacggcctctaagtgttccattgaaaggaagagtggcacatctctcatttaaatcaaaagctacacatgataaaccttagtgagaaaggcgggttgaaagtcaagacaggctgaaagtatgaaatttacctaagttgtaaatgtgagaaaaagttcttgaaagcaattaaaagtgccactccagtgaacacaaaaataataagaaaacaaaccaccttattgccgatataaagttttagttagtggccttcatatatgatcaaaataaccatgacactcacttaagacaaatccaagtccagagcaaggctctacctctcttcaattctatggaggctgagaaaggtgaggaaactgcaggagaaaagttggaagctagcagaggttggttcataaggtttaaggaaagaagccatctccataacataaaagtacaagatgatttagcaagtgtggatatagaagcttcagaaaattgtccagaagatctagttaggataattgatgaaggttactacactacacaacagattttcaatgtagatgaaacagcttctgttgaaaaagatgccatctataactttcatacttagagaggagttcatgcttgacttcaaagctttgaagtataggctaattcccttgttaggggctaatgcagccagtgactttaagttgaaggaaatgctcatttgctattctgaaaattctagggcccttatgagttatgctaaatgtcctctccctgtgctctagaaataggacaatgaggcctgggtgacagcacgtctgttgacagcatggtttactgaatattttaatcttactgttgagacttattgctgagaaaaaaaatccttttaaaatattactgctcattgagagtgcacctggtcacccaagagctctgatggagatggacagaaagactggtgttgttttcatgcctgctaacacaatatccattgtgtagcccatggatccaggattaatttttactttcaagtcttattacttaagaaatacatcttgtaaggctgtaactgacacagagagtgattcctctgatgtgtctgagcaaagtaaattgaaaactttttggaaaggtttcacaatcctatatggcattaaaataatttataattcatgggagaaggtcaaagtattgaggttaactgaaatttggaagaagttgattccaaccctcatgaatgactgtgaggggttcaagactttaatggagaaagtcactacagatgtggtataaataataagagaagtggagaactagaattagaagtggagcctgaggatgtggctgaattgctgcaatcgataaaacttgaatggattaggggttgcttcttatggatgagcaaagaaagggtttttttgagatacaacctactcctgaagggaagatgctgtgaacattgttgagacgacaacaaaggatttagagtatcatatagatttagttgacaaagcagcagcagagtatgagaagactgattttaattttgaaagaagttctaaagtgggtcaatgctatcaaatagcatccattgcatgcagcagagaaatctctcatgaggagaagactccatcaacgtggcatatttcattgttgtcttaagaaattgccacagccacctcaatcttcagcaaccatcacgctgattagtaagcagccatcaacacggaggcaagaccctccaccagaaaaagataacaacttccggaaggttcaaatgattgttagcattttttagcaataaagtattttaaaaattaaagaacacttaatagactccagtgtagtgtaaatataactattatatgcactgggaaaccaaaaaatttgtctggcatgtttcattgtgataattgctttttttttgccttggtctggaactgaaaccacaatatgtccacagtatgcctgtattagctatacactctattaaggaacacatctattgtgttaatggaatgctgcattttttttgagaaggagtattgctctgtctccaggcgggagtgcagtggcatgatctcagctcactgcaacctctgcctcctgggttcaagcgattctcctgcctcagcctctcaagtatttgggactacaggcatgcacaaccacacccagctaaattttgtattttcggtagagacagggtttcaccatgttggccaggatggtctcaatctcttgaccttgtgatccacccaccttggcctcccaaagcgctgggattacacgtgtgagccaccgctaatttgtgaacccacagaaagctctaaacaccatgtaactgtcaaggatgagcagcatttacctaagttacctggaaccatccctactcaggtacactcagttctgctaactcataactagtgctactaagaaagtacattatggagttaaaaaaaaagacacaataaaaaaagagagacattggagcagccaaataatagtgaaaaatgttaaggctgagcccgttagcaaaataaagatagaatattaacaggtagctcttccccaggtgcacataagtagctctcattagtgataatggaagctttgtgagcattctaggaagactatgtttctgagtaatatccttaggagggagactagaggcaatagctggagtagttatgaaggtggaaacacaaacaaataaagaataactgagaatgcttatttggaatttgatctgccgtaagaatttttatctctttagctcttcaaattactaggcccattctagaaaaccaaactgctcattacaaatttcttccttttctgcctttctctctctctatctatctctttctctctttccctctctttctctttgcataccctccacatgacatatctgtgatatatataaaaatacataatactagtgtgggaatattgaatggagtcataaggactttggagatttaaagacctggctttgagtttctgttcttccacttattagcagtaagccacagtttataattctagaaattgggataatagtccttcacccaaatgctcttctgaggattaatgtataatgcaccaaaaaccctgttgggttgggtgtagtggctcacacctgtaatcccaagattttgggaggttgaggcaggaggatcgcttgaggccaagagtttgcaccagccttggcaatatagtgagatcccatttttatttttatttttttaaatagccaagcatggtggtgtgtgcctaaagtcctagctactcaggaggctgaggtgggaggatcatttaagcccaggagcttaaagctgcagggagctatggtcgtgccactgtagtccaacctgtgcaacagagcaagactctgtctcttaaaaaaagataaaggaaaaaaaaaaaaagcccttgcctcacaggctttactttgatcaacaatgctttggaaaaagactagtattcatttaagattgagctgagtccttagtaaaaatcaaatgaaaaaacaaatggatttttcctatcgttgtttgagttttagataggatactcaaaattcacatcctagttgtagtctcattgcacttgagcaaagaatgatgagaaatactaccaaaccacatattggtaattgagatatttaggacagagcctcacacaagtgttgtattgtatggtaggaatcatttcgtgtgactgaaacatcactcttccgcgttaaggtgagaacacaacagacgattcactatgactagcgttagagcttagtgaaggcttcttttctcttcattatgcatttttaaagttgataaaatttgtgccatttgtgccaataatttgaacagggcattcagcatccattttttgtctaaagagagaagactttcttccctaatttgaaaagtttggattagtttttcacactgaaaaatctatatttagtctaggatgtcagatgactttttaactgaatccctggaattgtctcccagcatctctgggaccgaggccatcgtgtggctgatgtagaccaaggtctgctgaagaaagctgctcatactctacctgacttgcagtgcagaatgggacaggaggtctcacaaaattaaaccaaggaaaaggagttacaacttatctctagatgtttgtgtaaactggctattcaatgttgctagcctgctaatagtcaggagtatctgaacaagtggctaattcttctctcccttttatttctggagattttaatgtcatgtaggcataaaaccagagtaccattgacaactctaacttgtttcaacctttcttggaattttctcatcagcattgtcttgggcccatgctttgttcttcagagactggactcttgttttattagcctgacattttgttttgacctctgttgacaccttctgccctccggcgtgcactctgtttagtagcttcttttatttataactaatgctcttctgctcgactcagacaaactcattgatttgcaatctggtcacacttgcattgctctatctaatataaaatcttttctttttctcgagcatctctctttttgccatgacatttattcagcttcttgcattttcattttgctttcactcctattctgattacagattaaaaatgtctgcattataccagcggggaaaagctattccagttcagagagatcactgcgaagcataccttacatctttaaaggactttatgatttcacagagcatcttcacacacacaatatcttacttgatcctcacaacaaccctgtgaggtaggtgttaacatgttcattatacaagagtgggaataaaaatgctgagatacacagaggcataccatctagagttctactagaatcttaatagtatgaatcttgggtctgtgtgttaaaacgtaaaggaaagaagagttgtgaaaatgtagtctgttgatcagtagagagaaaccaaaaatataacatgtaatcccataagagatttttagaacaaaagaatattggtattctttttcatgatcaaaatatttttgtttgaaatgaccaggtaatacatgaaaagttttatttttggtttaaatgggttggataaattgcccaagctcgactacacttcaaaacttaaaaaaaaaaaaaaaaaaaaaaaaaaaatatatatatatatatatatatatatatatatatatatatatatatatatgctgtaatttggaaaataagaagatgagaaggtaaaataagaatcaatttttaaaaaatattctaaggaattaaaatttttttatctcctctgcatacctatccagccctgttcctcccccagtatagcttagatgtattgtaattgcttgttcatttgtctacatctcttagggacaattagctctgtaaaaccagagacaattatctcttattagctgttatgtccagctcatggaggtacataatggacatgtgaattaatgattgaatgaatggattttcttctatgacatccctatctctggttgagaataatgtttgaatataaagaactctcatattatcaatactcatgacagttctcctagaacccaataaattaaattgtgttctagactctaggtgaatgcgtgtagtccagcctgtgcaatagaacaaggctctgtctcttaaaacaagaaaaagaaaaaaaaaaagcccttgactcagtctttactttgatcaaaaatgctttggaaagagaccagtattcattgaagattgagctgattcctcagtaaaaatcaaatgaaaaacaaatggatttttcctatcattgtatgagttttagatgggatacttaaaatttacaccctagttgtagtctcattgcgcatgagcaaagcatggcgagaaatactaccaaaccacatattggtaattgagatatttaggacagagcctcacacaagtgttatattgtatggtaggaatcgctttgcttgactgaaacatcactcttccaagttagggtgagaacacagcagttctcctagaacccaataaattaaattgggttcaagactctaggtcaatgggtggcagagaactgaggactggttggagcagccctccagtccgtgcatgagaggtgtccaggctgggggtgataggggagagaggtgatggtggagtaattggagtaagaagaggtatgagcatgggagcagaggcccaaacagcaccagggaccaggagagaaggccatgtggaagtcaggtacaacacgggaaccaaagtcatttggaggagtcacaaaaggatcttggaagtcagttgtgcagatgacttgtccagaggtgaagggccttttaatgagatggtagcagaggatgtcccgcccaacccacctgatcttaagagggccctgccctaatatgatcagtgagttgtactggtcctgacacatatataaaggaggaaattaattatttttaacatattttcagaaagccttacaaaattttaaagatgcatatgaaaacattcaatataaattttcacataccaccattaactacagatgtggggaatcaggcactttcatacagaataaattggtacaagcttttagcagccatttacaataattcatcaaatggtaaaatgtatgtaacctttgaaccattgattctacttctagcaaattccctattaaaaagtattcccacaagattacatgtgagagtgttgaatgtagcattgtttattaaagtctgaccaaagcaaacaaaaatcatttagtgttcaggactagaggagtgaatggctatattatggtgattatggtgtagctgaataatagaataatgtgtagccattgagagaaaagaggtagtgacatatataatgatatggacagatgactgacatattaacataagcgaaaagcagaatataccacattagatgtttatgtatatcattctttgtttttaaagcattatgcagttgttatatactctgcatgaggagggagggcatggtggagaatgcagaggctgtatacaaacatctctcttactccttcctcaaagaaagcatgtgcataaactccaaaatagccatgaaaatactgtaactgaaaacatttctgaacatatctgaagaaaatgttcaaagcatttgataaccttaggtaatggaagacagtggggtgctgtttgcagtgtaaaaataaaaaaaaaatagtttcttatttgcaaaacttgactaaagtcaatgttaagaagctcagagaaagcctcaggaaaaggagataaaaacaaaagataaaataaaggcagagataaagataacataaggataagaaggagaactttttaagaggaactcagctgaaagtaaatggagtgaaaaggagaaagaaagaagtaagtcgagtaaaaagtacacagcaggtgggccaggcttggtggctcatgcctgtaatcccagcactttgggaggctgaggtgggcagatcatgaggtcaggggatcgagaccagcctggtcaaaatggtgaaaccccgtatctactaaataacaaaaattagctgggtgtggtggcatgtgcctgtaatcccagctactcaggaggctgaggtgggagaagaatcatttcaacccgggaggtggaggttgcagtgagccgagatggtgccactgcactccatcctggcgacagagcgagactccatctcaaaacaaacaaacaaacaaacaaaaaaacaaaaaagtatacagcattcaaaagtgaccacattaaagaacgaatggatagaatggagaaaagacagacagattaatgtttctattgttttaatataacagtaatactcattaagtaacactaaagtactccgaagacacacaatactctgttgtactttgaaagcatcatgattacactaatgactactctaatggctggtattcacaaccatgccctactttgtctaaatatgtcatacctacacaatattaggttaaaataattaggttttgtagggcagataaattgctactgtatatttctagataatgattacaaataaaaactgccagattttggtacataaaaggatttgccattatctgcctaaaacagacccctgatgattaaatatgatcaccctgtttgtgttacctatcccatggacacacagacacacacacacatcacatgtagtttctactgggaatacagagggagggaggagccttctgattctgagaagttaagtggggattccacactcctcttcataatcctttcattatatcagtatacattcagcctagacacaacaattgacttacagcatggcaaatagaagacatctcatctaatatttagtatttaaggtccaattaacaggttgtgtatattgcaacatgaggtcggcagtagattgacaaatattcttgttgtgaaatctattctgttgtaggtttaaaggtttagaacatggaataccacatttcaagtttttagaaaaataaacgaagagccccagacatcagatagttaatttttcagggttcttaaactgtccaaattcttatatttaaggtttcatttagtaaggaaggaggttgtaattgtttctatgcataagcttgattttcccttagtggatagaaattgacttgaaaattgaacaattttctttgtggaatttttagaaaatagtattcatcacaaaaacaaaagacaaatggataatgagattgaaagagttgtataatataatctatttgttttaccccaattagcatgcttatttgtagaaaattatgtttggcttccatagagtctgtatggatctgtgctgaagttgcgaacatttgcctcaagcccagatctctagtatcacagacttacttattacaagaattcacacagaaaacaaaatactatatacttacttaatgtgtttccactccccttttcccctttctggccttttggtccagaatttccttgagaaaagaagaaaaatatttgtttttaatcagggcaattcacaatgtttgctttaactggagacagatcatcacaaggtaattaaaatataatagaatggacagatattgaaatgtataataacattgtataatgttaacaataataatagttattacttaggaagctccattctgaactcaatattgtgatatttcaaattatttacaaggccctaaatgccccattttcctaaatcaagcaaagctgaagaataaggagtttgttttgtacttatttatcctccttttctcctcttcctttgactgggtcttactcacacccccaggaagtccagtgccttccatgagctcccacatcccgttcttatattcacattacatttatggttttcatttctttagagtgtaccatccccaaaaactgggctgccaatgactttctgggagtgttgagattcttactcatggggaaggtaggaagatccttggagcgttcacatctccaggatgatcacctttggttttgagaaacctcacccatttatacaggggtgtggtacaaatatttcatatgagggtcagggcttcaaatggatgcagaaacattgctagatctttttttttgccaacggattgctacttcacccactgtcccatttttaaaggggtgtgcaggagatctttctttagtaccaagaaatctcttaagattggtgctgttcctgcttattgagttttttttccaacagccatgagatacaatcagatcttcaagtaattactaccttgacataaatctagaactgatcctagtgctctctgtctcaaagtcaaaacctttgttaatgtttttgattccctccagcaaaactgagaaccttcaaccttttcatcctagagctcagaggatgtagtttaacaaccatagacttcaaaataataatagtaataatttagaaacccctgtgttgagttattttgctctgctacttactgggtatgtgacttgggacaagtctttaaatctttctgagctaaagtttattcttctataaaataaaaaaataacgcttttcattgtagagttgcctgttcattaagcactttgcccataaaagatacacataaaagatctagttcttcttattcctattcttcacctcctaaagcttagctggaatcttctctttgtgattttattctcagagaatgagagaaaaactttttcatcgcagttcattttatatggtacaattatatataattttagtgtttatatttatttttgatttctctagtttacattgtcttcatctgtgctttattttgaacatgtgtcattatgtatttcttagagaagattttggatcctaatttaccagctaaaaaaatacatatatataatgtaacatatacaatcagtagcatgagacttgaggcacttaaagagtaaacattattcccaattgaaattgtattttgaagatttaatgaaatgccaaccattttatatcaggtcataatatcaaatttctaattctctaattgctttgcataatgtgattatactttatatcattaaattcatttcttaattgtaattgagttgtttcaggtactgctaaattggcaaaaattgttgctaccacaaagcacccaaaacctttcctatattttgagagcatgctttaataaaatatagtgccaaattttcagattgtccaagaggaaaaagctctaagaaattgttaaaaattagggaagggaggagttaaaacaaagttctaactcttttcataaaagagaacataataagcaagcttaatttcattatttcaacattaacttcacaatgagaaaagagaaagaaactatgcattgttcttagaagtcttttcacacagcaacttgtcttagatatttcagaatagacatgcttaagccagagacatgcttgacccacgaaaggtccttgtagctctcagattctatgataaataaaaaattagtttcatgtttttattttgcctttgttcttataccactgtgacttttccttttaaagatggtaaaataaaatgccttatctccttataaaaaaacaaacaaatgttttgtatcattttaacatgattcagagatttgcttaccgatgatacttgaaaatcttttctcacacttgaaaacagcaaaaatatcctttctaatggagaggaatgtagtggtccttcagaatgatacctttggttaaaaatgaatgcaagggcttggtccaaacctagagttaactatctcctatcctatgtattactctttaataaaaagtaacttatatttctaaaagccattcaaaagtaagaaccaggtcatatgtaggaggatattctaacttgaaaggatgtaagagggggtgtcttcaataacatcatcatgatttcaagcattttttgtgagcctcttatatgagccggatactaggttagacatttctgcttacatgccttaattacactaaccaaatttctgcagctgtaggccgcctttccatcccccgtttctttcaagctactttcaaatgtgatcatcctctctcctaagccttgtgcttcttcctggtccctgaattcctcaccttataaccactcattaaccttacactatcttttttgctttgctttcctctgtcttcagccactcctcctctattttatctttccataagcatttaagtggtactcagatccttccttcaaagaaaaaaaaaaccatatgaaacaaacaaaactaacaaaaaatgcatctcttcctcctcctctgcatagtgaggcagcttgagagttgagtctaccacatctccaacccttatcaaccattcccttctccgcataccctaatctggttatcaccccaccccacagaatctgctctgaacaatggcaacatccccacagcagcaggtgcaaagggctttttgtagacttcaccttacttgaccacctttgaaactctgtgtttgccttttttcatgctctgttctctgggttttcttcttcagttgggctacttctcttccatttgctactttgttcatctcagcctgtacttctggaactacttaaagctttatgctatgccccttctctttgtacctttccactctctacccataaaatattattaaaatcagtggttctgaataatatttatataatcatagataaactttgtcttttaatctctggcctctactcgaaacttcagactcatgtgttcaaccgtctgtagatagctccatgaatcacagagagaaaatgttcagtaaacgtgttgaattaataaatgaactacatatggtgtaatattttagataatcctgaaaatgaccataacttaccctgagggaaacaataagtctttgaatggacttcaagaggcaaaacagacagaagtacgttatttgcatgctgaaagttctactatgttgaacaaggtagaacagaaccttctacggattttgaagacgggcaaggtttcacatcaattaaatcctccaaactttctgaagtaaatatatcaggtcttataaatggactactctatagatctgctatgcatggagaaagtgtgaagtcttctctttctcttctcatgtttgtgtatcttttcagttgtagactgtcttattcacccttcatttccctgtttctagcactgtacccttacgagcagtgtgtacttaatccatgtagaaggaaagggcaaggtgagaagaaaaggagtgtgggagggagaatagaagaaaatagatggaggatgttctttttgaactttttgcttcagaatctgataatgtttttgatatcattcacatagtccaggctgtgaaaaaattacaactcaagcaatgtaaagtatcaaagagtgtttatatcacaaattggggtcttagctctgaaatatattactttatctatcacggacctgtttttacttatttcatatttgacaattatcggacttatttctaattttagcaccttcttcagactcttgtagaggagagactgtactgttccttcttttagtctgcagtacaactagaacagcacctggcactgctgctgacatctctaccagattggtgtcttttaataagaagtgatgtcctaaggatatgttttgtcaagggacttattacctctgccgttgtttttctttgtgcgtgattactctttctgcactgtttttttccacctaaacataatggttttcaaaatgtggtccctggaccaatagcatcaccgtcacctggacattggtgaggatgcaagcccaatcccagacctactgcatcagaaactctggggtggagtcctgtaagctgttttaacacatcctcctggtgattccaacacctacaatagttttagaaatacaaacctaaagaaattctaggcctcttttagtccagcgctaacaaacactactttctatctaacacattttcttacagtatggaattaatcactccttactctctacttccatacagcaatttgtccaacctcaccaaggttgtttacttaccacatggcattatagctaattgcttatgcattttttttctgtatccagctccttaagaaaagcagctgtgctgtatttatctccagcacacagtgacccctcatcaagttgtgtgaactgggtgaatgaatgaaataatactctccaaagctaaacataggtttaccatttgatccaacaatcacactcttaggtaaactcctgtccacagaaaagccagcacattaatgtttatagctgctttacgtagaatttctaaaacttttttttttgagtcagggtctcactgttacccaggctggagtgcagtggcatgatcttggttcattgcaacctctgcctcctgggttcaagtgatcctcccacctcagcctcctgaataggatgccaccatgcctggctaatttttgtatcttttggtagagacacggtttcaccaggttggccaggctggtcttgaactgatgacctcaagtgatccgcccacctcagtgatctgcctgccttggcctccaaaagtgctacgattacaggtgtgagccaccacgcccagcctaaaactttgaagcaaccaaagcgtccttcagtagttgaatggataaacaaattgtggtaaatccataaaatggaatactattgagtaataaaaagaaatgagcaatcagaccatggaaagatatagagaaaccttacattcatattgctaagtgaaagaagccagtctgacaaggccacatactgtctgactccaactatatgacattctggaaaaggcaaaactatggagtcagtaaaaagatcagcagctgccaagagattgtggtggggaggaatagagttggtggagcacaggggacctttagggcagtgaaactattctgtctaatactgtaatgatggatacatgacattatacatctgctgaaacacataaaatgtacaacagaaagagtggccactaatgtacattatagattttgggtaataatatgtcagtgttggtttattaatggttacatatataccacactaatgcaagatgttaatagtagaggagaccatgtgtgcatgggtggtttatgggaactctctatgctttctgtgcagtttttctataaatgtaaaactgttctaaaaataaaatgtagtttaaaaatacctcaatgatagggaccctattccttttttttctttttcttatttttttagagacagggcctcactatgttgctcaggctcgtctcaaactcctgagctaagcaatcctcccacctcagcgtctcaaatagctgggactacaggtactcacctctgcacttggcccgactctattctcttgatgataattcactttgaaatgaggagacagtaagcctagctctttctaagattgctgttcaaagtttgcaatttaagcttaggctactggcagagctgatggaaataatatcatcatgtgtgtacatttcaaaatgctgagcaaccttgattcttaagcactagtagataatggcagacaatttattttgcagaggataggatttcagacttctctgtattttgctaacagtaacttcacaaagtctggccagttgtggttaaacgggtatttacactttgcttctttttttttctttgccagtctttcaactctctttgttcaaagacggatatcattgttagtgatgatttatgattgtgaggagtttataactcctgtgtgtttttttaaacgattttcctttgggatatagagactttcctcgggtgaacagaagtcagtttcaaaaatctgatttcagaaatcatttctagaccacaaaataactgcatgtgaatactagtattcacacaatgaccactttttatcatccaagaatttaaaaatatgtatactacatatataacattatgtgtgtgtgtatgtgtgtgtgtgtatatatatatatatatatatatatatatataaaattatctggtgtttcttctacatattctataaagaaaatacacattattgtaatacctggccttccggcatatcctgggagtcctcgacttccaggaaagccaattgctccccgatcacctttaagacccggaggacctacattattaacgaagaaaaaaagaaggtaataattcattttcatacagacttgagagtataatgaaaacatctagttttataagtgaatatgaaattagagaatcttcaaatgaaggaataatatctttcctaaaatttaatgtttgacattgaaaaacaatagaagcgataaatataaaccttagtacattcagcacattgtagctattcaataaataacatattgttggtagaaataaaagcacattaggaaaaatagatcttggagttttaaccaaaagacttatgtagtcaaccagtaatcatcaaatggcaggatcttgctgtagctgaaataataactttaaaatgcataagctgaaaattgaattcttaagatttgccttagaaaaaaatgcaactcaagcaatgtaaagtatcaacgagtgttttataaaataaattggtgtcttggctctgaaatatattactttatctatcatggacctgttcttacatatttcattgtaatcccagggtaaataaacataaacataaacacacacacacacacacacacacacacacacacatgcgatacacagatttacttatgagtatgtactatatacttacacaaatccagggtttcatatgcttaaatgaaaactgaaaatggctattttttttacccaatattactatggtgatcataacaactgtatataaaagaaaatgttatattccagtgaaataaaatattttatcctagagttcagtagttcttgataaactattgtaacagtttaggcatcttattttgtcattatcaattcagagagaactcgttcacccagtctcacttgatcccatggcagagaatgccatgttgcctgctttagacaggagcatcttggggccataagagcatcagagaagcccctccaatgctgacttctcaagtacctcacagtgatgctcagaacacagctgttcaactaaaaatcaaggatgttcaactacaaatcaagtacattttcaatgaatgaacaaataactctgtaaatgaagcatatgagatactttcatagaaatcaggcagtcatagacctctgttcttggagatggttaagcagactctatatggcctatggagttatgtgacttgtttgtttaatgatggttcaaaatgtagtccccaaaatgtaagcacagctgttgaactttattccataagatcagataccctgaggctttcaggaggcaattaactaattttctacaataatctgtggcaatgggaaagggtctggcacctgcttctaactcatggacaatataagtacagttacatggaatctcagccatgggatgttcaaagagacgttagacatcatcaagtcagaatccatcattttagagacagttccatgagaccagagtgatcaaatcacttacataaagctggtctgataattattcacatgtcctaggtgtcctgctccattcaggctccttcctgcaaagtagcagactggttaagggcatggactctgcactcatgcccattggggttcaaataccagctttgccacttaccagttgctgattgacctcaagcaagtcatttaactttactgtgcattgcacctgtaaaatgggtgtattatttgtttctgcatcatcaggctgatgtgatagttaaaagagctcatacacgtaaaacacttagaaaagtgcctggcatgtaatgactactttgtaaatgttagcttttcttgttctcctccccctcttcctcatcctcctcctcagtaatacaatcattatttttaccagcctgttgtaaaggcttctaaatttagttttattaaatgatacgtacacagttagcagtgacattttttgattcactggcacaatttgttacttccagaaaaaacccactttcaatactcaggtgtagagcgacagcctgcagccaggcaacattccttactcaggtgtatatttaaggatcctgtccttgctgaagctttagggaggggccttcttggggccatagcctatgggaaggggcgggccagggtaaagatatacgtggatataaacattaataaaatatggttcctctcttccaatatctatgggtaagatgagctttattttctcttctggaagcacgattcctatggtggaaaattcagactacgtaaggaagtaaatagtactggttgatgatgaaaagtttgcagccagagaagccttcagttctctcgagggcatctcatgtaggtagccccacccatgcctacaggtcaaactaccttgttattgatcacattgggcataaacagcttcttagatggcccacacaaagtttcctttagaaaagaaagttgcttctccttcaaaacattgttgtcatgggtaaaatcagccccttaaaagaaactcacatgagataaaaaatccttgatcatgacatttgcctcccttatattactacttatcatcctggaagcgctgtgaattcagagattctgtatctgtttacacatactctatagggtattgtagaacaccaggcctggagaaagtgctcagcacatagtttttgagtgaaaagtgataggtcattctccctagcatgctttcaaggaaatagccctctaaaataaatttgttattatttggggaataaagcatatttaaacataatatccaccctagtatatgaataataattctactatatttaatgtattagttatttgaggctactaggacaaccacttaggttttgcagatattcgcatcatgattgtgagtctaggtgagtttgacttggtcaagctgagtttagtaggctcaaatggatgtagagatggggaagcaataaacctgctcagattagaaagcagaattagtatgattgtccatcatatactctttgcttcctgatttcggcatcaaatataaggcaattagacaatctggtggagaaacgaacagaatgcagcaagacatccagaaataattcattaggaaagatgcctggtattttgaatacttttcttgtagtgcaccaaacaaaatggtaacctgataacctagaagagtcattgattaccccaggaactcgacctgtcttttatgaggaactgggtaatgcctatttgtgtaaatgagcagtaccaaaagcaacaaattatgacatcactttttaccctgtaaatttaaaccatgacaaatcgttaatttacaataaaaaaaaaacaaaatcaaagattctttgcaatggtgtctatttataacattaacacaagctgaaatttataaatccttctatttcatacattcacagttcagaaacagctgcagaagattctcccaagatgaagcactgtatggcaagatgtagcccagactgaatttttatggttgagttataaagctctgacaattgcagcctgtatggagggggtgatagacccttgacaatggtagttctggcagcagatttaatactggttatttcctctgcttatgacattaatgcagcattgttaatatctgattagcattagtcaagtagaaagactttcctgaataaaaattctttcctggcaaggcattcaaaagcacatcaatactaataccacctgacttggcatattatatatatgggtaggattgctattttatatatataaaacatgtgtacctggatgtatatcatctatcttcacatataatatgccatatatatttatatacatatatatacatatatgtgcttaggcaggtatcaagttcatgcttctcattttcaaaaatttttctgatgtgaccagggctagtcaatacactgatcagaaagaagaaccttttatataatcaaaagacagaaaaataagatgaagtacatggtatttagacatgttttggtaacacaaaccattctacttataattagaccttgcagtatacttcctaccatcaaacggcatgcaggatatttgatttcaagccaaggctaacatgacaatcatgttattatcttttttattttttcaagcaaagaaagttcatgttctctcttctgtgtcttctttcaaaatatttctttcaagattacaacttagaggaaaataatttgaaacagttttgctcttagtaaagcacagagagtgactgtcagcaaggtaagtgtcatccatattttagccaatatttacattcagatttcattagtttaaacagatatattccaaatactatataagaaatatagtccaatttgcttgtgattcataactcactactagtgtgagtttttatgtcttaaaaatgagatagcttgcaaatgtgaagatgatttattcaacgcaaagataattgttgtactccccttcacatatgatctacggttaggtctgccttatactgtttgctgtctattatatacatgtcactatctagacttacaaacaattccatttggttactctggttaaagcatttattttcttcaacagtcatgagtaatgcttatcattcagtgtattatgtgattaggctactagaacatttactaatcccccaaaacacacacacatatacacacatgtgcgtgcatacacacacacacacacatacacatcctctgcaggatataaataaaatagcaatcctcccctacacatgtacctggatgtatatcatctatcttcacagtatatgattaaatagctaaaattaccatacctattggacctggaaatcctcgtggaccactttctccagtgggacctcgatctcctttttcacccgggggtccaggaggacctttaaaaaaattacagttactgatcatagttgtaaagcataggaaaaatgggttagtcatctgtcaaggtacttatataaggaaatccaaagtcttctatttgttgtgcaataatatagaatgtataatactgaacttcatgaatggaggagtattctgctattcaggaatataatgccctatactaatgaggatgacattgcctcaaagtaaacaacctaacagtatattaaatgtgagtgtgcctaacacttttctatgttctgagaacctgggggcagagaaaagacagcaggctggcacaaagtcacattagtgttgtacgcatcctaggcagttagacatagagttagatataatacagaattagctactatacggaaaatctataagtaagaacttaaaagacatttgtgataccctcaagggaaaggaaaattcacacatggtagacaaccagaaagcactttgttggaactgaccataaactcagatatttgtcagtgaactgtagatcggcgtgaatggtgatggttgaagtcttcattgagaaagtaggatatgaggggtactttcaagaatgaagggaaggggaaggaagacaattcctagggattgagaaaggcatgaggaaaggcaggaaggtgaaaatgagtagaggaattcttttttcaagtaaaatattaagtagaatttctaggttgctataaatactgtaaacaaaatggagacattgcaaggaaaactttggtctcatcattttttttcaggtggctctcctgagagctgtaactaaacaaccctgatttagccatttgtattttctgtgtccagcaaaacagatacctgctcatcatgcctttaaaatgattatacctagcatgtctttagaactcaaaggtaatcctacctaaacaccatgttccatatggagtacagaggacaaataatctcttctttatctaaagaagagcacttagtttccttttcaacaccagaagaaagaaacagaaagaaacattattccatagattcaccacagaataaggaaatagtgatattttaaaggaagcattttcaattgctagtttggacacatacatagtccaaggaaaacaaatatatacagcatccctggttagaatgcacttgtttacaaattttaatcaggtgggagacataatacccgaagaaatctaagagggggaaccacataaataaataaagattatctcatgaataagtatattttgtacattttgttgttgcttattttgacatccttgactctacttctgtctattcctctggtatgtcccattttcaaggtacaatttgggttttagaggcccaagatatcattattactcttctcaatagaatgtccctttctcctcatatgcaacattggacacacatttaattgtatttttattataaaagcaactctacttataggaaacataaaagcctagaaaaagcgtgaggaagaatataattcgtagttgtgttattttaactaaagatctttaccatttctttcctaagtgtgtacgtgtattttttttttccacataatcgtcatgcaaacaacatgttacagggcttttagaaattaactggtgtattatattctaaggtatagcttaattgctgcgagacatatatttaaatgctgcacaagaaatgtaagatttctgtatcaaagggaatctctatgtgccccctattccctgcagaagaatgtagtacttcccaagaaaatggagttatggtaacttccataaccatgaacgcagctgcatccattcaacactacatagcaatgaatcccaggggaggggggcaagcaggacagacactcaatttatgcctgaattttgttgagctaattgaagggaagcacagggatagtaatcaaggatggtattttgaaaaaagtgcgcaagcaaagatttcagtttagtaactcaggatccaaagcaagacgcagacattccaggaaaaactagaacatgaaacaagaagaaacaagggacacagagaatagatctagactcttagcctctgagatggacttctcaccatttctttggtaagtaagagatggaaggaactctcctaattactaactatcctttcaattatattacatgtaattatgggaactgtatacttaattttggagtattagttcaatcacagcgaatagatcagtattattttacaaaatttggagttaaagatccctctctgtatttttatataaaaatactgatacctggtattcgaatcctacaataagaaaaacaggtaaagatttttgttagagttctaactaggcatgttgaatgtacctttttattgtcattctattcttcatgtaacattaatctcacattatgtttcatttttgtacattgttatagatcttttactgtttctaacaaaatgttggaaggatctcaataaatgttttaagtgtcttttagattcattgggggaataaaataacaaattatataccactttactcttagtttctgatgcagaacttttaagaacactatccactaccttgccaccttccaaaactagcctcctctccattcccattgtagctcacgtcttcaccatcacacagctggactattgctagagatttttaatctagtctgaatgtgttttatctgtttcacctcctagttccctcagtgttggctttcttcttctttttgataagaatccgttttgcaatgtctctatcaaattaaggaaatgcagtaacctattctgtcatattatggaaaaaagaataaagacttagagtctcttgtagtcaccttttgttcgtagtttccatttagtcttttcaaaattttgttccatactgacataataactgcctcgttgcatcaataaatggacaaaatgctacctgtcagctcccttgctgatacatgtcaaaaaaaatgggttaatattggccaaaatatatgatttattctagttcaagaagccatagaatttacattatttttcatctttaatatttccaattacagttacaggaataattcataaatactatcacaataatctgccatgaagaattacctttatacaacacatgcacaaaatctactatgtagcttcctccatgattacttcttaaaaaggaaaagtaatatttctatataaccacaaaaaagtactgatatataatatttgataatcatcaatatcatagaacaaaattacacaatttactagaaaaacaaacccaggtgtatcatatcatttaaaatcctcagacgataacatagcactaataatatctgactaagtttccagagcgatgcttctctagtttttattcattatgagcattaatcttctactccgttttcaatcttgtctcatattcagatcatcataaaaatctgccacatcttctagtctattgctgcctaaacctgcttcttttttttttctctagttttcatgctcattgatttagatatgtttaatctggaagacactttaaacattgtttaactaaacatatttatagagggtcagagagtgagttgctcaaggtcttaaagctagttgggttaaatcagaactagaagaatttcatttctttcctgatcctatgctaccatgttctaaatttaattgacttcattttccacatctgttcttccattattcctcagctgaatttttcctttacatagtggttagacaaactcacaattcagtttttttcctttggttaatttttttttttttttttttttcagagatagggtcttgctactttgcctaggctggtcttgaacttctgggctcaaaaggccctcatgtctcactctcctgaagtgctggaattatattgtctcagcctcccaaagcgctgggattacaggcatgagccaccacttctagcctacagtccagctgttacaatctcagtaattaattatacaaaactccaaattcaaatgccctcagttgctttttcattttctctactataaaaatcaatatttcttttttggtgctttcatatcctaggaagccaatatatctaaaatgtttccaaataaacaaaatgttagctattctcaccacagagtcatattatattttatttctcttaaatacctttctctagagttcatctttgcttctttaaatcacgttatccccaactctccaccaaactctacttcaccatttccacaatgaaattttatgtagttctttaaggctctaattattataactatttgagaaatgtattaaaaaatctttgtctcttttaactgtataattatttagtgattattaatataagggaaaagagaacacaaagtaattacactaactctgcaatcaacacatgataaaggataaagcactcattaatttctaaaatatggttcttaagttataatttaattaatagatattttatggctaggtgctataagagatataaagaacagtttctaatggaagtagcttgtgtccaggaagagtgaacactgttctcgaagagaatatgagatacttttatacataactatcacattaagtattctcttgtgagagaatacttaatgttccatattaagacagaaataagtatcagctgggccttactattggtagaaccagcaaaggcttcatgcaagaggtggcatcttagatggactttgaatgataaacaagatatcttcgaatacaaatcaaagagaaaatatttcaaataaaggaaaagacatgaggcaggatgcacaaagtactgggtacattagaatcacagtcaaattagttgaaatatttgatatacaaaaaagacaagcgagggaatgaagcattcaagactagttaagagacacactgaaaaagaccttgagtgctacaggcaaaactgtatgtctaatgacggggcaacagagagtctttatgcaatctaagacttcctttaggaaggctgtattctacaagggtgcaaaaaggattacagtctgggcaggaaacaattgcaactctggcaaagagtcataagaataatttatacgaggatataaagaaatgacaaaggaacagagaatacagaatgttgagaactaatggtggtcttgggagatataaaataattaaaattgatagcttggaaaccaggaagaatgacactgctattatagagtgtaacttgctaagacaaaagtcttagtttcacttattcactcaacacatatgtaattgctcacccactattttccaggcactctaacaggcattgggattgcagaggtagacaaggaggagaagacttaacctcacagagctcacattctgctggagaagatacaagctaaacaagtaagcaaatgtagagatgacatgatttcatatagtggtaaaaactatgaggaaattaaagcaaatcatggtagagagagatgggggagtttagaataagaatggtggaaagtggaggaggtaacttcaagtggagccaagaaggagtagagacgtagagaagaacctttcaagagaaagagaaaatgtctagtgttcattatggacagcatgaaatgaaacaagcactttttctatattaacttttacttgttcgtggcacttcattcttccacatttccaagctaggcagaaggatgacagagggaagattgagaaaattagggcagagaagtagacaggtgacagaccaagtagaagtttagattttatcccaagactaatgagaagacattggaggatttaagcaagagagagaaaagacacatctagtgtaaagagagaaaccacacacatccagtaatttgtgtgggttttcttaaatagcatttttttttttttttttttgctatttagaatggactaagagcagagccagggacaccaactgagaagcggatgtaatacaccagactgggatatggttgcttgaattagagtagtagtagagagtaagaagaagtttggtttgagatattgtatgaaataagaattagtaggacttacaaatggattacatagagaatgagagcaaggaagtcaaagacagcttccaagatcaggcagtgagcaggtagttggaaaatgacaaaaccaacaaaaagactgaaaacgcaacagatttggggaggcagatgcgggtggctagttaagaagcaaggatttggttttgaatttgtaaagcttcggacatttatttgaaatccaaagtggaggtatctaactgttagagaaaaatctgattaattcaaatttttctttatcatctgttttattgtgataaatactatatatgatatgtgttctgtataagcaagctataaagtacaacaataatgagaatacccttgcaacatcacaatccaagaaatcggtatctacctagatgttcccctatctcattcatctatttccttttcatagataaatattaccctgaattttgtgtttatcattttcttaaattttaaaacaatgattatattacatatttatgtgtctgtaaatttacataattttactaactatgagcattagaagtaaaaattgtctatatatagttttctgggacttgtttttattctttttttcattgtcatcacttgattattaggcttcttaattttctcaaactagtgtatttgaaatgaagtcacatgaagttcttagttctatttttctagttgctaatgatataaaatgagacaaaatattaaaatcatgaaatagagcttaacagacatggaagctggaatgagaacatccaatatgaatttcatgtaagttacagaggaaaggagagaaagaatcgtgaagaagcaatagtcaaagtgaatgaagctggttatattcccaaactgatagacataaatccactaatataagaagtacagcaaatgttagatggataaattatcaatacaaaaccacagataagtaaaactgcagatatgaaagacaaagagaatgacaaacagattggtggcagtcattttaagagccacaagaaaagcttgaagccaggggaccaattttttcagcacactgatagaaggaatcaaaataactgtcaacctaataagtgtgtatatagtaaaacaatttcaaagatcaagtcaaaatagagaaaatgaaatcagaaggtttcttgatcaatttactttcactaaatgaacttccaaaagatatacttcaggcagaaggaaaataatcccagaagaaatgcccgaggtgcttttagaacggagaacaattggtaaattcatgcgcaaatttaaataaatatttgttgtgggtgagcgatgactatctgagccagtggtgcagggttaaataatttaccaagatggttgtagataaagaaaggcagatttattaacaaaagcaggaaaatacgttgcaaggaggcaatgagcaggccagcagaagagaaactgattgccaggaaacaaaggtttgctgaagattttatagaatagtgtttataacgtatgctgaagagagcttgtgcagtactgataaaccaaggttagagtgggttaacttgcaggtatctggtgacaagtttcttgcaggagggacctacatgttctggaccaagaagaaaggcagatttatagcttatcttctttctctttgctttccctggtcctaccagcctgactacttttccctaattaaggctccacaagattgtctgtataaaaaaagaaaaataatattgactaagttctcgattaaaaaaaaataaagtagaataaactgtactaaaatattagcaggaaactagggaagaggatcatcaaagcactttcagttccttgtgtattttaggatgaatgttaagatactgatcaactttagacttcaagataaatgttaaggtcaacaatcaataagaaatagaaatatactacaaagtttctgaaacctgtttggtaattttggtagagagaaaaattcagcaagagaaaaatcttaatcaatccaaaagtggcaatacagcaaagcaaaagaaacataaaataaactggaaaaaaccagagcacatgataagatagtggaaataaatacagtgcaaagagatggtcagattgtatatttttttaaaagaaaaggtaagtattcattacaagagactaacctaaaacaaagaataccaacaggcaaaaggttgcaatcaaaatatagaaaaatacatgcaaatggttgaaatcaaaatatagaaaatcaaaatcaaaatatagaaatcaaaaaatcaaaatatagaaaaaatctataatgtaaagctaaaactaaaatatctaaaatgtaaagctaaaactgaaagcctatatatataaagaaagcatatatacatatattttatttatatatataagtaagatccaattcaccttatttcactaacaggcactgcagaagaaatggacaaatccatcattattttggagagttcaaaagatccttttaattaataatacagtcaagtaagaaataaaaaagactggaagttttggaaaagcaatattaacaagcttggtttgtgaacatgtgaagaaacttgtaattacaaaaaacttgtattcagtacttatgaggtagtttttaacaatgagaaaatcattagaccttaagatatattttgcttttccctttctatttaagtgataccaggctactggttatcgtaccctgtctttatctgattttcatattctttcctttgggtatttgcagtaaatgtaagctcagaaactatttatttcaaaccataggatttcaaatatcaaatctctgcatgtatcagtatattttaatatatatatcattttctggagaaatgacaagacattttaccttgaattaaagtgatatttctcaaggtctgagaatgttcccaatctttcagtctgagatcattagtgatgttattcagtactttcacttctccttttatttcctgttccaaatgcacttgttcttctttcatagccataatttctgctgatacattgtaaacacgctcctctaatttactgatttcctgtaaaacataagtgagcattcacagcctttgttacatacataattatcaaatatgaaagttcaagaaaccctcggagttcaggtttttaaaaacatattatgggagttttatggaataagaatatagaaattagaaaactgttttgaaagtagtaattctttaattgtgaaacatttcctcttttgactgaatggctgaatgtttacaatcacaacccccttcaaaaatcaatttaatgtatctatgatatgtttctattcctatatatatagatgtcaaaattctaacaataaaattaaataaacaccataaggtcttaatttatctgaagtaaaatgtcttcgtactgtacttacagtggcaacatagtcaaatttcgtgaatttgatagatttatattggaaattgttttatagtaataagtgaagtttaatgtcataatcctcagtggtgatgatcattgacaatagattttcatactcaataaaacctcgaactcgcatattaacagtgctttactttcagtttgcattgcctctgtatttgaggcattagtattttgtgttttcaaatacacgtatattttgtgtatatttatacatacacattcatatacttaagagtgtgaaaaagacagaggatctacctatatcctggaatatgcttttatattttactcaataatatattaaggatatttatctattaaaatactttagagactgatattttcagtaatttagtggaattgaatctatttctcaaaatttatttaggattcctattcatagtgttttgagctgtgcacttttctacaactaaacaatgctgccatgaacatcattttaaatatatttgtatattgatataagtacttctatagaacatcttcctgaagtggatttgaccaaagggactaaacattaaacagcatttttgttcaaccattgccgtactactctccaaatatatgctaccatttttcttcctcttactgcgtatcagcgtccactttttgcagctgaatactgggtaccattaatatatttaagtttgcatagtaagagtaggtacatagcaaatcattattacttaacttgtttttcaaattatagtgaggttaaagtatccagtcattaaatttctgacgattaatgtttattaatttttcttttagatcatttgcttggttttctctttcagcattgggctttttatttttgatgaaccaaatgttctcatctattctggtaataatttttgtctctctgttctacttttatcccattttctgtcttcattgtatgctttattattgtattaagtactcctatgttctaaagttgatagatactcatttccgatttgcacatggggaaataagccagtggtatgtttttctttaatccagaagtaaaaagaatattacactctcttgagctggactagactagacaagcttaggtgagaggatcaagatggtcagagtgtaggaccttcgaaaataaatgaatgtgcgtctagatttgcctcttcaatgacactatactgaagcagagagacttaccagcttttattgctctaactgtgccttctcccaaacaaaaccttattctagattagaatttctctatcttgcacctcctcctcccctgaccatttaatattttctgtacaataccatcattacaataaaggtgaaatagtgagcatggatgtttgtagggcacaccgccatgataaatacacttgacttaatttagggggctaaaaattgctgcaagtatgtcggg

SEQ ID NO: 868 - DNA, 82785 bp, Homo sapiens
aatgccaagcactaaaaacagaaataaaagacaaaacacaaaatctgcagcaaccaacacaaccaacaacaatccatctccctcagtatttgcagattgtttctgagcctgggcacgccgttaacacttagccagatttgcactaatcctagagatcagcccaaggtgaaagtttaggttcttttcaaggcatgtgtttcgccctgagcatgcatgcggctttctaaacttccctgcattcatttttttaaacaccctaatttcccaaagaaactgtcttcagtttttgctaccaggccttatgctctctacttcatgtttcaactataatgttgtgacccatgcatttgagggttgttatttcagctaacagtgtttttgaacaacggccactgctttaccaacctgaattcaaaattaagtgaaacagagttgaatgctttgcatcagtccttcagggaatttcttagacagattaaaacagacaaacacaactgtttgtgaggaaggtcatctctgcttcccatggaaccagggcccaagggcccaagctacgaatgtagactgcctaccactacctcaagacaaaaaaaaaaaaaaaaaaaaaacattgctgcatccaggaggaggtagggggaaggcaggtaaaaatatcacaaactttactgttgtttcaaagttgcctttttcttgactcaacatttgcttagttgctgtaaaattctgaattttttcagagtcctgaaaaagttgattctgacagtttctatttattttttgatatttctctaaaagaatgaattcatgaagctgcctactccaccattttgttaatattgctctttgtttttgtttgtttgtttaagtaaatgtactcaataataacatatacataagttcttgttaagatattaacattttaaaaacataaattctaagagttttaaatataaattactctgcaaaggaaaatagctgataaataacagaaaggaatacatatttcagtatgttatgtaaccagaagattggtgtggttaaagaaaaacattttaaaatgtattacctaccattcaataaagaaaaagtgcaaagaaaatgcatagttgaaaaaaatcaggctatattatggttttatgtgtgattaaaagccaaaaccacatctagtgccaaacacatgttcctaaaattcctatatactgtctcaatgaattaaaaaaatctcaacgtaatcatctcctaattgtgcttttctgagggaacattgttaattgtctacctgacaaacattgactttttcctcctctctgccataatcttgattttatttagttaacatgagatcttgagcttcaccagccttgagcttctccaactccggagagtaaataatgcttaccattgtaacccagtgatggtaaatttgtatctcttgagtgtgattgctttggacatacatatcactgccatactgatcaaacaaatgactgagggtagaaatatttcattttacccttcatagcaaatattattacagtcaacccttaaacaatatgtgtttgaactgtgcactgttccacttatacatggatcttccacctctacgattcctgagacagcaaatccaactccccctctttctccttctcagactactcaatatgaaaacaacaatgaaggatgaagacatttatgatggttcacttccacttgattaatagtaaatatatttctcttccttatgatttaattaaagttttctttcctctagtttatttttttgtaagaatacagtacatcatgcatataaaatgtgttagttgacattattagtaatacaaaaatggttaattgactatttatgttattggtaaggattctggtcaccagtaggctctcagtggctaagttttgggggagtcaaaagttatatgtggatttttcactgtgaagggatcagtgctcccaacctctgcattgttcaagggtcaactgtatattatttgtaataggcacattacaaattaatgtaatgctttacttaagtacaaactactatggtctatacgttttgaaaaaatggaaagttttgatttgaaactatttagataatttaggtggaatgtgtttggcccttagatattaatggttattcttcattttctacatccctttggtctttcttttttcttcttcttttatttatatatacattttgcatttaacgtgatgctggatggctcaacaagtagaatacattcattctggtcagctgagctattttttcaaaaaaaccaaatcgcaaatttctgttttttttaatggaacaaatgcaattcaacattccaaagtaaattaagtcctcaatttgtattggtgctattaggttcttttcttgactggactgaacttagtagattctctcaaatacaaaaaggatttttagattacttattaaagatatatctatgcataagtggtaaatcagcatgcatataccatacagcaatatagtattaacaacccataggcactgatctcagacatcccaagtgcctatgggttgttaatagtactattaacagtgtcatagtactagtactagtaatagtactagtaatagcaatagtactagtactagcaatagtactattattattttaaaggtaaattttattttaaaataaaaatagtaatagtaatagtactattattagtgttaataatactaatagttaatactaacagttaacactaatagttaatactattgacaacccataggcactgatttcagacatcccatgcataccacttacgcataagtagtaaatcagcatacatataccatacagcaatacagtattaacaacccagaggcactgatctcagacatcccaaacaggctgataatgcaaatgattctttcagaaaccattgtatttaccttttgaagaaaatacctagatagtggaactgaacacaaagaattattaactagctgaaattacagccagggtttgagacagaaagtgtacattcagaattcattctcttaaccacaaaattatgctgccagagaaaatcagcaatgttaaacaagtagaagaatgttacatgataaaaatgcattttcagtaggctgtttacagtaattccaattccaaggtaaggttttgcctttttaagttggacggctgtgagtctaccacttggttattatgtgtggtgagacttcagaatatgaaaaaatgcttaagcttatgctttcatttgccactattaaagaaagaacagtagagtaattccataatagtactagtttacaattactttttttgtgaattagtcataggaaacttcagaattctgttattttcagggctgaggttgaattcatttgcgctttaatatcaactgctggtctttctgcaggcagtcactttcagggtagaattactgggtttcagggtagcttttcacactctacactatggccctggggatgggttgactaccaacaaaaggttgctaaactacttttttggggcatgctcagagttattgtccctttaggactaaagacgcaccccccacccccccccccgccctttggttgtaaatgttgactgacttcataaaagactccaaacagttgaaaccactcttccttctgcactgaagatgtttgcattgtttgttaaaatggattaatcagatttaaattttaaacaccatgtcctagaattgtaacaagctaattattccatttaaagtgcataacaaactaaacttcctgttaagtggcatttttgatccaccaattatctggacaaatatactgatggtcagttttctcatatgtcctgctttcaatttacttcatgattcaattaaacagttgtcagtacatgacaagaaaaataagctccctggtccatagtggccaagacatatcattaacattgatatctaatacacaagttattgcacattgagatatcttaatagttggataacattcttattttaaaacaatatgtgtggattggagattttgcaatctaggcacaaaagatatcttctgatcccttccgttattcagaaagtaattaaaatcaactaaatagattacaaagacaagaagagcaaaaaattgtaatctcctggtgaacatattatgaattggagccaattactggtatgcatttctattacccttggcctttgtaatctggaagctataaacttcaaaatgttcaattcagcatataagtcattatattagaaaattccatttaaaaacctatagaagttaaaatgatttaaatatagacataaaatagtaagcatgaaggtgttcaatatattaatcctgtaatctaaaatattatttgggcaatattcttaatctcttaaatattgattaaatggattttacaggaacaaggtaataaaatcatttttgagcagcgatttcatagttgtgaatgaaaatatgatgcattataaagtgcaagtgactccagcatcttcagaatgtgaacaggctcttgtcccccattgccgaattttacattcttcaatagatgattctctcccaaaacaaaacacttcattcagccatattggaccagtacctgcaataatgaggtataactgcattagtaagtttagagtttagtgtttctctttgagtggggcaaagccattaattccttcactaattaaacaaaaaagtgttgattattttctgtatgcaagttctgtgctctctagtaggaatcaaaaattaatctcctgcttcagaacactttatactctgttaacatgtaaactactaaaatgcaaagtaagaagagctctaacaaagttacctacacagttctataaaagtagagattaagaatgtttttttaaggatttgacaaattagttttattattaatctaaaaataaagaagaaagtttgagccttaataatcatgggtacatgtaataacctgatgatccaagcgtatctgtatgtcaaagggtcttggggtatatttgcacataaaataaaccggaaaaaggaaaacttaatatcagcatcttcctccttttgttatcttcccgtgtatttcaatttatgtgtgcctggtttatcaaatacattatctgtttttaattaaagtagaactaatctaatcagcaaagggcctacacaccatcctgtaaggaaatcatggattaagaatgctactgattgcaaacacaaacaaacagcaagaaaatgacaaagcaaaggttttcctgagctgatcaattgtaagagtgttaacagtaagttggagagcccaagtattttttgaggtgtttataacagtattgaggcttttttacttgaaattttaaggcagaagaaggaaaagaaaaaaggaatatgatctcaaaatcagaaaccttgccagggacactttttagttcccaaattatcttactaggcatggcatgtttcctattgtgtttgtgattgtatgtgtgagcatgtttgtatgtgtatacgtatttgtatatctgtgtttccttataagtatataaagtctataaaaactttttgaaagcctcaaagggctacttaaaaatacaggcaaataaaaacaattgcacaaatagtaagactattcccatgttaatacaggaggaagccgaagtacgagacatttataaattatatctattatatttattgtcatttataaattgtataaacaaacagaaattaaacttttggtgaaagccatggctctgtcataatttggagagtgcgagaatggctccatgaattgtgaacccgggctactgtgatgctttcgaattgtattttgtaggtctactcagtgaatttagatttcagcagtgcagaatttgtacaatccaggaaaaggaaactgagagtgggaattctcccaatgtctacagcaccagcaaggccatcccaacatgaatagcaaaggaaagaaattatttagttgactaatgtgctgacatgtaagcacatgtttttagaaattgcagtaagggaattcacgaatgttagaataccaaggttgtggtcctgataatgaaaatttaagtccagtcttttaagaatttcttatgtggcaggaaacacttatacatgtgatgtattattccatgcaatcctcaaataactttcaaaaactgaatgccattattgtgtcattttactgttgaggaaactgaaaatcagcaaggataaggaactgtacgtgctcaaagtcgcacaggattctcaccctgtatccaccctgagccactgccttaaatcaatgacttactgcaacctccttcattattagacttacttatttagcaaatctcctttggtgcctacacgagtgaacaagaccaaactccatactcttgtggactgacttcctgggagggcttatgttctaggtagatgaagcaactgagatcacatatacaatcatgccagagcaaatactggcatctagagcctctgattcttattctggttatttttcctctgaggacacatggatgtgacaaatgtattgtggaatttggtatctctgtcttttgctatgtggaacagtttcagacacagtgaaaattttttaagtgcttgtgtataaggtaatatgctaggtcttttcacatacatttctaaatttactttttataataaccttgttaaataatgataattatctccatttcatagatacataaactgagactgagaaagggtgtatgactttctcaaatttacaaagaatagatccaggcaacagaacatgatgacacttaaagcttagtgatattcatgggttacatagatgtctagatagaattatagaagtaatttccaaagatttgttgttttatttttatattaatatattcaagactattgagcccaggggaaaaatttatttaatacacattttccgtctcattccaaattgttttctgcattaaaaagttaatgcagatagtataaaattcataaaattttatccttgtgtaaaccaatgagataaaaaacaaatttgtttttatttctttagataataactgttattcaaggatcttcgttgttggggctgtcactgttattattttttttgtgcctctgaactattctttctattcggtggaaagctatacaaaaattacgtgtgtttcttagatatgtttttaatctctaatcctcttcctctctttctctctctctcatctttccacctatatacctagccatatatatatctatgatttcctttataatttgagggttgtagggattgatattgattatatattttttttaagtttttttttttttttttttttgagacagagactcactccctctatcgcccaggctggagtgcaatggcgtgatctcggctcactgcacttccgcttcctgggttcaaatgattctcctgcctcagcctcctgagtaggtgggattacaggtgtgcaccaccacgcccagttaatttttgtatttttagtagagacggggtttcaccatgttggccagaatggtctcgatctcttcaccttgtgatccacccacctcagcctcccaaagtgctgcgattacaggggtgagccactgtgcctgacctcctcttcacctctttttaaaaaatgaaagatactgatatttctttgggggatttgggtatctttaatcttaccagcatttccatgaaaaataaaaggtaatcagtttcatacatcatccagatatattataaaatgatgagatttgagatcagctgctgaatagataaatgggagagcaaatatcattaatagttaaaagtgcctgaatgtgtattttcattatttctagtcatgactgagtgacataaatttgtatgacttttaagcctagttgggaagtgttttgtgaacagtgtctccattgagaaaaacaatgtaaattaaagttgaaaacaccttgggaatcaaagtagagaagaatgggtcaatatagcctatagtttggattgtagttttgtgcttatagagaaaccactcatttttcctcaattttatgatatgcagaataaaggagtaaggctaacatagctttaagactttgtctacctttaatatttcatgatactaagattctgaagaagcaagctctttagaaatgaagatcttaagtataaaggacttggaaggatgttccatctggtggagaaagcatggtatgagagaaaggttaaggcatgaatcttgacccttcttcccactcccacccacccccaaccacccccaaccaccataatgactacgtaaatttgtacaactttgatgacctctgctagccctacttattttctctatgaaaaaaatatgctatttttctgtgattacccagctgtatggaccagccctatactactttccataatatttaacattcaaatgtttacattttaaaacattcaacatgcaaggagcagtatgtaaaaatttgacttgtgaccctttgatatatttatttatctttgagattatatttactcccattcattaagggatagttcagaggtatagaggtgcattttttgattgccttctgtttacccttacattttttttttgaaaatttcacatagaaaattgattatggtatgtaaaagtggtaataaaaaagcaaagaaaagacagctaagaataacttttaaatggcatttatgtttatatattacttttgtttctcttttcaggtttggagtttcagcactataaactcaggagaagaagcaatagttactccagatcttacttccctcatcagcatccatacaggctcagatatacctggaacaaattcttggaggtaccactgttgtatgataaaactcatccaagtttgctgcagggagaccacaggcacaatagctgggaaagcctggatacggggcaaaaagtgactcactctcctttccctgccctgtgcattgataaacagtagatgcccctcagtgcttccttaattaaacttgttttgtctagtcagaaaaaaaggtgcatccaaatgagagaacctatttaaaggagcatgcttgaaactttattcctataagtcattttacctgcagctgcaaaactaattgttcttaaaactaaggattctatctgctaagccaggtttgctatttaaaaccagaaaaaaatatgtggagactgtccaaaaattatattctttctataatggtgcattataaaaagagggttcatttaaattgttttctggctgggcacagtggctcatgcctgtaatcccagcactttgggaggctgaggtgggtggatctcgtgcggtcaggagttcgagaccagcctgaccaccatggagaaaccccgtctctactaaatatacaaaaaattagttgggtgtggtggtgcatgcctgtaatcccagctacttgggaggctgaggtaggagaatcgcttgaacctgggaggcagaggttgcggtgagccgagattgtgccactgcactccagcctgggcaacaagagcgaaactccatctcgaaaaaaaaattgttttctttttgtttcaattttggtaatgatgtacaatatgatatgaacctgattcttctcactttcctaagagaaggataaataattaaaacaatgcatgtttctcttttagttctttactcatccactcatttttctaagtttcttttcttgtctctactctgtatttaaaattgctttttcttttcctcttgagtgaaactgtgaatttaaggtggaggagtgaaaaaatcaggaatgttttaaatagctttccataaaaacctcgtttgccatgtctaatccccaatcagtgaataatgtaagcctgtctcttaaaatacaatatccagtgaagtagatcataaaacttacttttcaaatcattttcttcagaacaaataatgttggttctatttttttctctcagctcattttgctttattattttaaaattctcataattattctttagttgtttggtactgaactctacgcagggagtggaaacaacagctaagtcaaaccaggtgcagtggttcacacttgtcattccagtactttgggaggctgaggcaggaggattgcttgaggctaggagttttagatgagcctgagcaacttagcaagaacctgtctctataagaaattaagatttaaaaaaaaattagccaggtatgtggtgcaggcctgtggtcccgagaaactctgcaggctaaggtgggaggatcgcttgagagcaggagtttgaggctgcattaacctgtgattgtaccattgtattccagcctaggtgacagagtaagaccctgtctataaaataaaaaatctaagtcatattagtgggatatctactttgaattagccttggaatatcactgatgtcaatatacaatgtaatagcgatctcactctttcaaagagaatagcaaataaatgtgtgataacacagtttgtgttgctgctagcagtgatctccttcagtagtgagcaatacaacattgtgagtcagattttgtactgggtgctttccatatgctagttaactcaagcttcaaaacaaatctgccaggtcagtattattctcattttattggaaaggaaattgaaattctgaaacacaataaccacagctaaaatttaaacttgcaattttttaagttagaaaactcctaatctttccagtttgcttcactagatgctgaaaaaatgtaaaaggaaaccaaaatcctgacccactttattgtttgatgataataaaactctgggacaatgtatagaatcaccaactaccataaacaaacagcctcctgaaaatttagacaaattatgtcaagaaaacttgagagacttatctccacatagccaagtaagtaacttcacatgagactaaactctgtcattctattccttatttaagtttaaaaaaaaccattttcttcttagtatctcagtatacttattatcttcctttcttaccagttctttagaccagaaatccctactttatagagatataagcaggaatgaataaaagttttgaggaaaatactattttactcatgagactaagccttaaagttaatacaattttaggacaatagtcttcagctatgtttttctcacctatgtttgtaactccagtggaaaaatatctttgaagtccatggcaaagcttcatgctcagagaagaaataaagctagagatgacgtcttgttcactttcatactacaggctgtatgttgccagcacttactagctttccttgaattaaagtacatatactactactgttgctctccatttgattttctctttgtaatagatgaaaaagcctcacctcagccactgtactactgggctagtttcttaaagcaggggtccccagcccacagaccatggaccaatagtgtccatggcctgttagaaacaaagctgcacagcaggaggtgagcagcaggtgagtgagcaaagcttcatctgtatttactgccgctccctatcactcacattaccgcctgagtgccacctcctgtcagatcagtggcagcattagatactcataggaacacaaaccgtattgtgaattacacatgtgagggatctaggttgcacgcttcttatgagaatctaatgtctgatgatctgaggtggggctgcagccgtgatgctagagctggggagcggctgcaaataaagattaacattagcagagaggtgtgacggcacagagacaatagtaaatcaattgcttgtagactcatatcaaaaaccctgtcagtgagtggaaagtgacaagctgcatctgatggcaggctttagagtcgaaagtgagttgatgtacttcagttgtacagctgcttttggtgcctttaaaggtatgtttgagacaacttcaaatttccatacattctggattaaactttcgaagcagaatatcctgaaattgccacaaaagcactgaaaagcctgcttccatttccaacatgctatcttagtgaagcagggttttctacagtgatagcaaccaaagtgagattatggagtagactgtacataagcaacacacttcaggtgtcactgtctcccatcagccccagatgggaccgtctagttgcaggaaaccaagctgagagctcccactgattccacatagtgagtggaataatctacatcataataagttgtataatcatttcattatatattacagtataataataatagaaataatgtgcacaataaatgtcatgtgcttgaaccatccccaaaccttctcccatccctggtctgtggaaaaattgtcttccacaaaactggtccctggtgccaaaaaggttgggaaccactgtcttaaagaaacaatgctaaatacagacttgtcagatctctgcataatataagcatcaaaataattcatccagactagtggtattttaggatacttttcttttttttatactgagcttgtctgcattgattatattatctaaataactggcaaattttatacttcattttgtcaacaaaagcacatcttgagaatccaaaacatcttttatttctaaagctgaagaatcatcagtcatttaccaggtgactaagagcatggataagactcgttatgtcctctattagaactgtgggtgtccccttcatagatggtaacagtcacttgaaatgttttatacaattatgtattttaaataaatggtctttcattctgtggatgttagttatcatagaaatggattctgttcccacaaaacaatttggaaacgtgggctgggtggcgtggctcacacctgtaatcccagcactttgggaagccaaaaataactaccaaatatacaaaaactagccaggtgtgatggtgcatgctggtagtcgcagcttctcaggaggctgaggagggagaatcacttgaacccaggaggcagaggttgcagtaagccgagattacaccccgcactccagcctgggtgacagagggagatctgtctccaaaaccaaaaaaacaaaaacaaaaacaaaacagaaaaccaatgtggaaactcagattgggagctcagtcttgttaaataactgatggcatcattcaattctctagggatgaagagttgaggattttttctttttcctcttctccagaaaaacaaaaaagaaaaacaaagaaaacaaaagcaaaaatctagctgttgaccttgagaatatcttactattttacttttggagataaattttataggtgcaagaatgatttcaaacccacacttttcaacctgggaaaaatgttctaaatatgggacagggatggaaaatttggaaactccacagatctctctgaagctgtttatttcctttgtttcttctatgtaaacctttagggtgcaagttaaaaactacggccaggggctgaaactggctacagaagttctgcacattaccagtctattttctgacatctcctctcttcatgaaattaaattatccttctgggacctaaagactctagaacctgagacttctgcttaaatccatctcttaaacctaatatgataattattatcattatttttttagacggaatctcactctgtcacccagggtggagtgcagctcggctcactgcaacctccacctcctgggtccaagtaattgtcctgcctcagcctccaaagtagctgggattaccggcgtgcaccaccatgcctggctaatttttgtatttttagtagagatggggtttcaccatgttggccaggctgatctcgaactcctgacctcaagtgatccacccaccttcagcatcccaaagtgctgggattacaggtgtgagccaccatgcccagcctaatatgaaaattattttaggtaaaatagtaaaggatgtgattgtgacctattattaacgctatgcaggtatttaacacaatgcgtggcatatagtcattactcaataaatcatagcatattagcacttggtaatatcttctaggcatttgagaagttcatcttacctttttctacttttctgtaaaaatttgtttttcagagacaggtcttgctctgtcacccaggctggagtgcagcagcgtgaccatagctcatgtaacctggaactcctgagcccaagcgaccctcccacctcagcctctgtagtagctaggactgcaggtgcatgctatcacgcctggctttttttttttttttttttttaattggtagagataggatcttactatgttgtccacgctggtcttgaactcatttattccagtgatcttcccacttcagcctcccaaagtgctgggactacaagcgtgagccactgtaccaagcctagactatgttcctgtcactactttattctctgtctttagagaatgcctacatttcatttttttaaaaacaaaattttctggccaagcgcggtggctctcgcctgtaatcccagcactttaggttggcgaggcgggcagatcacgaggtcaggagatcgagaccatcctggctaacacggtgaaaccccatctctactaaaaatacaaaaaatgagccgggtgtggtggcgcgcggctgtagtcccagctactaggcaggctaagggaggagaatcgcttgaatccgggaggcagaggttgcagtgagccgagatcgcgccactgcactccagtctgggcgacagaatgagactctgtctgaaacaacaacaacaaacctcacaagattttctttaaattaccttgtccaaagtgagctgccttgtgcacggcttgaacacctgggtatcccaagctcctacagacgacctgtccaacgcgcacttcccagcgatcgtcacaaattgtaccccactggccgctgtggagtatctccaccctcccctcgtgagggccgctcccaccgaccagtcgaactttcgtaaatggagctgtaaagttaaaaaaaaaaaaaaaaaaaaaaaaaggcaagcaaggactaattatgtacatactgctttacagcactttttttttaaacacaaaaaaatgtttagcacattttccaaataacttcaactattggaataaatattaaactttctagcaccacctattggtaaagagtttaactgcaaatattgcagctttaacagctgttaagagcaaaatccaatctgtcttacatgtaagttatatatacgaggacacgtcacagattatattccaacgagtttgaattttgacagatacaagtttattgtcacttagattttttcataccattgaaaaattataactaaatggttcattattttcttgacatacaaacatacaaacttatcaacatacaatgcagagattttcaatactataggagggcgaggagcagatattttagaatatcataaacacaaaaataggtgatcaaacttcatatcttttcccaagggaaacaagggaactatagtgacaaccttcatttagaaatagcaaagactttccttgttgtgaggttcctggattctgtaacaaagatttttgtgtttttcctctttagaaaaaaatattaacgagataaaaaatcagacaattttgtttatttttagaagtgattcaaatagtaaactacaaagaaataaactttgtttataattataaaagtaattttgttctgtaatgtctaatcaaaatgaccatatgtacaataaacttttgtaaaatcttgatcatgctacagaaagatttacataaatatgaaatggctcttttctatttttaaaaaccaatatatatgcactttgacctagtgacagattaaataaaatagtgcaacaaatattataagagcaattcacttggcgtatgaaaaatctctcaacagcctgtattattctgctaagtatttgtttagaaaattatttggctaaagaacagaatgaaaggcagagatgaaaaattatttttaaaaatttagttaatattaaataaaaataatattttctaataatcataaaaactaataaatgtaattctacgtaaacaaaagatagcttttcaaatataagtttgaggaatgttatattataaaaaagatgtaattttcataacaaaaatatctctctaatgtgaaaatggagttttaaggaatgggtttttggagctcaattaattgaagaaatattcagtaacttctttttctccagtttgaattcattttgttagaacggtaatctaataacatttaaagttactagattactgtttcaacaaatgtttttaacttatgcttattactgttttaacagtaatttaataacatttaaagttattagattactgacaatttcctgtaatgaaattgagtgacctgagctatgcagaaacataaaaggtggcatgttactatatatataattataattattctcttgattcttccaaaatataattcagtgctaaatactgatttagtgtaagcatgcctgagtggataagtccttcttcacttaataagcataagttaaaaacactttaaaacatgaaaataatttgttattatagtatttcaactttcatttactagtaaaattcctgagtggcccaatcatttcctgtaattgcctaaagaaaacgagaaagaaaaatccaagaatggattgtgagaagcctttacatattagagacatgttttattaactagtgtgatatccaaatgtttatttttatacaagtcaaatatatccaaacataatatatttatcatgcatgcatgctatgaaaaatcaggcatactcaaacatttgattatatgagcatcgttgtcctgttgtccaaacaagtgaatgtaagcattctcactgcccattgtttacctcttactccttccaaaatgtcataaatgagccttgcttgtcctggagcagtggttctcaaagaataatatgcagcagaacaagctcccaacagctaattctgttggtccagggaccacactttgagaaccactaacctagatgattgcagtatatatttagaagaggagacatattatatcagaaacagatagtgctgctgatacaatcctttcatctcatttattgcaaagggaatggctgactgtaaatttctgccaaattccgtatgctcaagggatcctgagggggagtaggtacctctattcaaattctttttttttttttttttttttgagacggagtcttgctgtctcccaggctggagtgtagtggcgcgatctcggctcactgcaagctccacctcccgggttcaagccatcctcctgcctcagcctccggagtagctacgactacaggtgcctgccaccacgcccagctaattttttgtattttttagtacagacggggtttcaccgtgttagccaggatggtctggatttcctgacctcgtgatccgcccgactcggcctgccaaagtgctgggattacaggcataagccacggcacccggccctctattcaaattctttagggccaaatatgcttgggtatgctgatccatatctgtcacctgaaatatttttcagttataaataaactattgacaggtgaccacacattgctgatccttgaccatctctgaagtaatatagaggaaaggcgtctcaataggtcagtagactcatttgagagttggcttcacctactattcaactgctctgttttggtgatgtagaaaagttcattttgtcatcaaccttgatcataggattttctctgtaagactgaaggatcaaaacttctctgaaagtagctaattcactgtcacaaagatgtaaagaatgtctgtcgtttctttggcaacaagctaatatatttagtcagatagggctttttttttttccatttgggtatttttatcttgtatataaagatttcagaagacatgtatatgtgtgtgtgtgtgtgtgtgtctggatagctgtttcctctttatttgtgtagacattttctacattcaaatcaaataaacacagataagcatagactatgtgcctaaacgatttcgtgtattattattttttaattggtgaaaaaacagaaacagaaactaaagtaatttaaaccaaaaccaaaataataatgtattttaaggacactggatgtttcatagaacccaaggataagattatagttaggtatctgcaatagctgacccaagacccgaatctgcttaggagtctccaacttgtactcaagcttctttctgtaggttgctttattattctttttttgttgcaagctagatatctttgctctcctgttcacttgatagaacatgtctgttaacagctcctaagtttatattttacagtttctttcttgatgacagttactgtctctttctcagtgacagactgacagttctgacactcacctaacttgatattttacagcctatttcttagtgatagtttctaaaatatccagggaagttcttctatggcctagtttgggccaaatgcccacctgtggactggacaaacaggccgagtcacttgcatgaacatggcattcccacagtgagaatggggaggcatttccttgttgaaagagttttgagcagacaaaaaatcttaagtccattccataaaagatattttaataatcttggtgcatttatgcaaatatttgctgtttctttacagaaaaagtttgggaatccctggtagaattacaaacatagtagacgagaatgatagaggatttcctgggaatactcttgtcaagtgacttgtggaataaataaggtcatgcttaatctctgctcacctttccaacctaacccttgagaaattctccccacctgcactgctttgtctttttactttatatataactactcacattttccaaataagtctcattctcctttatttctggggctttggttcctgtctggaatgttccttcttcccttcccacttcccctctcatttctacactctcaatctccaaatttcgattggttactcaatagcactattacagatgctataccaaactgcagtaaacttgtttgttttccccagtagactgaaagaaacccgttatagtcatcttttcagcatctgacaagatgcaagttgtcactcagtagtcacttgaggaagagttatggcatgaatgagtaaataaatgaatggtaagcttctcttgatacatgaactgcattacccagtgagattaaattggcaaatgcttaaaatatcaaatcatagaagaaactgaatttaatatttcataagtcttcagagggaatagaatatagtttctatgagtagaaacagaaaaatcatgaaggaaagattgatttaactggcataaacataagtgtttttatggaaaaaaacccatatggctggctactgagagcctctccaaatacgagcttttggtgggaggctctgatcagagaagcctgagacattagaaaatctgatcttgtcagctcagtgagcagatctatctcttagaggcagactaatgttaaacagaatcttgggactaaatgtcaattcaatttacaatgagaaatgtaattgccttaaaaactggaatatttgaatctgcttgacaaggccactttctccccttgggaaatctgcatgggaaggcaaatcacagtgagtgaactcttagtttaattaatttattaatttacaaagagacttagcagtgagattttgcttctgggatggccaatgatctttcgttaacacatttttctttatatatgttaatacattcagtcaggtaaaatgatttgacatatctctgctgattcattgaatgttcattctatagtttaactttttaaaggcaatctcactattcttatgtcccatttctttacatctctatgacaatgagttagctagtttcagagaagtttcaatcctttctttaggaaagaactgggacataagaatagtacatacatatgtagtaaatgcacaaaaacatgaacggaaggaaacaaactccaggataaaggtttaccctggaaaggaagacaggtagacatactggtacttcaactctgctcataacattgtatttcttttaaaaatttttaaaagtttttctttagagataaggtgtccctgtgtctcccagattgaagtgctgtggtgcagtcatagctcactgcagcctcaaactcctgggctcaagtgatcctcctgccttggcctcccaaggtgatgtgattacaggtatgagccactgcacccagccaaaattatatctcttaaaaaacaaatacttgtaatcaagatggtaaatgtgaacatttcaaaggtccaagtggtacacatgactgtgtattagctatttattataaatattatttcttttctttatttttgaaatatattttatttaaagaaggaaacaacacattcactgcaatgttcacagagccatacctgaaccctgcacaaattatttaaagtgttccatatatgagtctacccttaaaagttagagaaaagatactacgaatctattcatcgctgttagaaagacaacattcaaacttgaaaagtcagggaacatgtaaggtcttctttgcatgtgtcaattaccactactcagtggaaagaaataatcgaacatagaaatgacttttgaggagcataacagttattatcctattgtttactcatagtcatgatttcctttttgtatcatttattggaattaggatttagggttaaatttattacaatggtagttatgatatttgagatgcaaacataatacagaaattaaaaaaaaatctggttgcagtttgacctgaaagttctcacaacatggcaaaattcctttaagaagataactgattctttatttaagataattaccttaatgagatacttagcaatgaaatgtgcaacccaaatatcagatacctgaagaaactgagttaaatttctctagaaaatttctctagaaaaataacataacatattgtgttactcctaaagccagggagacaagtatttgggacagagtcaagaggagatatttttgtattttttgaagagacgggatttcaccacgtagcctaggctggtctccaactcctgagctcaagcgatttgcttgctttggcctcccaaagtactgggattacagacatgagccactgcacccggccataggtataattttgcacagtttacttaatggttctaaatcctcatggggagaacaccagagtgatagattccttgtggggattaagtaaaggaggtatataaagtgcttttcagagtgtctggtacagagggttcattctacacattataggtattattgatactattatttcttaaaaattcaaatttctggcctaatgatggggaataggtgatgggagaaaaaaagtatcatatattaaatagcagtttctcaactactttgtgcttcagaatcccaaggagaacttttggaaatcacatgtatcaaggccacagcacaaactccctgaaatcagaatatctgtgtgtcatgtccaggcatctttatatgataaaagcctcacgagtcattctgatgttcaccatatcctgagcccaacttctagaacaatactagaatacatatgaccacttagagagttacaaatcattcgcattatggaagaattaaactaatacatcgccgcccaataagcaatcagcaagactatttctaaacatgattgaacaagatagtgagtttgatccactttttagtgccctggaccctgcattctgagatttttaaagcaaatcttgtcttatccaccatttggtaattatcttttcgggttaggcaatgagtatatcttatctctacacacaatagcttgtcaaggggaaagctcaggatcaaaagtagagacagagttattttgaaggaaaaaatgcggcattctttcttagccatggctagatgttaagataatgccacacaagagctgacttcacaatgaatataacatatctaaagagaaagagagagcgagactgagtccaaatgatttactttgaacacctggatcctgctatgcctgaagccatctgtgggaattgtaattcttaattatgtaaaccaatagactctattttgtgattaaagatgtttctgttactttccacttaacagttcttacaaatatctccatggtgattatttgtcaaagaatattagaagtgattgcccaggtcatcctgtttgtcattaatcccatcaccattggttattgtctgtttaaacagcattattctggtaatttttattatctcatgagacaatgtaaaagaacatcactgaaatgtaaatacacaatattggcagtaaacaaaagtgaaattgttctcataactataaaaacaccagaatgcatcaaatttacttatggtgcaatttaggccctctttaagaacaaagttacagaaacatagacaaagaaaactgaattcatcctgaaacagttccagccgtgtgctgcagagatcctgcccacagacagaggatcaattcttgataccttcctattatgtactgaattgtgtcgctccaatattcgtatgctgaagtccccaatgtgactatatttaaagatagaggccatatggaggtaattcaggttcaattaggtcataagggcagaatcctaacttgataggacaggtgccctatcggaagagataaagacaccaggagctcagtgctcacacagaaactgcctcatgaagtcacaatgagaagggggccgtctgcaagccaaagagaagcctcaggagaagccaatcctgcccccagcttgatcatgggcttttaatgtcaagaactctgaggaaataaatgtctataatttaagctactttatctgtggtattctgttctgacagcccaagcagactaatacgttttcttttttcacttatgttatgtttttacttgcaaacgagaaatagcatacttcagtgcatataaacttaaaaatacaagctgcttctttaatttataggtggagttaagctaccatacttgctatgttgtgatttgaacacactgaaaatctcttttccgaaaataatcactttgtccctaaaacacctactttaaaagctgatttttattcaaaaatgacataagtacttacgaaggacctattagatgttttaatacgttaataataataatatgtttgttagcttacactctgtgattgataaagcacatgtccttttggtgcagaaatagtatttctaggtgcaggtaatgtactgggtaacaggattaagtgagaatgcaacagggaagagttcgaggtggaagatgttttataataaaacataatcattttataggggaaataagttttgctgtaaatcatatgaagttttagtgaaaatactgtacacagaaactgaatatttgtatgcagttaaagaggtttacttgttctttgaactttctaggaaataaaaatgcagaattatataaaacgtcattaggaaatgggtcattttgctaaataattcacattagaattcctttatataggtccctaaaatacctgagggtccaatgttttactttggcatggattaagcaggatatgagtaagaagtagaaaatgaaaataactacagcatccgggaaaggattaagagtctgtaggctaagccataatgggggaatttcttggagactccatgtgaaacaagccaactgtgtcgttctaggaaatctcgtcttaagattcacctcaggttgggtgccgtggcttatgtctgtaaccccagcactttgggaggtcaaggcaggcagatcatttgagtttagcagttagagaccagcctgggcaagacagcaaaaccccgttccctacaaaaaattttaaaaaacagctgagtgtggtgacctgtgcctgtagttccagctacctgggaggctgaggtgggaagatcacttgaggacaggaggcagagattacagtgacccaagatcatgccactgcactccagcctgggtcacagaaagagactatcccctcaacacgccctaaaaaagatttacatcttaagggcaggacatttccagagacgatcggctgaagggggcaaataataggctgtgagcccatacaagtccagtgcttgaatttgagcaaaataaataatcttgtgtgagtatcaggctaaatttcttactgcagaataggaagcctggagttgtttcttcaaagggcaggaaaggtacttggtactcaggctatggaggaaagggaagtggagtgttgggcctctgcttcatctgcattcctgcacataattgcatgaatttccacttttgctgctgtgaaaaatggggctgatgtttttccttctaattggttctggtgagagtgaggctgtgagagtcagctgggatagggactaagcaggacaagtgctaactgctggatccataattgatttaaatctctatttcaaacgacacaacatacaggtatatcctgttttattggtcttcactttattgcacttcacagatcctgcatgttttacagattgaaaatttgtggtaattctgtgtcctgcaagtctgtcagtgtcatttttccaatagcatgtgctcgctttgtgtctttgtgtcacattttgcaaattctcacagcatttcaaacttttcctttgtttcaaatgctttcttctgcccccacttagatgagcactgtattttatctttaagtatattaacatggtgacaaattgatttatttcattttttaaaacttttatattaggttcaggcgtacctgtgaaggttggttatataggtaaattgcgtgtcgtggcaatttggtggacacagattattttgtcttcgaggtaataagcatagcagctgagagcttttcgatcctcaccctcctcccaccttccaccctcaagtagaccccactgtctgttgttcccttctttgtgtccgtatctactcaaagttcagtccccacttataggtgagaacatgaagtgtttggttttctgcttgtgtgtgtgtttgtaaggataatggcctccagttccaaccatattccttcaaagaacgtgactcattcttttgtatggctgcatggtattccacggtgtatatgtaccacattttctttatccagtctaccaatgatgggcatttaggttgattccatgtctttgctattgtgaatagtgctgtgatgaacatatgagagtatgtgtttttatggtagaacgatttgtattcttcgggtatatactcagtaatgggattgctgggtcaaatggtaattctgttttaagttctttgataaaccaccaaagtgctttccacaataactgaactaatttacatttccatgagcagacgataagcattctcttttctccacgaactcgtcaccacagcatctgtaattttttgactttttaataaacagccattctgacaggtgtgaggtggtatctcattgtgcttttggtttgcatttctctaatgattagtgatgttgaacatttttgcatatgcttgttggccacgtgtacgtcttcctttgaaaattgtctgttcatgtcctttgcctattttttgtcaggtttattttttgcttgttaagttccttacagattctggatattagacattttttgatacatagtttgcaaatattttctcccattctatgtatctgtttactctgttgatagttttttttttttttttttttttttgtggtgcagcagctctctaattaggacccatttgtcaatttttatttttgatgcaattgcttttggcatcttcatcgtgaaatctttaccaggtcctatgttcagaatggtatttcataggttatctttcagagtttttatagttttaggctttacttttaagtctttaatccatcttgagttgatttttgtatatggtgtaaggaaagagttcagtttcagtcttctgcatatggctaatcagttatcccagcaccatttattgaaaagggagtccttttcctattgcttgtttttatcggctttgtcaaagatcaaatagttgtagatggttggcaatgtttctgggttctctattctgttccattggtgtatgtgtctgtttttgtactagtaccatgctgtttttgttctgtacccctgtagtatagtttgaagtcaggtaccatgatatctccagctttgttctttttcttaaaattggcttggctctttgggctcttctttggttccatatacactttacaatagggttttttttttttctaattacgtgaagaatgtcattggtagtttgagaggaatagcattgaatgtataaattgctttgggtggtgtggccattttaatgataccgattcttcctatccatgagcttggaatgtttttctatttttttgtgtcatctaggatttctttgagcagtggtttgtagttctccttgtagaagtccttcactcccctttttagctgtattcctaggaattttattctttttgtggcaattgtgaatggggttgcattcctgatttggctctcagcttgactgttattggtgtacagaaatgctagtgatttttgtacactgattttgtatcctgaaactttgttgaagttgtttatcagctgaaagagcttttgggtcaagactatggggttttctagatatagaatcatgttgtctgcaaacagatagtttgactttttctctttctattttgatactgtgtatttctttttttgttttgttttgtttttttgagacagagtctcaccctgtcacccaggctggagtgcagtggcatgatcttggctcactgcaacccctgcctcccaggttcaagtgattctcctgcctcagccccccaagtagctgggactacaggcacccaccaccacactggctgatttttgtatttttagtacagacgggttttgccatttggccaggctggtctggaactccttacctcaggtgatcttcccactgcagcctcccaaagtagatgccctatatttccttatcttgcctgattgctctggccaggacttccaataccatgctgaacaggagtagtggagagggcatcattatcttgtgctggttttcaagcagaatgtttccaggttttgcccatttaatatgatgtcgctgtgggtttttcaaagatggctcttattattttgagatatgttccttcaacacctactgcattgagagtttttaacatgaagaggtgttgaattttatcagaagcgtttgctgtatctattgagatcatcatgtagtttttgttgttagttttatgaggtgaatcacatttattgatttgcaaacttttccattattagtaaaatatggggagattaaaacagtttgtggaaaaaagcaattaaaaggtaaaaatcacaaaatataaattttacttctcaacataagctccatcaagttcaagacacttttataggtgatgatactagccatttagtccattcctaaagacctgaggatcttaagaatttaactatatcaatgttgtaatcttctcattattgaaagaagaaaaattggtgtcctttaaaaatattttgagagtgggaagctaaaagaagtcagaaggagccaaatgaagattgtaaggtagatgcccaatgatttcccattgaaactctcccaaaaattgtcctagtttgatgagagaaatgagcaagagcattgtcatgatggagactccctggagaagctttcctgggagtttactgttaaaactttggataactttctcaaaatactctcatagtaagcctaggttaccattctttggccctccaggaagtcaacaagaaaaatcacttgagcatcctcaaaaactgttgtgagaacctttgttcttgactggtctgcttttgctttgactgtaacacttctacctcttggtagccattgctttgattatgcattgtcttcaggattatactgggaaatccatgttttatcttctcctataattcttcaaataaatgcctcaggatattgaccccacttatttaagatttccactgaaagctctgctgttgtctgcagctgatctggacacaatagttttggcacccatctagaaaaaactttactcaaccttaatttctaagtcacagttgtgcaagccaaaccagttgagatgtctgtggtgttggctgttgttctgctgtctcagttcttttcaattaaggcacaaacaagatgtatttttttcctcacaaattgacgtggatagtcagctgctgcagggttcatcttcaatattttcttatccctttgtaaaactgagttctctttttgtcaactgctgattcctttgggacattgtgcctataaacttttcataaagtatcggtgatttcaccattcttccaaacaagtttcatcataaatttcatgtgtgttcttggttccattttagcaatatttatgtggctctgataggggctctttttaaatagataccttattgttcttagtgcatcaaattagattctattcagacatgttataataagctagcttgttttagtgcagaatttttgaaatccatgtatagtgttttcctaatacatattttccatgattttttgaagaccccttgcatttgttatggcaatcagtgacctttgagattactactgtgattagtttggggaaccacaaaccatgcccgtaaaagatggcaaacttagttgatatatgttgtgtgtattctgactgctccaccaactggctgttcccccttctgtctctcttcctctcctcaggcatccctattccctgagacacagcaatattgaaattaaacaaattagtaaccttaacaacggcctctaagtgttccattgaaaggaagagtggcacatctctcatttaaatcaaaagctacacatgataaaccttagtgagaaaggcgggttgaaagtcaagacaggctgaaagtatgaaatttacctaagttgtaaatgtgagaaaaagttcttgaaagcaattaaaagtgccactccagtgaacacaaaaataataagaaaacaaaccaccttattgccgatataaagttttagttagtggccttcatatatgatcaaaataaccatgacactcacttaagacaaatccaagtccagagcaaggctctacctctcttcaattctatggaggctgagaaaggtgaggaaactgcaggagaaaagttggaagctagcagaggttggttcataaggtttaaggaaagaagccatctccataacataaaagtacaagatgatttagcaagtgtggatatagaagcttcagaaaattgtccagaagatctagttaggataattgatgaaggttactacactacacaacagattttcaatgtagatgaaacagcttctgttgaaaaagatgccatctataactttcatacttagagaggagttcatgcttgacttcaaagctttgaagtataggctaattcccttgttaggggctaatgcagccagtgactttaagttgaaggaaatgctcatttgctattctgaaaattctagggcccttatgagttatgctaaatgtcctctccctgtgctctagaaataggacaatgaggcctgggtgacagcacgtctgttgacagcatggtttactgaatattttaatcttactgttgagacttattgctgagaaaaaaaatccttttaaaatattactgctcattgagagtgcacctggtcacccaagagctctgatggagatggacagaaagactggtgttgttttcatgcctgctaacacaatatccattgtgtagcccatggatccaggattaatttttactttcaagtcttattacttaagaaatacatcttgtaaggctgtaactgacacagagagtgattcctctgatgtgtctgagcaaagtaaattgaaaactttttggaaaggtttcacaatcctatatggcattaaaataatttataattcatgggagaaggtcaaagtattgaggttaactgaaatttggaagaagttgattccaaccctcatgaatgactgtgaggggttcaagactttaatggagaaagtcactacagatgtggtataaataataagagaagtggagaactagaattagaagtggagcctgaggatgtggctgaattgctgcaatcgataaaacttgaatggattaggggttgcttcttatggatgagcaaagaaagggtttttttgagatacaacctactcctgaagggaagatgctgtgaacattgttgagacgacaacaaaggatttagagtatcatatagatttagttgacaaagcagcagcagagtatgagaagactgattttaattttgaaagaagttctaaagtgggtcaatgctatcaaatagcatccattgcatgcagcagagaaatctctcatgaggagaagactccatcaacgtggcatatttcattgttgtcttaagaaattgccacagccacctcaatcttcagcaaccatcacgctgattagtaagcagccatcaacacggaggcaagaccctccaccagaaaaagataacaacttccggaaggttcaaatgattgttagcattttttagcaataaagtattttaaaaattaaagaacacttaatagactccagtgtagtgtaaatataactattatatgcactgggaaaccaaaaaatttgtctggcatgtttcattgtgataattgctttttttttgccttggtctggaactgaaaccacaatatgtccacagtatgcctgtattagctatacactctattaaggaacacatctattgtgttaatggaatgctgcattttttttgagaaggagtattgctctgtctccaggcgggagtgcagtggcatgatctcagctcactgcaacctctgcctcctgggttcaagcgattctcctgcctcagcctctcaagtatttgggactacaggcatgcacaaccacacccagctaaattttgtattttcggtagagacagggtttcaccatgttggccaggatggtctcaatctcttgaccttgtgatccacccaccttggcctcccaaagcgctgggattacacgtgtgagccaccgctaatttgtgaacccacagaaagctctaaacaccatgtaactgtcaaggatgagcagcatttacctaagttacctggaaccatccctactcaggtacactcagttctgctaactcataactagtgctactaagaaagtacattatggagttaaaaaaaaagacacaataaaaaaagagagacattggagcagccaaataatagtgaaaaatgttaaggctgagcccgttagcaaaataaagatagaatattaacaggtagctcttccccaggtgcacataagtagctctcattagtgataatggaagctttgtgagcattctaggaagactatgtttctgagtaatatccttaggagggagactagaggcaatagctggagtagttatgaaggtggaaacacaaacaaataaagaataactgagaatgcttatttggaatttgatctgccgtaagaatttttatctctttagctcttcaaattactaggcccattctagaaaaccaaactgctcattacaaatttcttccttttctgcctttctctctctctatctatctctttctctctttccctctctttctctttgcataccctccacatgacatatctgtgatatatataaaaatacataatactagtgtgggaatattgaatggagtcataaggactttggagatttaaagacctggctttgagtttctgttcttccacttattagcagtaagccacagtttataattctagaaattgggataatagtccttcacccaaatgctcttctgaggattaatgtataatgcaccaaaaaccctgttgggttgggtgtagtggctcacacctgtaatcccaagattttgggaggttgaggcaggaggatcgcttgaggccaagagtttgcaccagccttggcaatatagtgagatcccatttttatttttatttttttaaatagccaagcatggtggtgtgtgcctaaagtcctagctactcaggaggctgaggtgggaggatcatttaagcccaggagcttaaagctgcagggagctatggtcgtgccactgtagtccaacctgtgcaacagagcaagactctgtctcttaaaaaaagataaaggaaaaaaaaaaaaagcccttgcctcacaggctttactttgatcaacaatgctttggaaaaagactagtattcatttaagattgagctgagtccttagtaaaaatcaaatgaaaaaacaaatggatttttcctatcgttgtttgagttttagataggatactcaaaattcacatcctagttgtagtctcattgcacttgagcaaagaatgatgagaaatactaccaaaccacatattggtaattgagatatttaggacagagcctcacacaagtgttgtattgtatggtaggaatcatttcgtgtgactgaaacatcactcttccgcgttaaggtgagaacacaacagacgattcactatgactagcgttagagcttagtgaaggcttcttttctcttcattatgcatttttaaagttgataaaatttgtgccatttgtgccaataatttgaacagggcattcagcatccattttttgtctaaagagagaagactttcttccctaatttgaaaagtttggattagtttttcacactgaaaaatctatatttagtctaggatgtcagatgactttttaactgaatccctggaattgtctcccagcatctctgggaccgaggccatcgtgtggctgatgtagaccaaggtctgctgaagaaagctgctcatactctacctgacttgcagtgcagaatgggacaggaggtctcacaaaattaaaccaaggaaaaggagttacaacttatctctagatgtttgtgtaaactggctattcaatgttgctagcctgctaatagtcaggagtatctgaacaagtggctaattcttctctcccttttatttctggagattttaatgtcatgtaggcataaaaccagagtaccattgacaactctaacttgtttcaacctttcttggaattttctcatcagcattgtcttgggcccatgctttgttcttcagagactggactcttgttttattagcctgacattttgttttgacctctgttgacaccttctgccctccggcgtgcactctgtttagtagcttcttttatttataactaatgctcttctgctcgactcagacaaactcattgatttgcaatctggtcacacttgcattgctctatctaatataaaatcttttctttttctcgagcatctctctttttgccatgacatttattcagcttcttgcattttcattttgctttcactcctattctgattacagattaaaaatgtctgcattataccagcggggaaaagctattccagttcagagagatcactgcgaagcataccttacatctttaaaggactttatgatttcacagagcatcttcacacacacaatatcttacttgatcctcacaacaaccctgtgaggtaggtgttaacatgttcattatacaagagtgggaataaaaatgctgagatacacagaggcataccatctagagttctactagaatcttaatagtatgaatcttgggtctgtgtgttaaaacgtaaaggaaagaagagttgtgaaaatgtagtctgttgatcagtagagagaaaccaaaaatataacatgtaatcccataagagatttttagaacaaaagaatattggtattctttttcatgatcaaaatatttttgtttgaaatgaccaggtaatacatgaaaagttttatttttggtttaaatgggttggataaattgcccaagctcgactacacttcaaaacttaaaaaaaaaaaaaaaaaaaaaaaaaaaatatatatatatatatatatatatatatatatatatatatatatatatatgctgtaatttggaaaataagaagatgagaaggtaaaataagaatcaatttttaaaaaatattctaaggaattaaaatttttttatctcctctgcatacctatccagccctgttcctcccccagtatagcttagatgtattgtaattgcttgttcatttgtctacatctcttagggacaattagctctgtaaaaccagagacaattatctcttattagctgttatgtccagctcatggaggtacataatggacatgtgaattaatgattgaatgaatggattttcttctatgacatccctatctctggttgagaataatgtttgaatataaagaactctcatattatcaatactcatgacagttctcctagaacccaataaattaaattgtgttctagactctaggtgaatgcgtgtagtccagcctgtgcaatagaacaaggctctgtctcttaaaacaagaaaaagaaaaaaaaaaagcccttgactcagtctttactttgatcaaaaatgctttggaaagagaccagtattcattgaagattgagctgattcctcagtaaaaatcaaatgaaaaacaaatggatttttcctatcattgtatgagttttagatgggatacttaaaatttacaccctagttgtagtctcattgcgcatgagcaaagcatggcgagaaatactaccaaaccacatattggtaattgagatatttaggacagagcctcacacaagtgttatattgtatggtaggaatcgctttgcttgactgaaacatcactcttccaagttagggtgagaacacagcagttctcctagaacccaataaattaaattgggttcaagactctaggtcaatgggtggcagagaactgaggactggttggagcagccctccagtccgtgcatgagaggtgtccaggctgggggtgataggggagagaggtgatggtggagtaattggagtaagaagaggtatgagcatgggagcagaggcccaaacagcaccagggaccaggagagaaggccatgtggaagtcaggtacaacacgggaaccaaagtcatttggaggagtcacaaaaggatcttggaagtcagttgtgcagatgacttgtccagaggtgaagggccttttaatgagatggtagcagaggatgtcccgcccaacccacctgatcttaagagggccctgccctaatatgatcagtgagttgtactggtcctgacacatatataaaggaggaaattaattatttttaacatattttcagaaagccttacaaaattttaaagatgcatatgaaaacattcaatataaattttcacataccaccattaactacagatgtggggaatcaggcactttcatacagaataaattggtacaagcttttagcagccatttacaataattcatcaaatggtaaaatgtatgtaacctttgaaccattgattctacttctagcaaattccctattaaaaagtattcccacaagattacatgtgagagtgttgaatgtagcattgtttattaaagtctgaccaaagcaaacaaaaatcatttagtgttcaggactagaggagtgaatggctatattatggtgattatggtgtagctgaataatagaataatgtgtagccattgagagaaaagaggtagtgacatatataatgatatggacagatgactgacatattaacataagcgaaaagcagaatataccacattagatgtttatgtatatcattctttgtttttaaagcattatgcagttgttatatactctgcatgaggagggagggcatggtggagaatgcagaggctgtatacaaacatctctcttactccttcctcaaagaaagcatgtgcataaactccaaaatagccatgaaaatactgtaactgaaaacatttctgaacatatctgaagaaaatgttcaaagcatttgataaccttaggtaatggaagacagtggggtgctgtttgcagtgtaaaaataaaaaaaaaatagtttcttatttgcaaaacttgactaaagtcaatgttaagaagctcagagaaagcctcaggaaaaggagataaaaacaaaagataaaataaaggcagagataaagataacataaggataagaaggagaactttttaagaggaactcagctgaaagtaaatggagtgaaaaggagaaagaaagaagtaagtcgagtaaaaagtacacagcaggtgggccaggcttggtggctcatgcctgtaatcccagcactttgggaggctgaggtgggcagatcatgaggtcaggggatcgagaccagcctggtcaaaatggtgaaaccccgtatctactaaataacaaaaattagctgggtgtggtggcatgtgcctgtaatcccagctactcaggaggctgaggtgggagaagaatcatttcaacccgggaggtggaggttgcagtgagccgagatggtgccactgcactccatcctggcgacagagcgagactccatctcaaaacaaacaaacaaacaaacaaaaaaacaaaaaagtatacagcattcaaaagtgaccacattaaagaacgaatggatagaatggagaaaagacagacagattaatgtttctattgttttaatataacagtaatactcattaagtaacactaaagtactccgaagacacacaatactctgttgtactttgaaagcatcatgattacactaatgactactctaatggctggtattcacaaccatgccctactttgtctaaatatgtcatacctacacaatattaggttaaaataattaggttttgtagggcagataaattgctactgtatatttctagataatgattacaaataaaaactgccagattttggtacataaaaggatttgccattatctgcctaaaacagacccctgatgattaaatatgatcaccctgtttgtgttacctatcccatggacacacagacacacacacacatcacatgtagtttctactgggaatacagagggagggaggagccttctgattctgagaagttaagtggggattccacactcctcttcataatcctttcattatatcagtatacattcagcctagacacaacaattgacttacagcatggcaaatagaagacatctcatctaatatttagtatttaaggtccaattaacaggttgtgtatattgcaacatgaggtcggcagtagattgacaaatattcttgttgtgaaatctattctgttgtaggtttaaaggtttagaacatggaataccacatttcaagtttttagaaaaataaacgaagagccccagacatcagatagttaatttttcagggttcttaaactgtccaaattcttatatttaaggtttcatttagtaaggaaggaggttgtaattgtttctatgcataagcttgattttcccttagtggatagaaattgacttgaaaattgaacaattttctttgtggaatttttagaaaatagtattcatcacaaaaacaaaagacaaatggataatgagattgaaagagttgtataatataatctatttgttttaccccaattagcatgcttatttgtagaaaattatgtttggcttccatagagtctgtatggatctgtgctgaagttgcgaacatttgcctcaagcccagatctctagtatcacagacttacttattacaagaattcacacagaaaacaaaatactatatacttacttaatgtgtttccactccccttttcccctttctggccttttggtccagaatttccttgagaaaagaagaaaaatatttgtttttaatcagggcaattcacaatgtttgctttaactggagacagatcatcacaaggtaattaaaatataatagaatggacagatattgaaatgtataataacattgtataatgttaacaataataatagttattacttaggaagctccattctgaactcaatattgtgatatttcaaattatttacaaggccctaaatgccccattttcctaaatcaagcaaagctgaagaataaggagtttgttttgtacttatttatcctccttttctcctcttcctttgactgggtcttactcacacccccaggaagtccagtgccttccatgagctcccacatcccgttcttatattcacattacatttatggttttcatttctttagagtgtaccatccccaaaaactgggctgccaatgactttctgggagtgttgagattcttactcatggggaaggtaggaagatccttggagcgttcacatctccaggatgatcacctttggttttgagaaacctcacccatttatacaggggtgtggtacaaatatttcatatgagggtcagggcttcaaatggatgcagaaacattgctagatctttttttttgccaacggattgctacttcacccactgtcccatttttaaaggggtgtgcaggagatctttctttagtaccaagaaatctcttaagattggtgctgttcctgcttattgagttttttttccaacagccatgagatacaatcagatcttcaagtaattactaccttgacataaatctagaactgatcctagtgctctctgtctcaaagtcaaaacctttgttaatgtttttgattccctccagcaaaactgagaaccttcaaccttttcatcctagagctcagaggatgtagtttaacaaccatagacttcaaaataataatagtaataatttagaaacccctgtgttgagttattttgctctgctacttactgggtatgtgacttgggacaagtctttaaatctttctgagctaaagtttattcttctataaaataaaaaaataacgcttttcattgtagagttgcctgttcattaagcactttgcccataaaagatacacataaaagatctagttcttcttattcctattcttcacctcctaaagcttagctggaatcttctctttgtgattttattctcagagaatgagagaaaaactttttcatcgcagttcattttatatggtacaattatatataattttagtgtttatatttatttttgatttctctagtttacattgtcttcatctgtgctttattttgaacatgtgtcattatgtatttcttagagaagattttggatcctaatttaccagctaaaaaaatacatatatataatgtaacatatacaatcagtagcatgagacttgaggcacttaaagagtaaacattattcccaattgaaattgtattttgaagatttaatgaaatgccaaccattttatatcaggtcataatatcaaatttctaattctctaattgctttgcataatgtgattatactttatatcattaaattcatttcttaattgtaattgagttgtttcaggtactgctaaattggcaaaaattgttgctaccacaaagcacccaaaacctttcctatattttgagagcatgctttaataaaatatagtgccaaattttcagattgtccaagaggaaaaagctctaagaaattgttaaaaattagggaagggaggagttaaaacaaagttctaactcttttcataaaagagaacataataagcaagcttaatttcattatttcaacattaacttcacaatgagaaaagagaaagaaactatgcattgttcttagaagtcttttcacacagcaacttgtcttagatatttcagaatagacatgcttaagccagagacatgcttgacccacgaaaggtccttgtagctctcagattctatgataaataaaaaattagtttcatgtttttattttgcctttgttcttataccactgtgacttttccttttaaagatggtaaaataaaatgccttatctccttataaaaaaacaaacaaatgttttgtatcattttaacatgattcagagatttgcttaccgatgatacttgaaaatcttttctcacacttgaaaacagcaaaaatatcctttctaatggagaggaatgtagtggtccttcagaatgatacctttggttaaaaatgaatgcaagggcttggtccaaacctagagttaactatctcctatcctatgtattactctttaataaaaagtaacttatatttctaaaagccattcaaaagtaagaaccaggtcatatgtaggaggatattctaacttgaaaggatgtaagagggggtgtcttcaataacatcatcatgatttcaagcattttttgtgagcctcttatatgagccggatactaggttagacatttctgcttacatgccttaattacactaaccaaatttctgcagctgtaggccgcctttccatcccccgtttctttcaagctactttcaaatgtgatcatcctctctcctaagccttgtgcttcttcctggtccctgaattcctcaccttataaccactcattaaccttacactatcttttttgctttgctttcctctgtcttcagccactcctcctctattttatctttccataagcatttaagtggtactcagatccttccttcaaagaaaaaaaaaaccatatgaaacaaacaaaactaacaaaaaatgcatctcttcctcctcctctgcatagtgaggcagcttgagagttgagtctaccacatctccaacccttatcaaccattcccttctccgcataccctaatctggttatcaccccaccccacagaatctgctctgaacaatggcaacatccccacagcagcaggtgcaaagggctttttgtagacttcaccttacttgaccacctttgaaactctgtgtttgccttttttcatgctctgttctctgggttttcttcttcagttgggctacttctcttccatttgctactttgttcatctcagcctgtacttctggaactacttaaagctttatgctatgccccttctctttgtacctttccactctctacccataaaatattattaaaatcagtggttctgaataatatttatataatcatagataaactttgtcttttaatctctggcctctactcgaaacttcagactcatgtgttcaaccgtctgtagatagctccatgaatcacagagagaaaatgttcagtaaacgtgttgaattaataaatgaactacatatggtgtaatattttagataatcctgaaaatgaccataacttaccctgagggaaacaataagtctttgaatggacttcaagaggcaaaacagacagaagtacgttatttgcatgctgaaagttctactatgttgaacaaggtagaacagaaccttctacggattttgaagacgggcaaggtttcacatcaattaaatcctccaaactttctgaagtaaatatatcaggtcttataaatggactactctatagatctgctatgcatggagaaagtgtgaagtcttctctttctcttctcatgtttgtgtatcttttcagttgtagactgtcttattcacccttcatttccctgtttctagcactgtacccttacgagcagtgtgtacttaatccatgtagaaggaaagggcaaggtgagaagaaaaggagtgtgggagggagaatagaagaaaatagatggaggatgttctttttgaactttttgcttcagaatctgataatgtttttgatatcattcacatagtccaggctgtgaaaaaattacaactcaagcaatgtaaagtatcaaagagtgtttatatcacaaattggggtcttagctctgaaatatattactttatctatcacggacctgtttttacttatttcatatttgacaattatcggacttatttctaattttagcaccttcttcagactcttgtagaggagagactgtactgttccttcttttagtctgcagtacaactagaacagcacctggcactgctgctgacatctctaccagattggtgtcttttaataagaagtgatgtcctaaggatatgttttgtcaagggacttattacctctgccgttgtttttctttgtgcgtgattactctttctgcactgtttttttccacctaaacataatggttttcaaaatgtggtccctggaccaatagcatcaccgtcacctggacattggtgaggatgcaagcccaatcccagacctactgcatcagaaactctggggtggagtcctgtaagctgttttaacacatcctcctggtgattccaacacctacaatagttttagaaatacaaacctaaagaaattctaggcctcttttagtccagcgctaacaaacactactttctatctaacacattttcttacagtatggaattaatcactccttactctctacttccatacagcaatttgtccaacctcaccaaggttgtttacttaccacatggcattatagctaattgcttatgcattttttttctgtatccagctccttaagaaaagcagctgtgctgtatttatctccagcacacagtgacccctcatcaagttgtgtgaactgggtgaatgaatgaaataatactctccaaagctaaacataggtttaccatttgatccaacaatcacactcttaggtaaactcctgtccacagaaaagccagcacattaatgtttatagctgctttacgtagaatttctaaaacttttttttttgagtcagggtctcactgttacccaggctggagtgcagtggcatgatcttggttcattgcaacctctgcctcctgggttcaagtgatcctcccacctcagcctcctgaataggatgccaccatgcctggctaatttttgtatcttttggtagagacacggtttcaccaggttggccaggctggtcttgaactgatgacctcaagtgatccgcccacctcagtgatctgcctgccttggcctccaaaagtgctacgattacaggtgtgagccaccacgcccagcctaaaactttgaagcaaccaaagcgtccttcagtagttgaatggataaacaaattgtggtaaatccataaaatggaatactattgagtaataaaaagaaatgagcaatcagaccatggaaagatatagagaaaccttacattcatattgctaagtgaaagaagccagtctgacaaggccacatactgtctgactccaactatatgacattctggaaaaggcaaaactatggagtcagtaaaaagatcagcagctgccaagagattgtggtggggaggaatagagttggtggagcacaggggacctttagggcagtgaaactattctgtctaatactgtaatgatggatacatgacattatacatctgctgaaacacataaaatgtacaacagaaagagtggccactaatgtacattatagattttgggtaataatatgtcagtgttggtttattaatggttacatatataccacactaatgcaagatgttaatagtagaggagaccatgtgtgcatgggtggtttatgggaactctctatgctttctgtgcagtttttctataaatgtaaaactgttctaaaaataaaatgtagtttaaaaatacctcaatgatagggaccctattccttttttttctttttcttatttttttagagacagggcctcactatgttgctcaggctcgtctcaaactcctgagctaagcaatcctcccacctcagcgtctcaaatagctgggactacaggtactcacctctgcacttggcccgactctattctcttgatgataattcactttgaaatgaggagacagtaagcctagctctttctaagattgctgttcaaagtttgcaatttaagcttaggctactggcagagctgatggaaataatatcatcatgtgtgtacatttcaaaatgctgagcaaccttgattcttaagcactagtagataatggcagacaatttattttgcagaggataggatttcagacttctctgtattttgctaacagtaacttcacaaagtctggccagttgtggttaaacgggtatttacactttgcttctttttttttctttgccagtctttcaactctctttgttcaaagacggatatcattgttagtgatgatttatgattgtgaggagtttataactcctgtgtgtttttttaaacgattttcctttgggatatagagactttcctcgggtgaacagaagtcagtttcaaaaatctgatttcagaaatcatttctagaccacaaaataactgcatgtgaatactagtattcacacaatgaccactttttatcatccaagaatttaaaaatatgtatactacatatataacattatgtgtgtgtgtatgtgtgtgtgtgtatatatatatatatatatatatatatatataaaattatctggtgtttcttctacatattctataaagaaaatacacattattgtaatacctggccttccggcatatcctgggagtcctcgacttccaggaaagccaattgctccccgatcacctttaagacccggaggacctacattattaacgaagaaaaaaagaaggtaataattcattttcatacagacttgagagtataatgaaaacatctagttttataagtgaatatgaaattagagaatcttcaaatgaaggaataatatctttcctaaaatttaatgtttgacattgaaaaacaatagaagcgataaatataaaccttagtacattcagcacattgtagctattcaataaataacatattgttggtagaaataaaagcacattaggaaaaatagatcttggagttttaaccaaaagacttatgtagtcaaccagtaatcatcaaatggcaggatcttgctgtagctgaaataataactttaaaatgcataagctgaaaattgaattcttaagatttgccttagaaaaaaatgcaactcaagcaatgtaaagtatcaacgagtgttttataaaataaattggtgtcttggctctgaaatatattactttatctatcatggacctgttcttacatatttcattgtaatcccagggtaaataaacataaacataaacacacacacacacacacacacacacacacacacatgcgatacacagatttacttatgagtatgtactatatacttacacaaatccagggtttcatatgcttaaatgaaaactgaaaatggctattttttttacccaatattactatggtgatcataacaactgtatataaaagaaaatgttatattccagtgaaataaaatattttatcctagagttcagtagttcttgataaactattgtaacagtttaggcatcttattttgtcattatcaattcagagagaactcgttcacccagtctcacttgatcccatggcagagaatgccatgttgcctgctttagacaggagcatcttggggccataagagcatcagagaagcccctccaatgctgacttctcaagtacctcacagtgatgctcagaacacagctgttcaactaaaaatcaaggatgttcaactacaaatcaagtacattttcaatgaatgaacaaataactctgtaaatgaagcatatgagatactttcatagaaatcaggcagtcatagacctctgttcttggagatggttaagcagactctatatggcctatggagttatgtgacttgtttgtttaatgatggttcaaaatgtagtccccaaaatgtaagcacagctgttgaactttattccataagatcagataccctgaggctttcaggaggcaattaactaattttctacaataatctgtggcaatgggaaagggtctggcacctgcttctaactcatggacaatataagtacagttacatggaatctcagccatgggatgttcaaagagacgttagacatcatcaagtcagaatccatcattttagagacagttccatgagaccagagtgatcaaatcacttacataaagctggtctgataattattcacatgtcctaggtgtcctgctccattcaggctccttcctgcaaagtagcagactggttaagggcatggactctgcactcatgcccattggggttcaaataccagctttgccacttaccagttgctgattgacctcaagcaagtcatttaactttactgtgcattgcacctgtaaaatgggtgtattatttgtttctgcatcatcaggctgatgtgatagttaaaagagctcatacacgtaaaacacttagaaaagtgcctggcatgtaatgactactttgtaaatgttagcttttcttgttctcctccccctcttcctcatcctcctcctcagtaatacaatcattatttttaccagcctgttgtaaaggcttctaaatttagttttattaaatgatacgtacacagttagcagtgacattttttgattcactggcacaatttgttacttccagaaaaaacccactttcaatactcaggtgtagagcgacagcctgcagccaggcaacattccttactcaggtgtatatttaaggatcctgtccttgctgaagctttagggaggggccttcttggggccatagcctatgggaaggggcgggccagggtaaagatatacgtggatataaacattaataaaatatggttcctctcttccaatatctatgggtaagatgagctttattttctcttctggaagcacgattcctatggtggaaaattcagactacgtaaggaagtaaatagtactggttgatgatgaaaagtttgcagccagagaagccttcagttctctcgagggcatctcatgtaggtagccccacccatgcctacaggtcaaactaccttgttattgatcacattgggcataaacagcttcttagatggcccacacaaagtttcctttagaaaagaaagttgcttctccttcaaaacattgttgtcatgggtaaaatcagccccttaaaagaaactcacatgagataaaaaatccttgatcatgacatttgcctcccttatattactacttatcatcctggaagcgctgtgaattcagagattctgtatctgtttacacatactctatagggtattgtagaacaccaggcctggagaaagtgctcagcacatagtttttgagtgaaaagtgataggtcattctccctagcatgctttcaaggaaatagccctctaaaataaatttgttattatttggggaataaagcatatttaaacataatatccaccctagtatatgaataataattctactatatttaatgtattagttatttgaggctactaggacaaccacttaggttttgcagatattcgcatcatgattgtgagtctaggtgagtttgacttggtcaagctgagtttagtaggctcaaatggatgtagagatggggaagcaataaacctgctcagattagaaagcagaattagtatgattgtccatcatatactctttgcttcctgatttcggcatcaaatataaggcaattagacaatctggtggagaaacgaacagaatgcagcaagacatccagaaataattcattaggaaagatgcctggtattttgaatacttttcttgtagtgcaccaaacaaaatggtaacctgataacctagaagagtcattgattaccccaggaactcgacctgtcttttatgaggaactgggtaatgcctatttgtgtaaatgagcagtaccaaaagcaacaaattatgacatcactttttaccctgtaaatttaaaccatgacaaatcgttaatttacaataaaaaaaaaacaaaatcaaagattctttgcaatggtgtctatttataacattaacacaagctgaaatttataaatccttctatttcatacattcacagttcagaaacagctgcagaagattctcccaagatgaagcactgtatggcaagatgtagcccagactgaatttttatggttgagttataaagctctgacaattgcagcctgtatggagggggtgatagacccttgacaatggtagttctggcagcagatttaatactggttatttcctctgcttatgacattaatgcagcattgttaatatctgattagcattagtcaagtagaaagactttcctgaataaaaattctttcctggcaaggcattcaaaagcacatcaatactaataccacctgacttggcatattatatatatgggtaggattgctattttatatatataaaacatgtgtacctggatgtatatcatctatcttcacatataatatgccatatatatttatatacatatatatacatatatgtgcttaggcaggtatcaagttcatgcttctcattttcaaaaatttttctgatgtgaccagggctagtcaatacactgatcagaaagaagaaccttttatataatcaaaagacagaaaaataagatgaagtacatggtatttagacatgttttggtaacacaaaccattctacttataattagaccttgcagtatacttcctaccatcaaacggcatgcaggatatttgatttcaagccaaggctaacatgacaatcatgttattatcttttttattttttcaagcaaagaaagttcatgttctctcttctgtgtcttctttcaaaatatttctttcaagattacaacttagaggaaaataatttgaaacagttttgctcttagtaaagcacagagagtgactgtcagcaaggtaagtgtcatccatattttagccaatatttacattcagatttcattagtttaaacagatatattccaaatactatataagaaatatagtccaatttgcttgtgattcataactcactactagtgtgagtttttatgtcttaaaaatgagatagcttgcaaatgtgaagatgatttattcaacgcaaagataattgttgtactccccttcacatatgatctacggttaggtctgccttatactgtttgctgtctattatatacatgtcactatctagacttacaaacaattccatttggttactctggttaaagcatttattttcttcaacagtcatgagtaatgcttatcattcagtgtattatgtgattaggctactagaacatttactaatcccccaaaacacacacacatatacacacatgtgcgtgcatacacacacacacacacatacacatcctctgcaggatataaataaaatagcaatcctcccctacacatgtacctggatgtatatcatctatcttcacagtatatgattaaatagctaaaattaccatacctattggacctggaaatcctcgtggaccactttctccagtgggacctcgatctcctttttcacccgggggtccaggaggacctttaaaaaaattacagttactgatcatagttgtaaagcataggaaaaatgggttagtcatctgtcaaggtacttatataaggaaatccaaagtcttctatttgttgtgcaataatatagaatgtataatactgaacttcatgaatggaggagtattctgctattcaggaatataatgccctatactaatgaggatgacattgcctcaaagtaaacaacctaacagtatattaaatgtgagtgtgcctaacacttttctatgttctgagaacctgggggcagagaaaagacagcaggctggcacaaagtcacattagtgttgtacgcatcctaggcagttagacatagagttagatataatacagaattagctactatacggaaaatctataagtaagaacttaaaagacatttgtgataccctcaagggaaaggaaaattcacacatggtagacaaccagaaagcactttgttggaactgaccataaactcagatatttgtcagtgaactgtagatcggcgtgaatggtgatggttgaagtcttcattgagaaagtaggatatgaggggtactttcaagaatgaagggaaggggaaggaagacaattcctagggattgagaaaggcatgaggaaaggcaggaaggtgaaaatgagtagaggaattcttttttcaagtaaaatattaagtagaatttctaggttgctataaatactgtaaacaaaatggagacattgcaaggaaaactttggtctcatcattttttttcaggtggctctcctgagagctgtaactaaacaaccctgatttagccatttgtattttctgtgtccagcaaaacagatacctgctcatcatgcctttaaaatgattatacctagcatgtctttagaactcaaaggtaatcctacctaaacaccatgttccatatggagtacagaggacaaataatctcttctttatctaaagaagagcacttagtttccttttcaacaccagaagaaagaaacagaaagaaacattattccatagattcaccacagaataaggaaatagtgatattttaaaggaagcattttcaattgctagtttggacacatacatagtccaaggaaaacaaatatatacagcatccctggttagaatgcacttgtttacaaattttaatcaggtgggagacataatacccgaagaaatctaagagggggaaccacataaataaataaagattatctcatgaataagtatattttgtacattttgttgttgcttattttgacatccttgactctacttctgtctattcctctggtatgtcccattttcaaggtacaatttgggttttagaggcccaagatatcattattactcttctcaatagaatgtccctttctcctcatatgcaacattggacacacatttaattgtatttttattataaaagcaactctacttataggaaacataaaagcctagaaaaagcgtgaggaagaatataattcgtagttgtgttattttaactaaagatctttaccatttctttcctaagtgtgtacgtgtattttttttttccacataatcgtcatgcaaacaacatgttacagggcttttagaaattaactggtgtattatattctaaggtatagcttaattgctgcgagacatatatttaaatgctgcacaagaaatgtaagatttctgtatcaaagggaatctctatgtgccccctattccctgcagaagaatgtagtacttcccaagaaaatggagttatggtaacttccataaccatgaacgcagctgcatccattcaacactacatagcaatgaatcccaggggaggggggcaagcaggacagacactcaatttatgcctgaattttgttgagctaattgaagggaagcacagggatagtaatcaaggatggtattttgaaaaaagtgcgcaagcaaagatttcagtttagtaactcaggatccaaagcaagacgcagacattccaggaaaaactagaacatgaaacaagaagaaacaagggacacagagaatagatctagactcttagcctctgagatggacttctcaccatttctttggtaagtaagagatggaaggaactctcctaattactaactatcctttcaattatattacatgtaattatgggaactgtatacttaattttggagtattagttcaatcacagcgaatagatcagtattattttacaaaatttggagttaaagatccctctctgtatttttatataaaaatactgatacctggtattcgaatcctacaataagaaaaacaggtaaagatttttgttagagttctaactaggcatgttgaatgtacctttttattgtcattctattcttcatgtaacattaatctcacattatgtttcatttttgtacattgttatagatcttttactgtttctaacaaaatgttggaaggatctcaataaatgttttaagtgtcttttagattcattgggggaataaaataacaaattatataccactttactcttagtttctgatgcagaacttttaagaacactatccactaccttgccaccttccaaaactagcctcctctccattcccattgtagctcacgtcttcaccatcacacagctggactattgctagagatttttaatctagtctgaatgtgttttatctgtttcacctcctagttccctcagtgttggctttcttcttctttttgataagaatccgttttgcaatgtctctatcaaattaaggaaatgcagtaacctattctgtcatattatggaaaaaagaataaagacttagagtctcttgtagtcaccttttgttcgtagtttccatttagtcttttcaaaattttgttccatactgacataataactgcctcgttgcatcaataaatggacaaaatgctacctgtcagctcccttgctgatacatgtcaaaaaaaatgggttaatattggccaaaatatatgatttattctagttcaagaagccatagaatttacattatttttcatctttaatatttccaattacagttacaggaataattcataaatactatcacaataatctgccatgaagaattacctttatacaacacatgcacaaaatctactatgtagcttcctccatgattacttcttaaaaaggaaaagtaatatttctatataaccacaaaaaagtactgatatataatatttgataatcatcaatatcatagaacaaaattacacaatttactagaaaaacaaacccaggtgtatcatatcatttaaaatcctcagacgataacatagcactaataatatctgactaagtttccagagcgatgcttctctagtttttattcattatgagcattaatcttctactccgttttcaatcttgtctcatattcagatcatcataaaaatctgccacatcttctagtctattgctgcctaaacctgcttcttttttttttctctagttttcatgctcattgatttagatatgtttaatctggaagacactttaaacattgtttaactaaacatatttatagagggtcagagagtgagttgctcaaggtcttaaagctagttgggttaaatcagaactagaagaatttcatttctttcctgatcctatgctaccatgttctaaatttaattgacttcattttccacatctgttcttccattattcctcagctgaatttttcctttacatagtggttagacaaactcacaattcagtttttttcctttggttaatttttttttttttttttttttcagagatagggtcttgctactttgcctaggctggtcttgaacttctgggctcaaaaggccctcatgtctcactctcctgaagtgctggaattatattgtctcagcctcccaaagcgctgggattacaggcatgagccaccacttctagcctacagtccagctgttacaatctcagtaattaattatacaaaactccaaattcaaatgccctcagttgctttttcattttctctactataaaaatcaatatttcttttttggtgctttcatatcctaggaagccaatatatctaaaatgtttccaaataaacaaaatgttagctattctcaccacagagtcatattatattttatttctcttaaatacctttctctagagttcatctttgcttctttaaatcacgttatccccaactctccaccaaactctacttcaccatttccacaatgaaattttatgtagttctttaaggctctaattattataactatttgagaaatgtattaaaaaatctttgtctcttttaactgtataattatttagtgattattaatataagggaaaagagaacacaaagtaattacactaactctgcaatcaacacatgataaaggataaagcactcattaatttctaaaatatggttcttaagttataatttaattaatagatattttatggctaggtgctataagagatataaagaacagtttctaatggaagtagcttgtgtccaggaagagtgaacactgttctcgaagagaatatgagatacttttatacataactatcacattaagtattctcttgtgagagaatacttaatgttccatattaagacagaaataagtatcagctgggccttactattggtagaaccagcaaaggcttcatgcaagaggtggcatcttagatggactttgaatgataaacaagatatcttcgaatacaaatcaaagagaaaatatttcaaataaaggaaaagacatgaggcaggatgcacaaagtactgggtacattagaatcacagtcaaattagttgaaatatttgatatacaaaaaagacaagcgagggaatgaagcattcaagactagttaagagacacactgaaaaagaccttgagtgctacaggcaaaactgtatgtctaatgacggggcaacagagagtctttatgcaatctaagacttcctttaggaaggctgtattctacaagggtgcaaaaaggattacagtctgggcaggaaacaattgcaactctggcaaagagtcataagaataatttatacgaggatataaagaaatgacaaaggaacagagaatacagaatgttgagaactaatggtggtcttgggagatataaaataattaaaattgatagcttggaaaccaggaagaatgacactgctattatagagtgtaacttgctaagacaaaagtcttagtttcacttattcactcaacacatatgtaattgctcacccactattttccaggcactctaacaggcattgggattgcagaggtagacaaggaggagaagacttaacctcacagagctcacattctgctggagaagatacaagctaaacaagtaagcaaatgtagagatgacatgatttcatatagtggtaaaaactatgaggaaattaaagcaaatcatggtagagagagatgggggagtttagaataagaatggtggaaagtggaggaggtaacttcaagtggagccaagaaggagtagagacgtagagaagaacctttcaagagaaagagaaaatgtctagtgttcattatggacagcatgaaatgaaacaagcactttttctatattaacttttacttgttcgtggcacttcattcttccacatttccaagctaggcagaaggatgacagagggaagattgagaaaattagggcagagaagtagacaggtgacagaccaagtagaagtttagattttatcccaagactaatgagaagacattggaggatttaagcaagagagagaaaagacacatctagtgtaaagagagaaaccacacacatccagtaatttgtgtgggttttcttaaatagcatttttttttttttttttttgctatttagaatggactaagagcagagccagggacaccaactgagaagcggatgtaatacaccagactgggatatggttgcttgaattagagtagtagtagagagtaagaagaagtttggtttgagatattgtatgaaataagaattagtaggacttacaaatggattacatagagaatgagagcaaggaagtcaaagacagcttccaagatcaggcagtgagcaggtagttggaaaatgacaaaaccaacaaaaagactgaaaacgcaacagatttggggaggcagatgcgggtggctagttaagaagcaaggatttggttttgaatttgtaaagcttcggacatttatttgaaatccaaagtggaggtatctaactgttagagaaaaatctgattaattcaaatttttctttatcatctgttttattgtgataaatactatatatgatatgtgttctgtataagcaagctataaagtacaacaataatgagaatacccttgcaacatcacaatccaagaaatcggtatctacctagatgttcccctatctcattcatctatttccttttcatagataaatattaccctgaattttgtgtttatcattttcttaaattttaaaacaatgattatattacatatttatgtgtctgtaaatttacataattttactaactatgagcattagaagtaaaaattgtctatatatagttttctgggacttgtttttattctttttttcattgtcatcacttgattattaggcttcttaattttctcaaactagtgtatttgaaatgaagtcacatgaagttcttagttctatttttctagttgctaatgatataaaatgagacaaaatattaaaatcatgaaatagagcttaacagacatggaagctggaatgagaacatccaatatgaatttcatgtaagttacagaggaaaggagagaaagaatcgtgaagaagcaatagtcaaagtgaatgaagctggttatattcccaaactgatagacataaatccactaatataagaagtacagcaaatgttagatggataaattatcaatacaaaaccacagataagtaaaactgcagatatgaaagacaaagagaatgacaaacagattggtggcagtcattttaagagccacaagaaaagcttgaagccaggggaccaattttttcagcacactgatagaaggaatcaaaataactgtcaacctaataagtgtgtatatagtaaaacaatttcaaagatcaagtcaaaatagagaaaatgaaatcagaaggtttcttgatcaatttactttcactaaatgaacttccaaaagatatacttcaggcagaaggaaaataatcccagaagaaatgcccgaggtgcttttagaacggagaacaattggtaaattcatgcgcaaatttaaataaatatttgttgtgggtgagcgatgactatctgagccagtggtgcagggttaaataatttaccaagatggttgtagataaagaaaggcagatttattaacaaaagcaggaaaatacgttgcaaggaggcaatgagcaggccagcagaagagaaactgattgccaggaaacaaaggtttgctgaagattttatagaatagtgtttataacgtatgctgaagagagcttgtgcagtactgataaaccaaggttagagtgggttaacttgcaggtatctggtgacaagtttcttgcaggagggacctacatgttctggaccaagaagaaaggcagatttatagcttatcttctttctctttgctttccctggtcctaccagcctgactacttttccctaattaaggctccacaagattgtctgtataaaaaaagaaaaataatattgactaagttctcgattaaaaaaaaataaagtagaataaactgtactaaaatattagcaggaaactagggaagaggatcatcaaagcactttcagttccttgtgtattttaggatgaatgttaagatactgatcaactttagacttcaagataaatgttaaggtcaacaatcaataagaaatagaaatatactacaaagtttctgaaacctgtttggtaattttggtagagagaaaaattcagcaagagaaaaatcttaatcaatccaaaagtggcaatacagcaaagcaaaagaaacataaaataaactggaaaaaaccagagcacatgataagatagtggaaataaatacagtgcaaagagatggtcagattgtatatttttttaaaagaaaaggtaagtattcattacaagagactaacctaaaacaaagaataccaacaggcaaaaggttgcaatcaaaatatagaaaaatacatgcaaatggttgaaatcaaaatatagaaaatcaaaatcaaaatatagaaatcaaaaaatcaaaatatagaaaaaatctataatgtaaagctaaaactaaaatatctaaaatgtaaagctaaaactgaaagcctatatatataaagaaagcatatatacatatattttatttatatatataagtaagatccaattcaccttatttcactaacaggcactgcagaagaaatggacaaatccatcattattttggagagttcaaaagatccttttaattaataatacagtcaagtaagaaataaaaaagactggaagttttggaaaagcaatattaacaagcttggtttgtgaacatgtgaagaaacttgtaattacaaaaaacttgtattcagtacttatgaggtagtttttaacaatgagaaaatcattagaccttaagatatattttgcttttccctttctatttaagtgataccaggctactggttatcgtaccctgtctttatctgattttcatattctttcctttgggtatttgcagtaaatgtaagctcagaaactatttatttcaaaccataggatttcaaatatcaaatctctgcatgtatcagtatattttaatatatatatcattttctggagaaatgacaagacattttaccttgaattaaagtgatatttctcaaggtctgagaatgttcccaatctttcagtctgagatcattagtgatgttattcagtactttcacttctccttttatttcctgttccaaatgcacttgttcttctttcatagccataatttctgctgatacattgtaaacacgctcctctaatttactgatttcctgtaaaacataagtgagcattcacagcctttgttacatacataattatcaaatatgaaagttcaagaaaccctcggagttcaggtttttaaaaacatattatgggagttttatggaataagaatatagaaattagaaaactgttttgaaagtagtaattctttaattgtgaaacatttcctcttttgactgaatggctgaatgtttacaatcacaacccccttcaaaaatcaatttaatgtatctatgatatgtttctattcctatatatatagatgtcaaaattctaacaataaaattaaataaacaccataaggtcttaatttatctgaagtaaaatgtcttcgtactgtacttacagtggcaacatagtcaaatttcgtgaatttgatagatttatattggaaattgttttatagtaataagtgaagtttaatgtcataatcctcagtggtgatgatcattgacaatagattttcatactcaataaaacctcgaactcgcatattaacagtgctttactttcagtttgcattgcctctgtatttgaggcattagtattttgtgttttcaaatacacgtatattttgtgtatatttatacatacacattcatatacttaagagtgtgaaaaagacagaggatctacctatatcctggaatatgcttttatattttactcaataatatattaaggatatttatctattaaaatactttagagactgatattttcagtaatttagtggaattgaatctatttctcaaaatttatttaggattcctattcatagtgttttgagctgtgcacttttctacaactaaacaatgctgccatgaacatcattttaaatatatttgtatattgatataagtacttctatagaacatcttcctgaagtggatttgaccaaagggactaaacattaaacagcatttttgttcaaccattgccgtactactctccaaatatatgctaccatttttcttcctcttactgcgtatcagcgtccactttttgcagctgaatactgggtaccattaatatatttaagtttgcatagtaagagtaggtacatagcaaatcattattacttaacttgtttttcaaattatagtgaggttaaagtatccagtcattaaatttctgacgattaatgtttattaatttttcttttagatcatttgcttggttttctctttcagcattgggctttttatttttgatgaaccaaatgttctcatctattctggtaataatttttgtctctctgttctacttttatcccattttctgtcttcattgtatgctttattattgtattaagtactcctatgttctaaagttgatagatactcatttccgatttgcacatggggaaataagccagtggtatgtttttctttaatccagaagtaaaaagaatattacactctcttgagctggactagactagacaagcttaggtgagaggatcaagatggtcagagtgtaggaccttcgaaaataaatgaatgtgcgtctagatttgcctcttcaatgacactatactgaagcagagagacttaccagcttttattgctctaactgtgccttctcccaaacaaaaccttattctagattagaatttctctatcttgcacctcctcctcccctgaccatttaatattttctgtacaataccatcattacaataaaggtgaaatagtgagcatggatgtttgtagggcacaccgccatgataaatacacttgacttaatttagggggctaaaaattgctgcaagtatgtcgggtagttccagacattcagcataaagtgttaagtgactagacagtgattttgcttcctagaaacgaggaatcatccaggtttttcatcatacctaaaagctgaggctactttttctttcttttttttttttttttttttttttgagacggagtctcgcactgtcacccaggctggagtgcaatggcatgatctcggctccctgcaacctccacctcctgggttcaagtggttctcccgagtagctgggattacaggtgcacactaccacacctgactaatttttttttttttaattttgtagagatggggtttcactatgttggccagactggtctcgaactcctgacctcgtggtccacccacctcggcctcccaaagtgctgggattacaggtgtgaggcactgcgcctggcagctgaggctgccttattattcccttctttgaaaactgcacatggtgtttacatttgtcaaatttcagtggaaattattttcactgggaggaggaaaagtgtatttaatttcaaaaaatcctatatagcatccacacactccctccacatgctaccaccagtgaccctcctagaaacaggcatttaattttgtagtcgtacagtccttttcacctctatggatgatgataaatgccacccctgtctttcatttggtgccaatgttcttcctctttctttcaaattaatttttggtgtgtccttgataagtgttatgctggtgtcacttataacctatttcctcaaacgccatttacaaattcaggcattcatttaatttatttattcctacattgagctaaagattcaaaggtcaataaaattattcaagcaatggggatgagcgtcccaatgttgtttttcagtgtacacaggagtacacacacacacacacacacacacacacacacatgcacgcactggcactgacctagtttctaagtctctgtgagtgactactgtttttaaagatgtatatagctttcaaactttcaccattcccttgcatttccttttctaatgctggaattccctccaaaatttaagtgtaatctatcgaaactcaaacagctcactgatcaccagattttgatcgtttccattaattatcacttcaaacaggttcaaaatttctaccaccttccagatagtttccaatttgctttcaattcctcatgtttgggttcaaaagcattcgatggtcagccaggcgcagtggttcatgcctgtaatcccagcaccttgggaggccaagacgggcagatcacctgaggccaggagttcgagatcagcctggccaacatggtgcaaactctgtctccactaaaaatacagaaattagccgggtgaggtagcacgtacctttgatcccagctacatgggaggctaaggcacgagaatcacttgaacctgggaggcagaggttgcagtgagccatgatctcaccattgcactccagcctgggcaacagagtgagactccatctcaaaaacaaacaaacaaacaaacaaacaaaaacattccatggtctctgcaggatttaatgcactgccagaatcaaatgtatccttcttcttccatctcatccaccttccctctgtccttacctcatctcagtgctcttctgaccctatttctacataaatagtatttcttctccattcttctttcccctcaacttaatcaatgtctatcctgataactaacattttcgctttctgtctttcttatattattcaaaactatggacagtttcttctttgtacactttctctaatctttctatagcccaaggctttgatatcccaataccctttgatatgcttacttattaacaatgtaggaaacactgatagattttagacgtgacatggaatagaaacggaatatcaacatgttgggatgaggttcaccaacagactccccatacaaaaactgtaataccattgtcttctgacaccttaaggtgaggaccatgtataagttcaaaagttctgagtgaaacttacaaataaaaaaaaaaatctaagcatatcaaatatgtctgttgcaaaattcacacatacagagtgttcacttctcaagatctgctaagataacctaaaaattatgattggtttaggcagtctaaaaagacattttaacagtatttataaaatatgtaaagggagtctatattcaatgggaaaaatttcccctttttctaagagtttagagaaggcgaatccattttaaatcccttaacattcgtttaaaatctggataagttagccatagaaatcagggtaaacaggatgatgaaacagggtttgcaacttttgctttcctgtactgcctaaggagacgagacttggatggattcagttccagcaagtgaccttgcagtccacaaactcttacctcttgttgtttgaaggtattctcttggattttgccattcagattttctatgttgagctgcaaatcaagcaatgtggtattcaaacttattaaggacttggagatttcatctattgcattcccatgtccctggactgaggaaaacaaggtacttagctgcagaagaatgtcattaaatctttgatcagttgtcatgctgaaattttggaaatgctctgtgtccatgaggttggcttccatgtctaaaatatgctggattctcttctccatgttgctcatgtgttccataaagacttcttgaaatctcatttcctcttcgctgtcatttccttttcccgtgagactttgagttatatcatttgcattagttgaactaactgagcaattcttcgtttcccacttcaggagttgagctgtatatttaagtaaaaataaaccagtcatggcctgatccttgaatgcatacaggatcccatcccatatcattccattccgttcattttattccattccattccaacattttgaatgctaggctaaatcgagtatttttttttaatctacaacgtgtgaactacgctacgtatattgctgagaagcatacattctccctttcctattttacgttaagatgattccaggattatatcatgctttctgaattgctgcttatatgaatcttcttggccattgattttggccttgccaattaaaaaaaaattctatagattatgaaaggctatgtgtctacagaactgctgttagaataaagtggactaatgcttaatacagtttctgaagtaagcatgttgaatatgttaacaatggcagtgataatcatgatgatgacaaaagcaataagtggtgaaatagtggtgtcatgcataatatggataaattgttggtttatcttcttcattctttcacttgagctgccagaaaagcgtcattttcagttaatacagacctaattcacagttggtggagcaggaaattgggcaaatacattttttcactttataaaggtacgattctcataagactcctttttaactattataaaatatatattcacagcagaaaatttagaaaatatacataatatggaaaaacaatttaccatgaatctcaccatcctagcttaaactctaggattttggtgtacgtgtctcaacccttatcatattattatcttaaaatatgacatttttaaacaatctggaaacaactttttaatgtaatgctctatcataagtacttttttatattatttaatattattctacaaaaataattttaaaaactccattgtagtatatgtatggatctgccagatttatttaaaaaatagctgcatttagtttgcctctgttttcagtaatatagccaatgttttgatgaacaatcttgtgattaattatttcccaaattaaaaaaaaattatattctaaaatagtattttaggaacatactgagctgctgatagatatccccaaatgggcatatgttctctaaacaatctaattatcattctgaaataatctaaagcaatatgttttctagtttcaaaaaaataaaaggcttaaacattaactttttatgcaaaaataggccgggtgcgttggctcatgcctgtaatcccagcactttgggaggcgcagggaggtggatccccaggtcaggagatcaagaccatcctggccaacatgatgaaaccccgtctctgctaaaaatacaaaaattagccaggcgtggtggcgggcgcctgcaggcccatctactcaggaggctgaggcaggagaatcacttgaacctgggaggcagaggttgcagtgagccgagatcacgccactgcactccagcctgggcaacagagtgagattccatctcaaaaaaaaaaaaacaaaacatgaataattatagagaatgaggaaaatgttaaacacaatcttatcactattcagtcatggctgaggttttctgttttcctatatctctctatatgtatctatttataccttttatctacatgtatgttagtcatattcatattagattggttgtataagattttccgcatttgacaattatggaacaataaaaagaataatttcatattgctcaaaaatatatgcagctccacctgagtctatcaattttctaataaaagtgatatggtgatagtaccatttttatagatttttgagaattaaacaacacatgaaaaacatttagttctacccctaactcaaggattttgttcaataactaacagcttggtgtttacataggatctagttccctgattctagaatcttcctacactcctccattaccaactaggctactctgaacaagttacttatcgctctccttgctttggttttctcaatttgtaaaagtaacaattacctcaacagtggtgctgaacactaattaaataggcatatctattcctctaaagtgccttgtacatgagagacattatctcagttacagagtccaccgtatttactacctttacttaaagaggctgtgtgtggatcacctgaggtcaggagttcgagaccagcctggcaaacatggtgaaaccccgtctctactaagaatacaaaaattagccaggcgtggtggtgggtgcctgcagtcccagctgctcgggaggctgaggcaggagaattgcttgagcccgggaggcggaggttgcagtgtgccgagattgtgccactgcactgcactccagcctggctgacagagcaagactcagtctcaaaaaaaaaaaaaaaaaaaaaagaagctgtttgataagcattactactgtagctattattacattaagagtgtcatcctaaatatgcagttaaattctaatttcaaaaaatacatgataccatatttttccttgttttattaatttaatattagcttatgtgaaataacaaaatatgacaatattttgatgtgatctacaatagagtttgtattgagtatgttactctacatgtcttaacgtatcaataccttggaaataaaagtatatttcttaactgtatctcatcacatttattaaattcattgtggggaccaagttttgggttgacagcctcatccatgcattcattaattctatgatttaattcttatatactatgtggaaagtattgcttgagttactctgggaataaaagaacaattgggaatggaatttgactgtaacaatgaggagcccaaataaacaattttatcaaaattacttcaaaattttcctctaacgttgtccttttttgattattatttcttttgaagtagcagttaagaatttagattctagaatagaactgcctgggttagcaattctggctctgccctttataaactatggcgttggacaagttacttaatctgttattgcctctatttcaccacctgtataaatggggtactaatagtcagtgtccaaataattaaatgaactatatgtaaaatacttagaccacttcctggcatgtaataagcacttgaaaagtttcaggtttttgctatgattaatatttggattcaagatgtgtgattcaggtacctatatgcccaatattgattaactatggggaagtagcattgtgtgataaaaatctttttctggagttggatgttcatatgaacacagtcatctctctgctttattttactatgcacattgctctgattgctcaaccatatacttttactttcactggaaataagatttattttgtatcagtaaagctaatatttttcacaatatggaaagagaagccccaatgtgactaaggtcatatgaccaactatttttaatttgacaacaagttaaacatgaggtgacagtaaatgctacattttgttaatagatctaaaaacacaaattgcctgtttcatcgaaccctgagtgaaaactaatttttctataaaatgttaactttttatcatatatctaggtaaagaatgccaggatttatattttcaaaagttcacttatttttattggagagatggcattttgtgacttttctgtttcacatatgaaaggagacagaattttatggtctgtgcaacaacctacggacagggttatatttgattctacagatcatatctactctttcatattggaattatcttttcataccccaaatggatattgttttcagctaaagaatttttagtatttcagtaacaatttatatatatatacataaattcttgatttttatcttattgttctgacacagtattatgttgttacactctgacagtatttcagcagcttctttaagaaaagattgtaaatggaataaaccttataattaagaaaatacccctcaatatataattcacttcacagagttttatatataatattctatttcacccatgaattcatatttgccaaacttctaccattttagggatatattctgtctacatttgtaattttttatgccaagtagagatatatattgctttttagtttctttttgaaaaatatactgatctacaacttaattaaagttgtaagtggattgtgaattgtttattgttaatacataataaacatagtgaggccttttccaaattctggtgaatctgatactgatgtgtacttataaaatttgaacattcttagtgtctagtcaattttagtcggtacctactgtagtttcagtaaacaaactacttcaaatcaatcattgtaaactccagaataaatgtgttgacttggtagtattttctaatagctcggggactttgaacttggttagaaccttgaattattttccgactcctgtctgcactctgcacgagcctatcagaagctgcggtccctggtgctggtactgcaggcagtgatttgcataaaggtgatgaaatctactcaaattctaattggtttatatgtaataatcccaacaatgaagcatcatttagttatacatttcaaattacagataagcatagacataaacaaacatacagataaccttgatttaccaggaaattgtttaatgccaaacgtgtcaggtccttttactcagacaacaatagtttggttggttggttgttatggttggatttttgttttagtgtatttttaatggccaaaaagaagttaattgttacctctagaaaatattttcctgtggtgacttttttgttttttcttttttttttgagacggagtctcgctctgtcccctcaggctggagcacagtggcgcgatctcggctcactgcaagttccacctcctgggttcacgccattctcctggctcagcctcccgagtagctgggactacaggcacccgccaccactcctggctaatttttttgtatttttagtagagacgggttttcaccatgttagccaggatggtctcgatctcctgacctcgtgatctgcccgcctcggcctcccaaagtgctgggattacaggcatgagccaccgtgcccagctgacttttttgtttttttattggccaaccatgttgttttataaagacttgattaaactgggagacaagagaccagagtaactcgggttcggaagtcttggatgggaactccagctccaatactgagctgtctgaattttcttatgtggataatgagaataattacagtctctgtagagaggttaattgtaagggtgtattattgttttcattatttctttcttagtggaatttttgctctgtcttggaatacttccttagactgccctgtagcagaggaactttggcctggtctttaggaacttttttgttgttgttgttaaactgcttagtatgcacataaaaatgtatcttattcccagcctatctcttattagagcacatgggcagacattttatcagtcatatagagaagaggagagctataaggcatataaattcaaatgccaatcgaaatacatcaaatccatccaaaatgctacgcggggaataatatttacataagtgcttacggtgtatacaagctatctacccttgtagaaacagtcaaatctatctccggttcaagtcagaccctccaaagaaatatatacctcaggaacatcattttgagcccaagtatcacgttgtatattttttctttgagaagatactatcaggttatttttagagatattttaaataatatccctatgaaaaatgtggtcatataagctggattttactaagttgtaggccattattctacaaagtctcctctctttaaaaactgacagaaatattttttctgctctcagtactaagaatagaagagcttctcctggacaacaggctttttttttatattatagctattgttaatgtaaatgatcatcttacttcttcacattggcaaaatgaatacttttaaaatttgtcacccacattagaaggagaggactctagaggataatatatttttgaaagagcgtccttttcattttactattacaaatctgtatttttatcttgcacttctttttttccattctattttgttttttctaatttaaaaactatttttttctacttaactttgcggaatctgttttttaacttaacaaatttgaaggacactttgtaatgcagtattttctttatgaatgtaccatatacaaaagactgaatgcttcttttttgctttggcaatgaataattcacgggacgagttactaaatttcaaaactctgggttacgttacctgccactattccaatgagagggatgagaactgcaaacacgaggaggtaaagggcaatcagtgcagctttgaaggacttcagtttctcttgaagggaagggctgtttttaggatctaataaaacaaaaaagcccagcctactgttagaaagtgttgtcttcttccataattaaaattgttttaatctccaattatattcttactaccaagcctattggaataaaaaagaagaaaaaatgttccacatctttgcagtagaaagcaaaaggacagtcacaggaaaagccaatccaggtatcattataggcacttgactgacttatccactcactaaacatctacaagaaagttactgtgctctacaagttgtgcttgtttgatcttttggaatcagctggtaaattttaatatcgacacttacatatacaaacataaattttattcaatgttcatatgggaaaatattctgggtgacaataaaattttctaaagtaactatgcaattttttaatattttaaaatcagatagggcaaatacttattttcaatgactatgatgttaaaataattttcttgttcaattccttctcaatagttttgtatctgcatacctcttatgatttgaatacagtgtaaacaatatttaagaaaaatgaaataaagtgattcacatttttactaatctttagaatggatcaatgaagcccactctctctatatttcagaacatattaataacagtaaccttttattcatatgcatttatatggcactgtgatttatataatgggatattaattgtagtagagacaaatcaatataaaggggaaacagtagatgaggaagtcatttctctgattagttgaatacaatggtcattaaaaatttattttctatggtcattgctttcattgatcaattaaaaaaagtaaatgttgctttcaggttgcaaattgttaaattaaaaacaaacttttttattttaaggtattgaaaagaaaataagagacagtttttaaaaagtaaagaaaagagaagagctggatgcagtggctcacgcctgtaatcccagcactttgggaggccaaggcgggaggatggcttgagcctaggagtttgagaccagcctgggcaacatggagaaaccctggctctacaaaaactacaaaaattagccagtcatggtagcatgtccctgtaacccaagatacttacgaggctgaggtaggagaattgcttgagcccaagaggttgaggctgcaatgggctatgatcgcaccactgcactccagcctaggtgaaaaagtgagaccctgtctcaaaaagaaaaaaaaaaaaaggaaaagagagaaaaggaaaggaaagaaaagatggaaggaaaaaagaaaaagaacccataatagaagcaagtggagatatagtccacctgccaggttgattaagcctgaaaagtaggagtcatcttctcatctctaatttatcatcacaaatgtaaattctaccttttaaatagctctcaaacattttgattgctttttctctgctcccgatgtctctctcctccttcttcaaactctcatcatttctgtctgtaacagccctcactgttatcttttcttacatgtgtctcacttgtgccatatcctcccatccatcctttacacagagcacaagatccactgtgccctggagttgaggtctgtatttcaggtttgctatgtaagaactcatatatgaggctttaactttgtatatgctgcttcttcacactgaaatatcttctctttcttttctgcctccacccatccccttagcgatatgtatttatattttgaggtttagcagaattataagtaactttctcctgacatcttaaatgatcctgttgagatacagctgagtattgctactttttagctgttgtcgtaacctgtgcaaacatgtttcaccactgctatatgggttgaattctgtgccaccaacagatatgttaaagttttaaccataggtaccagtgaaagtaagtttatttggaaatagggtctttggagatgtaatcaagttaaaatgaagtgatattggattagggtgaaccctaatctaatgactgatgtctttgtaagaaaagaacaaatagctacagagagaagaccatacgaagaaggcgggaaagatgagtggtgcagctacagaggcaaggaacactaaggactgccagtagcccgtagaagctgggaggaggcacaggaagattcttctctagagccttcgaaagggcacatggtctttctgacacctgcattttagacttctgcatctcagaactgtgagcgaatacatttctgttttaagcctcccatttgttacaacaactctagaaaactaatacaggcacctaccacccatgattttcgaatattagctcacggtgctaggatcatatttatctccagaacctaatattgtagctgggaagccagaaggctcaatcaatgttgtagattaatttaatttcatataatactgccttacttttatttaagcttatttttattctgtctcaagaatacccctgttggtcaaataagtattattttaacatccacttacatttaaggtaagtctcaagactataattttatattttgtcaataactctaagaacaacctccatgggcagcccatccccctctacttactcggaggaagcaaagctgtcattgagcgagcatcaaatttcacagattcggagcagctatcagtgtcctcctgttgattgtgaaagtgatcccactgctccatacttctatgaaacaaaatggaaaaatatattaattccacatgaaatggctagggctcttttgcataatgttttaaactgaaatttcagtttgaaatggaatctattcagtttttcttttttttttttaattatactttaagctctagggtacatgtgcacaacgtgcaggtctgtcatatattatacatgtaccatgttggtgtgctgcacccacaaactcgtcatctaacactaggtatatctcctaatagctatccctcccccctccccctaccccacaacaggccccagtgtgtgacgttccccttcctgtgaccatgtgttctcattgttcaatttccacctatgagtgagaacatgcggtgtttgggtttttgtccttgcgatagtttgctgagaatgatggtttccagcttcatccatgtccctacaaaggacataaactcatccttttttgtggctgcatagtactccacggtgtacatgtgccacattttcttaatccaggctatcgttggacatttgggttggttccaagtctttgctattgtgaatagtgccgccgcaataaacatatgtgtgcatgtgtctttataccagcatgatttataatcctttgggtatatacccagtaatgggatggctgggtcaaacggtatttctagttctaaatccctgaggaattgccacactgacttccacaagggttgaactagtttacagtcccaccaacagtgtaaaagtgttcctatttctccacatcctctccagcagctgttgtttcctgactttttaatgatcaccattctaactggtgtgagatggtatctcattgtggtttggattagcatttctctgatggccagtgatgatgagcatttaaaaaaaaatgaaacggaatctatattctatgacacaatctgtaataaataacatttaattttagcaaaaaaaccataattagttaaatttgtatatctctcatatacagcaatgtattaaacttacccataagttttaactttcacgtaaaaagacagatgtatgtggaaccctctcatgtatctttctatttacaaacatgtatgtctatttttagaggtgtgttttttgagtgtggaaaaagaggtatctcttctttcttagctgaaaagttttttacaggtgacagaaaataacttgtaaaatgatttaatcagtaatttaatagagtaaaaggaaggaaataaagaaatgtctggatctgaatgatctgatttgacttcttacaaaagtcaattttcccagataattgttttaatttgcctctatctgacaaaagagaggatttgggaactatgcctgccttcctccatcctcttcctccacaatgtttaaatccattagagaacatagtccttgtccatatcaacataggattcagaaaaaacagttctcagaaatgatgcacatacaaattgtcattgcgaactgccaaataaggaatttccttagtattattttaattactctatttgctgaaaaaacaataatttcccttaggacaaatagttttgcatatttggactaaataaatatttcctggatcttttaagaaaattatttattggccgggcacagtggctcacgcctgtaatcccagcactttgggaggctgagatgggtgaatcacctgaggtcaggatttcgagaccagcctggccaacatggtgaaacacagctctactaaaaatacaaaacaattagccaggtatggtggcacctgtaatcccagctattcgggaggctgaggcagtaaaatcgcttgtacccggaagacagaacttgcagtgagccgacattgcaccgctgaactctagcccgggcaagaagagtgaaaccctgtgtctcaaaaaaaaaaaaaaaaaaaaaaaagtatttatttatttatttacttattttgagacggagtctcactgactctgtttcccaggctggagtgcagtggtgcaatctcagctcactgctaccatgttgtccaggctgatcttgaactcctgacctcaagtctgcctcccaaagtgctgtgattgcaggtgtgagccattgtacccggtctctctctttctctctgtctgtctctctctctctccccttctccctctctcctctctctcccttctttctctctctctcccttctctcttctctcattcactctttcactttccagagcttttctcattttacattggcagccatataaatatgtccttgtaccttttccagcataatctctattttatgtgcatactaagcagcttttaaaaatgttcctgtgtctctttaacatgtatcagaaacattggaaaggtttgataaaaagaaactgatgggcctcaccaccagagtttctgatatttggggtgggggctcaagaatttgcaattccaacaaattctcaagaggtgatgcaattggtctgaggaccacattttaagaaccttttccataaaaggtgattatgacttcttttgttggacacagttccgttcatgtgattgacaaatttagcataaagccaacatcttctgatcatttcttattttcttgaatgctgtgtaatggacttagcacagcacagttctaactgagtgcactggcatctttaggacagcaaagtcaaatccagctcaggaaatgaagggcgatcattcagatgcaaatgttcatcccactgtggggagaggcagtgacatgcaaggatatgactcaactcctgtcaatatattttgaaaatatcactaagaagattctttatttggaagtttgcagtgacagtcgttgcatattcctcctttctgagagttggttttcatgaatgctatgttgatctgaccaaggactctgttctttaatggatctgaccactgtggagaaagggaatgaagggaggtaggcatagaacccaaatcttctcctttctcaggtagaggcaaagcaaaataaataaacaattatctgggaaaatgaactattgtaagaagccaaactggattatttagatccacactcttctctatttcctccctttattagatttaaagagcagttttactcaccaagcaaaacaaatgaacaaaaaaaccaaataattaaaaaaaactgacatgacaataaaacttagcaaaattcactttaaaatatagttgaataattcataatcctttgggaatatacgcagtaatgtgattgctgggtcaaatggcatttctggttctaaatccttgaggaactgccacactgtcttccacaatggttgaactaatttacaccccaccaacagtgtaaaagcattcctatttctccatatcctctccagcatctgttgtttcttgaattttaatgatcgccattcttggaaccaatccaaatgcccatcaatgatagattggataaagaaaatgtggcacatatacaccatggaatactatgcagccataaaaaagagtgagttcatgtcctttgcagggacatggatgaagctggaaaccataattctccgcaaactaacacaggaacggaaaacaaaacatcacatgatctcacgtataagtgggagctgaacaatgagaacacatggacccagggaggggaacatcacacactagggcctgtcagggggtgggaggcaaggggagggatagcattaagagaaatacctaatgtaaatgatgggttgatgggtgcaccaaaccaccatggcatgtgtatacctatgtaacaaacctgcacattttgcacatgtatcccagaacttaaagtataatttaaaaaaaaaaaagaaaaacgaaaaccctatagtttaaggcaattggaactatgtactaatgctttttaactttgaactcagtttgtaaaagatggattcgcaaaaattgtgttcaagtatacctggtatgtatagacatgtgtcaattaaggacaaagatacgttctgagaaatgcattgctagtcaatttcatggctgtgtgaacatcatagagtgcatttacacaaacctagatggtctagcctactgctgctaggcaacaaacccaccccaggctgtgtggtctagcctattgctcctaggattcacacctatatagcatgttatactgtgctgaatcctgtaggcagttggaacacaatggcaagtatgtgtgtttctaacatatctacacatagagaaatgcagtaaaaatatggtataaaagatacgaagttctgcacctgtacagggcaattggataaatgaaacttgcaggactggaagttgctctgggtgagtcagtgagtgagcggtgagtgaatgtgaaacactgtagactttataaacattgcacacttaagctacactgaatgtataaaaaattttatttgttcaataataaattagccttagtttacagtacctttaatactttagaaacctttttaaacaacatttttactcttttataataacacctggcttaaaccataaattgtgtagctgtacaaaaataatttctttctaaacagctttatcctataagctattttaactttttttttttttaatgtttctacttctttaacttttttgttgataactaaggcacaaacacacacattagcctaggcctacacagggtcaggctcatcaatgccactgtcttcccctccatatcttctcccactgaaagatcttcagaaacaataacaggcatggagctgtcatctcctatgataacattgccttcttccagaatacctcctaaaggacatacctgaggctgctttatggttgaatctttttttataaataggaggagtacacaccaaaataatgattaagaagtataatatggtaaatacataaaccattaacatttattatcaagtattaaatacttacgtaactgtatgtgctatacttttaaatgactggcagagcagtaggcttgtttacaccagcatcaccacaaatatgtgagtaatgcaatttcctattcccttagaacagctatgaggtcaataggtgatagaatttttcagctccattataatcttatgggaccaccatcatacatatggtcctgtgttgactgaaacattattatgtagtgcatgtctataaccagaaaagctttcctttcaggctacctactggccccttctccacatgtttgattatggctttgatcctcacatttgagatattctgcctccatttttactgaaatgcaaaataaacagctcagattattctatctaccaggtaagaccgtttgtgaaaaaagctgaagacttttgaatctgataaacatctttacactctgaactctgaacgagtagggaccatgtctgcttttgtccacattatgtcactacagcctaaagcaacctggaacattgaatatattaaataaatattgaatatactgaataaatagaatatgctgaatattcatatatgaatagatgaataactatatagatataaatattcattatataattacatctataacatgtaatacatatttatatatacattatataatatataatttatattatgttaatatattacataatatattatataataggcaaatatataatatatataatatataatataataaatatattatcatattaatataacatatattataaatatatatttcccaattatattatatgtaataccatatatatttggcaattatataatatataatataaatatatgtataattatatgtaatttatattatgttaatatattatatattatattagttggcaaatatattatatattatatattttatatatcatagaattggcaatatataatattaaatatatttatattattatataatatataattatatatatatatatggcacaggcatagtacaaaagtgagtgattaactcttttggggaagtgggtaatcaaggtaggaatacagaaaagatgacaatgaatcagggttttgaaaatgagcagaatctggggtaaggtcattccaggatggaaaatatcatgttaaaaagcatgaaggtatgaacaatatggaactgagagcagttttaatttttcataaagacaacatttatttttcaccttaacatttatttttaatatgccttacttaggttaagagaaaacaaagatttaaaaagccaagtgtcccttttattattatactttcttttcacataaccttttcagcctagattcaggtaacttcctgtctctcccattaaaggagaggggtcctgcacattacaacaggcaaaaaaggctttcaggaaataaaatgttttaatttgatctattacatctgttcaattttcttgagtaccttcgagagtgggaaaaagacaaaaggagaaaaaaatggtattttaaacaaacagactataataaccttagttaggttggtagtacactatttatgctttttctctaaacaggtacaaaggaggttcaaaaagaagaggctggagaggcatgtagccggtagcatccgactcatcaatttcttcctttatttttctgatcgcataaattgatctggctttcacaacctacccaaaatataacattgaattactatctatacaaatgaagtaaaaatttattgtttgctttggcagtagtgacctggattaatattattagtgagacaatatatattgtttatgaaacattttgcttttctccctttcactttgaactagagatgaagcttgattttgttttttctttaagtttctaacctttgatttatttttttttagcatatagaagtgataataaatattttgtggattactatattttaaaccgtggttaccttgggaagatttatttaatctctgaaaaaggaaaaccacctagtacatgtctatgagtgatttagactaactgacactatttagtctataaaatacccctgacaggtgtagtgggccagaagggaggtgaacactgaagcatactcagtgcaatgaggaatgaacaatattccctatggctacatttgtgcaccatgggaagtctgtttgctttctgggcaatgttcaaaagggattggtttatcatgaactgcacgaaatgttggtatgtatattttccagaaaaaaaaaaaagctcacattcatcagagataatgaagccataggatttgtggcattttctgatgttactttcttttttcttagtctgcacagtctctctgagaatctcatctacttccatggcttgaactactgcctgtgtcctgatcaagccaatatagccaaaccagatctcaatctcagcatcagcttttgttttacataacacaactagctacaaacgtggattttctacagcaacctaacttttctttttccaggattttcactgtggttatatcatccatttacatcatctatttattatcatacccacttattattatcatctacttactgtatagtggagaatatgtgatatagttaggaatatgccggcaaagcacagtcacgcaatctgagcccagaactgcttttctagaccgctctcatctataagacccatatctgactgcacaaaaactcctgatttcctttgatccattccttccattctattccaatttttggacttcggcttatttttatctactccagccaggcatcttgggtaacagcaatggtgcagacaattaagaggaaaatccaagggcattaagagagaggacaaattaatagcatctaaaacacagcattttaacaaagaatcgtagggaaaaagtcaaacagtagaagataccttttttcaggaaaaaaaaaaaaaaacaccacacacataaacttgaaaaacatgatattcagtgggtgagtagaggaagaagactcagcacaaaagacaaggaagaactttttgacgctgcaagagaaaaacaagaagcagtcagggtcatggaaaagaacaaagaagttcgtggcctgcaagaaatccataacctgccacatagaatttaagttgtttttcctgtgtggtagaagcagaaataaaaccttgcaagattggcagtaataaatgtataaaaatgaaagtccctgagtgcataaatgaaagttgttcatgctcacggttttttgttgagaagagagatactgatgattgcactgagatagcacatccaggggagttttatttatttctgggtattcctcctcatctccccaacgtctcaacagcagagtgagccagggtccagtttctgttctgttttctctcctattttcactcccttggtgatctcactagcctcattgctttaaatataatctagaaggctgatgactcttaagtctttatctcttgcccatagctcgtctctcaactacaaacccatatatgcactgcctaacaacacccctgcttagaattctaatatggtgcaaacctagaggtcttcttttcctcgccttttctcatccactacatccaatctctcatccaaccctgttgctttgttttcaaacgctatgtagaaactgagggcttcttgtcacttccttgctagcatcctgtccaagccccatcatccctttcaccgtgacatttcttttttttttttttgagacaaggtcttgctctcttgctcaggctggagtgcagccgtgtgatcacatcactgcaaccttgacctcctgggttcaagtgattcttccacctcagcctcctgagtagctgggtctacgggtgcatgccaccatgcccatctagagatgcagtcttactatgttgcccaggctgatctcaaactctttagcctcaagcaatctacccacctcagcctcccaaatttttggcattacacacatgagctattgagcatggcctcaccttgttgattttaatagctccctgactttcacgcttacattcttgaattaattctccacacacttcccagaagaatcctcttaaaaagtaaggcagattgagtcactcccatgctcaaagcccctgaatgccttctcgtctcactcaggccgtcattaaagtctgactcaaaaaagcagaccacctgtaattcctgcactttgggaggctgaggcgggtggatcacctgaggtcaggagttcgagaccatcctggcccaatgatgaaaccctgtctctactaaaaatacaaaaaattagctgagtgtggtggcgggtacctctaatcccagctactcagaaggctgagacaggagaattgcttgaacctgggaaacagaggtagcagtgagccaagatcaggccactgcactctagcctgggcaacaagaataaaactctgtctccaaaaaaaaaaaaaaaaaaaaaaaaaggaaagaaagaaaaagcaagcaagcaagcaagctgactgttcctgaacatccattttcaacctacaaccccttggggctttgtcttccccaccctggcttcattttctttcccccaaaaacatatattccttatttgtcttgtctatcatctgtcttctctcatccaagccagatccatgatgtggacttttgatctctttggttcagggatcagagagttcctgaaggtgctcattacatacataatgccgtatttaaaattacataaataaatgaaaggcaagatatttttcaagatgactggattttatatcttaggttatgcctcaagaaaactttgtggttcactaaagtagggattttaaaaattcttctgttacatattggaaaataaaatatttctctctgcactgcacgtaactagcaaactgaaacaaaaaatattaccctcagtgaacccactttgcttcaaaagcatttattattaaaattaccagattatttcagctgcttactctggttataatcattgtaattttttagtaacgtgaacatacatacttgcatgagccttcattagcaggcagtgaacaactcacactgttcaagtgtgccttttaatatcagttccacagttaggacaaaaagtagcttcacataaagttactcttcctattaaatgtcagtgtgctgataaacgattgtaaaatccttggagtttgtgtaatctattaaaagcacgtgctcatgagaagtgaaacacgtttctgtaatatcagcattttatcaagtggatgaaaagtttacaggaaattcataatgaaagaatttcaaggttaatttgttgggaaccatataccttacttttttgtttttattataaaacattttaataatattatagatatgttaggatgaaatttctgtcatctcatcaccctaataaaggaaaaaaacccttaattttttaaat

SEQ ID NO: 869 - DNA, 6446 bp, Homo sapiens
aggtgttcagtaaatgactggtatatacgtaatatgtataatatttcatgctgctgagcaaatgaataggtaaagaacaatacggtgtgtgtgtgtgtgcatgcatgtgtgtgtgtatgcgtgtgtgtgtgtgtgtgtgtgtgtgtatatattttttttcttccccaagacagggtttcactctgtcaggctagagtgtagtggcaggatcacagctccctgcagcctcaaactcccaggctcaagcgatcctcctgcctcagcctcccaagtagctgggactacaggtatgtgccactacacctagctaatttcctttttgtttttttagagacagcgtctcactatgttgcccaggcttgtcttgaactcatagcctcaagcagtcctcccacctcagcctcccaaggtgctaggattagagttgcaagccactgtgcccaaccaagacatggtttaaaggtacaacaaggccaggcacggtggctcacacctataatcctagcacttttgagggccaaggtgagcggatcacctgagatcaggatttcaagaccagcctggccaacatggcaaaagcccatctctactaaaaagacaaaaaattagccaggtgcagtggcaggcgcctgtaatcccagctactcgggaggctgaggcaggagaaacgcttgagcccaggaggtgagggttgcagtgagccgagatcgcaccactgcactccagcctgggcaacagagcgagactctgtctcagaaaaaaaaaaaaaaaaaaaaaaggtacaacaggcgaggagttgaaatgaaaactccaggagggcaaatactgtgtcttttgttctccattgtatctctaggccctaacacagtgcctgcctggcactaagtatgtgctcaataaatactggctgaatagaatggacatttgaaagtcttctccaaaactcatactgaaacgtaatccccaatgtggctgtattgagaggcagggcttttatgaggtgattggatcatgaggactctgccctcgtgaatggattaatccattcatggattatgggttggtgagttaatggattaatgggttatcatgggaggacaactggtggctgtataagaagaggaagagagacctgagctaccaatgtaagcaagcttagccccctcaccatgtgatgccctgcacagccttaggactctgcagagagtccccaccagcaaaaagactcaccagacgcagcccctccacctgggacttctcagcctccagaactgtaagaaataaatttctggccaggcacggtggctcatgcctgtaatcccagcactttgggaggccgaggcaggcagatcacttgaggccaggagttcgagaccaacctagccaacatggtgaaaccttgtctctaccaaaaaatacaaaaattagctgggtgtggtggcacgcacctttagtcccagctatttgggaggctaaggcaggagaatcgcttgaacctgggaggcggagactgcactgagctgagattgcgccactgcactccagcctgggcaacagcagagtcgcaaaaaaaaaaaaaaaaaaaaaaaaaaaaacaataggaagctattaagggttttaagcagaggtgtggtatgatccgagtaatactttttaggctgagcatggtggttcacgcccgtaatcccagcactttgggaggcctggctgaggcatgcagagtgcttaagccaaggagtttgagaccagcctgggcaacatagcgagactctgtatctacaaataatagaaaaattggataggtgtgatgatgcatgtctatggtcccagctattcggagggctgaggcaggaggattgcttgagctcaggcggtcaaggccctccagcctgggcaacagagtaagaccctgcctcaaaaaataaaaataaaaaataaaacaaaaacattttttaaaaatctgatacaatctgaaaatgaattggaagtggggaaaatgtcccctcaggaccctgcccacttgtcagagcaagaaatgaccctactgccaccccctcttggaacagcgctcacaaagataacagagtttcagccatcattattatgagttcactgtttttcgctgctctttaacgaacactgtgaggcactgtgataaatgctggagaccctgagatgaaggacgcacagaccttgttttccaagagcctaaaatccctaatctccaagatcagccagtctttccagagaagcatttaactcagaccaatacttttggaagagggcagagctgcagagccctgatcacccattgttcgtatctctacctttctttgtcatgtatgtgtttattataccttgcctctttccaagagacagttgagatcgctaacaacaagaaaagaacccgtgagaattacaaacagaagaaaatatgatagtgggaaccatgacaaagcaaatggcctgaacctgtgggctggcgacagctgctgtgactaagcgcaaatttggctccgagcttcctggcagccagggaagaaaggaatacacggcaagaaggaagagcaacctttcctctctggtagcatagtgtttcctggctgcctttaaattctacaaaacaaaggtggggcctactgtggatgggcaaggctggggtcagcagggtaaccgtggttgcaagcaccctctcattcatcttgttcattacagaactcaacatcttccccaccgggcacggtggctcacgcctgtaatcccagcactttgggaggccaaggcgggtggatcacttgaggtcaggagttcgagaccagcctggcaaacatagtgaaacccccgtgcctactgaaaataaaaaaaattagctaggtgtggtgatacgtgcctgtaatcccagctacttgggaggctgaggcaggagaatcacttgaacccaggaggcagaggttgcagagagccgagatcacaccactacactccagcctgggtgacagactaagactttgcctgaaaaaaacaaaaaaagaactctggctgaacacaggggctcacacctgtaatcccagcactttgggaggccaaggcaggcagatcacttgaggtcaggagttcaagaccggactggacaacacagggaaacccagtctctactaaaaatacaaaaattagtcaggtgtggtggcaggcacctgtagtcccagctactcgggaggctgaggcaggagaatcgctggaacccaggaggcggaggttgcagtgagtcaagatcatgccactgcattccagcttgggcgacagagtgaaactctctctcaaaaaaaaaaaaaaaattagccggacgtggtggttcacaccagtagtcccagctacttgtgaggctgaggtgggagaagcacttgaacccaagaagtggaggttgcagtgagctgagaccgcaccactgcactctagcctgggtgacaaaaccagaccctgtctcaaaaaaaaaaaaaggagtccttgtgccaccacagcacctctgcctacctccctcaattctcccaccatctggacaccatcatccagttgtgtgtctctctccacctctggactgtaagctccttaaagtccaggattactgcttggttatatactgaattgtgtcccccaaaattcatacactgaagtcttgacccctaatgtcaaagaacgtaaccttatttggatttaggatctttgcagatgtaatgagttagcatgtgatcatagaggagtagggtggggcctaataaggtgataaccacgtgaagacacacacacacagggagaaggccacgtgaacacgagcagacggtgtcacacctgcaagccaaggtacgccaaagactgccccaaaactccagaagctggggggggtggcatggaacagactctcccacacatcctcaagagggaaccaaccctcccggcaccttcgccttggactgccagtctccagaacagctctcagacagtagatgtctgttgagtccccagtttgtgagatgtgtaaagcagccccgggaagctgatacaggtttctttatctttgtatgcctgtgcttagcacagtggctgccacacagaaggtgggttcacctctatggaactgaaccgcagaagcctgggtgttcaaggcacggcatcaggctggggggccatctacctcccagaatgggaggcaggtgcagagagacacccaagctccccgtttcaccatgtcaccaaggcccacagcaggcacagggtgccttgctacagcctggcggtacacaccagtcagggctatggaacatcgacaacagaaatcagctatgactattttatggaaaagaggattttgatgagaaaatatgagaaactcccagaatcaacaggcaaagtgcagagccatgctcagacaaaggaccacggatactgtgcagggggaaaatgtggccaaggccacgtcacaggacgtctgctgcagacactgccactcctactgggcctcaactctaaacaacctcttcctgcccctgcatctgtgcagtactcagcccagggtcagagcagagggtggcagtggtcatgtggccaagctgaggccacaggctgcgagaaagaatgtgtggtccacctcagcttccatactggcagaagaggctctgcctccctccaagacttacatactgagggttcccccaaccaggaaggtgggtggaatgttgagcaccccaaaatataaaaagtacccatgagacctaccaacccaccaagctgcagaattaagtaaaggtagatccctgagtgccatcacaccatgactgagtcctacagagacctacagaatggactcaggctcccagggtggcggaagtgagggagaggcctctgcatgtctacacagccccagagccaagtgtgaacaaaggaagtgtttcttcatctcttaccacagagaacaagtgtgaagcagaatttcaagcatctgctattgcaaaacatctaaagtagtagcaaaaggtcatttccagaaacatccctcttcccctaccctagaagccattcagcatcagttacattgtgaataacactatctgaagcttgttcattcattcagcaaactgtcctaagacccagatgtgcctggcctcgtgctgggcactggagttacaaagatgaatgagttgccatccctgaccacaagctcagtaagctggaggagaggagaacagagaaggcttcactggggatggcaactgtcatggagggttagaggttagtgatgtgaatttgcattccagatgttttttagcatttgctgggcatcacagatttctaaacacacacacatacacacacacatacttcctcccagtcagttacctccttaatcagccaccagcccgaggaccgtggtccagaggactaggcctggatatgcaaacctaggtccttttaggaagggctgcaggctaccaggtaggctaaagatgtcaacatggtagatggcaatctgcttccctgggtggaagacaagacacagaggctgaccccaacacgccagttggctgtgctcttgggcagaccttagctcttggtcagcagctggtcctcaggaaactgggaaatgaaccctgttttaggtgcccctgctctaccctccacaatcataataccagcgcttaccatttgcactgcacactccagtttgtaagacacttttacaggcatccactccttcattcattcattgaacaccaaggcactttgcttagagctaagaacctaaagagtaattaatcacagccgctagccgattggttgccacttcctatgggaagccctccttaacctctcaggctgggatcaatgtcccccaacccccacctcacaccccacaggccacggcagctcagacttccctacatcacaagctccctgtatcagcactgggtctccttctatctaaacttcctggtttagatgtgaaagggactcatccaccccatccaccactgcatcctctgagcctagtacagtgcctggcacacagtgaagcagaatggatgtcctgaggaagtgccagtgggaagacccaggaggacagaggggccgtggggaaacagaagccaagtgggaaagggcaggggagactcaaggtaagaatctggcattatcattccctactcatttgtggattaggacatttatctcagagagcttgagggacttgcccacaatattactgctagtaaactagctgggtctctgcactcactctcttcataccaatttccaaaccaactctctacatctcagacagctttgagccctccctcccccacagcccgcagaattccatctctcttcctgtgaccaacttactgtttgggatctaatgtattctgtaccctccctccggggtattttttttaaga

SEQ ID NO: 870 - DNA, 121502 bp, Homo sapiens
aagtgctgtcatttcattttatgaatgctgattagggagtttcagttaactgcaacactttgcaaacaggctatcaaataaaccccagttatcaagcagttctagacacaaagcttctgtttctattactaaatacaattaaagaattaaaaggatcagtgtgtttttcttgaggtatattagtctaaaataatttgcgatagtaagtcaccaaacacccgagtgactgaaattcttttagctatataaaacactcctttggaatgccgatctcccacaccgtaagacttaaaacacacaaaattcactgacatacatttttcacatagagattaaggggtaaaaaggtggcaaactcaatacacttacacagaagtagcaaaaaacgtgtaagcaaattccaaaaacctttgtcttatccagaatggcactttgtggtactccaaggattcaggcatttcatcagtattccgcacataggggtactcaaacaatgttgctgacagatgagacaacaaagtctcaccaacaaacatttctacagcaatgtattaacaggtaatgttgcaaatcagtcaaggggccaagtgaggaggaatccagaggagtagaaagaatactaattttctgccaaattttacactcagaggaaattaatccatcatagaagtcttccatgaaaaaaataaaaaaggtactcagtatgacccagaatagccatgaggttaaaacacatacacacacacacacagcaattgccacttccactagagtttgacagttatagatttgggtaattatagtagaaattgcgcgtttggaaacacactaagaccacaccctaagactgagaatctggactttaaacgctgatcattaattaaaaggacaacgcagtatctaagttggaagatctggccgcgcaggtggaaggcgaagtgatggggagcgataaagacaccaacttcaaaaccagggaccaggagggctgggtgtcgaggcgaggcgaggcgaagcccgggggataagggggtgtggagctggggacgggaacaggggatgaggagaaaaagcggccgcgaagaggaaggagtggtgggagccaggattggggaggggggacaacgccgacacgggaagggacgagccaacgagccaggagtcactggcgggcgcaggatctggggtgggagggggcggcgagagcgcgcgtggaggtgccaatggaaggaagggggcggaagaaaggaagacccgaatgaatgagcgccgggggcaggccggggccgcggggccacagaggaagcgggcccggggcgtcgcggggccgggggcgggcccagcgcgcctggaaaggaggaagccccgcgccagcgcgggccccgccgcacccgcctcttcgccaaaatggggtcgcagagcaggaaagctaggagtgtgaaggaagaggggaaaatggcaaaaaccaatcactcaccctccgctcgagcctccaggcgctctcagtcccgctcctgcgccctcctggagccgcagaggcggctcctcagcggcgctagggggagccccgggtccggagcgggggagcggcggcagccggaccgggagcccctcaacacctgcccctgtggcagagccgcgacaagccaggcggcagctccgagcggggagggcaagtgacccggatgtacagggtaacgacggggagggggaggagggaatgccaggaagtgagggcgccgcggacctgtccggccgtgcgcatgcgccgcacgcccgccccgcaaggtaaatccttagcctatcttctccgcccctcatccccgcccctcccgaaggggcggggcgaagccagagacaggtggtcggcgggcgcggcgtgcagaggaaggaggcgtggccacccccttgcaccccggcctccttaaaggggcagcaccttcgcaaatatcgcgccgagatagcttctgagtgggttggggtcttccagccttccagatgtacagatgggaaacggaggttcagaggtggcggtgacctgcctcttgtcagcgggcttggaaatggcaggaactggacctcgggactcgatgctgagccctgcgaagttgccatattccccccacgcctggaaccgctaggctgcgggcgcgcctctcccctttgggtcaggtactgagcctcgcccgcgattcccggcgcggcacgtgttcctggcaggcgcccagcgccaggagactgtactgttaccgcctgcgatggtatcgcggagacgcccttgggtggtgaaaaatgatcattctgagaacaaaaattagactccacttacaacactctcagatatatcagacccctgttctggggtcgactctgggcaaaaatatctagtgggcagaaacttggatgtgacagagggcacagcctcttaattacttccctaattcccctttcactctttgaacataaatgatccctttccctttacagacaaaaacagaacatcccatctagctagcttctcctaatcctgttataaagctgaatttttttttattaacattaaaggggaaaagatgacaatgttatctctcccagggttgttttcagtttgacagctgagcagatcactaagatggaggtaaatgattatgaacattttgcagtcacaggcccaactgaaaatactgtaacagtatggacttttccccccgggaaaatacagacatgcacacacatttgcataaaatttcaggagtttcatgcaaccagggagcctatccatgaaatcctgattatgaacgaagctctagtcaaagagctaaggttccggtaactatctgcgccttactctatggggccaagaaatcactccttgccacaaaacacagaagggcagcccttaccttagcctttttgtcttcctcttgagttatgtagaaaccaaatggtatgtaacatggtgggcatattacttagaaacgtgttgagtcatggagagatgaagtggctttttcaaggcacacactaagggcaacattcctaggcctcagacttttaccttaattatcatacttcaggaggattcagggattctatattgtagctattataattctggtcaatttcaatgaaactgaaggagatttttttttttttttttttggtgatggagtctcgctgtcacccaggctggagtacagtggcgcgatatcggctcactgcaacttccacctcccaggttcaagcgattctcctgtctcagcctcccaagtagctgggattacaggtgcacaccaccatgcctggctaattttttgtattttagtagagacggggtttcaccatgttgcccaggctgctcccgaactcctgagctcaggcaatccacctgcctgagcctcccaaagtgctaggattacaggcgtgagccaccgcccccagctggagatgatgttttacaaatgttgatgctgatagaaaagtcctcctaatccaagaagcttggtccacttgtctgacatactgacgtccaacctcagataacctgggtccagatggatcactgtcctcaatgtgaacaggaggaggagttcatacatgtgcaaagtcccttagatatgagctctgagtaaccacacacctctaaccctatctcccaccagaagcagaaatctttcatattatcttcaacacatgaatatctagttcagctccaatatctccaactacagggagctcattactgcaatcatcagcctttgattgtgaggaacctcttttacactaagcaaaaatctgatgcacaacaattttcatccactggtcgtaattttctctatggagagcaatatagacatgacgctggcctagggagcttacagtccagcaaagaagcagtccactgagaagtgataataataaaatactggaccaggtgcagtggctcacacctgtaatcccagcactttgggaggctgaagcaggtggatcacgaggttaggagttcgagaccagccaggccaacatggtaaaaccccatctctactaaaaatacaaaaattagctgggcgtggtggcaggcgcctgtaatcccaactactcaggaggctgaggcaggagaatcgcttgaacccaggaggtgaaggttgcagttagctgagatcttgcctttgcactccagcctggatgacgagcgaaacacgtctcaaaaaataataataataacaaaatacaatgagtcctgtgaggaacacggaatacccctctcacatgcacctttctccttagctgccctgggtccattcctgccatgtacaagaactcacaagtaagttcttccattaccccacatgggaattccctaaaagagggagctggctcagaaaacaagactcctataagaagtgctgaatttattcttctataatcctttcttcatcattctgcatgaatgtgatcatatttttgccgagggcaaagctttcaaagacttatgttgaaaaattgaacaaaaggatgcaaaaaaaaagggcttacataagagcactagtctcttaatgatgatttacgcattgtggctagctgtattttgtgagtccttacaatgtgccaggcactgtactaagctctacgctcttgacttgttttcttcttttgctttttcacagccatcctatatggtactattatcaggcccattttataaatgaggcaaccgaaactccgtatgtgacagatgcaggattcaaacccaatctgtcaacttcacagcttctatggacactgcattgtctctgtctacttttttaaatttcacaaggtcctgtggctttccttcagtgctgttttcttggaaatttttatttattattaaatcagttttaaaaccctatagagaataaatggtttcactcaatcattgattcactcaatcaacacacatttttgcaccgcccacccgcccccccgcactgtgtcctaggcatcaggctgagggtctgggaagaaggagagtaagacaccaagtccctgctccggaggggctgagagtttagtgaaaggacaggctgtcatcttgcacttaaaacaaagcatgactcgttgtaattcagaagggtagaggaaacagctttccctgggacaattgtgaaggcttcagaaagaatgggacctttggccaggtgcagtggctcacacctataatcccagtattttgggaggctgaggcaggcagatcacttagggtcaggagttcgagatggcctaactaacatggtgaaaccccatctctactgaaaaaaaaaaagaaagaaattaaccaaacatggtggcacgcgcctctgtaatcccagctacttgggaggctgaggtgggagaattgcttgaatccaagaggcagaggttgcaatgagccaagattgcaccactgcactccagcctgggcaatagagtgagactccatctttttttttttttttttttttttgagacaggagtctcgctctgtggcccaggcgggagtgcagtggcgcaatcttggctcactgcaagctccgcctcccgggttcacgccattctcctgcctcagcctcccgagcagctgggactacaggcgcccaccatcacgcccggctaacttttttgtatttttagtagagacggggtttcaccgtgttagccaggatggtctcgatctcctgaccacgtgatccgcccgcctcggcctcccaaagtgctgggattacaagcgtgagccaccgcgccccgccgagactccatcttaaaaaaaaaaaaaaaaaaaaagaatgagacctcttagcttggtctttaagggaaggggaaagggccaaggagaaaacgcagggggccaagggttggcagggattgtgggggtgctgtgacacactgagattgtaaaggacatcatacaccatactaagaaatttgaacttgccttctgaaggcaacaacaagtaaagagacgcttctaaccaagggagacacataatcaggtatgttttatatcaggatcactctgaccacagggtccaatatggactacagtggtagggagaacagagggccagcaaagcagttaagaggctgctgtggggtccaggagagggataaggagagcctgctcaaggaaactggcagcgaggatgaagaacaggcaccggaattaagatgctacctgatgcagaatctgcaagttcaatctgggggaagaggagactggggttgtcgggatgacccagaggctcctggcttagcagacaaactggatggtgacaccacgtgatatcaatacttttacacagttttcattcctcttatcttccaatctttatccatgtaaatgcacttgctttgccgggcgcggtggctcacgtctgtaatcccagcagtgtgagaggccgatgcaggtggatcacttgagtccaggagttcgagaccagcctggccaacatggtgaaaccccgtctctactaaaaatacaaaaattagccagacatggtggcacacgcttgtattcccagctattctgaaggctaaggcaggagaatcacttgagcccaggaggcagaggtcgcagtgagccaatatcccaccattgcactccagcctgggcaacgcagtaagactctgtctcaaaaaaaaaaacaaaaacaaaaataaataaataaatgcacattgctttcattggtttcttcagatatgtgcaactctttcccaatactttttcatatttctacacactcacatctatcattttaatgactacagagtatttcatcatactgaaatacctcagtttccttcagttgctaaaggtccacatcctacatggctggtttaccctctagactcatttggctttgggtattttgcaagggatgagttgagcctttagggaaaaagagcctttaggcaaaaggtgttggagaagtgtggcctccggggaagctgcaactctcctgggaggggcctgggcaaccgcattgctgtattgcaggtaaaaaatgcggaactatggaaaagaacctgtcatccatggggagcctgaggtccaagtttccacagaagctggttttcatgtcctaactccctaatccatttgttcattcatgtgttcatgtattcactccttctacaaagcattcctgtgaatgcagagggcaacacagcagagctgaaaccatgtctatgctctggatgtaacttaggctctgaaacctgctctacaacttacacaagttattcaacatctgaaagcctcagtttcccccacaagtttgttaactcagagaaaacttgtaaaatgctagggactgaactaggcacagactaagctcaataacagttttcagtcttggttttctccttatgcttttttgactcccaccactgtaccttgagtttcttttttttgtatttttatttatttatctatttgagacagagtcttgctctgtcgccccaggctggagggctgtgacacaatctccactcactgcagcctccgcctcccgagttcaagcgactttcctgcctcagcctcctgagtgagtagctgagattacaggcatgagccaccacacctggctaatttttgcatttttaatagagacagggtttcaccatgttggccagactggtgttaaactcctgacctcaggtggatctgcccaccttggcctcccaaggtgctgggagccactgcacccagctgtaccttgagtttctgaccaaacccactgggtagccatccatgagctgcagctcaggtcctaaatctgccagagtgaactagacccactcacttgatctttgcttcctatctgtgaaatggagataagacaatctacttctcggaaatgttgggaagctctcatgaagactgtataagaaaatactttcaaagctccaaagcactatgtcattattgactgttaacttttgttagagacattttgttttctttgtttttccctttaaaaaaactctgacctcagcgtaagctccctggattgtaattactgggtcaaaggatctgaaaattttttagatcctgatttgttattgcccaattgtccttagagaagactctatattttgctgccagccttcactcaaagacatctttcaatatgcttcagcacctagagtatagtttttgctgcctctgtatccagtctcgctcctcaattgaacattcagggagttctatcaactgtttctctcttccttttcacaggatgaatgaacactgaatcctttagaaaacagctccaaacatttccaccatagtcagggactccagtgttgccttagggatgaggactccatggatatttaacgaagaaaggggaagaggacaggggacagaggcctgagaatcccctgggaagggctagaagctcatccagcattgaaagatgacatcagagccgctattcaaaaagaacccaagtaagaaggcaaccaatcaaactgacaccttcctgttatttagcaaaacattaaccagtctcacaggagccataaagctgtccttagagccatatttcccccgagttataaggtttatctatgagcctccggcacatctgcaaatctaacatatttctcacaagtggggcaactccaagtctcatttccccaacccttcaggtgacctgcaggaagaaaaaagggtgccactgcatcacattggctgttcccttctgtacctcaagtacactttccagtctcttcacttggctgtttgtcagccttcggattcaaagcagttcccccatcacccttccaaaggtgaaccccccatcacccttccaaaggtgaaccccacctaccttcactcattccctagcatgtcactggtgtttttccttcacagcgcttatcacaaactctaattcttttatttatttatttttttttttgagacagaatcttgctgtgtcacccaggctagagtgcagtggtgcgatctcggctcactgcaacctccacctcccaggttcaaatgattctcctgcctcagcctcccaagtggctgggactacaggcacatgccatcatgctcagctaattttttcatatttttagtagagatggggttttgccatgttggccaagctggtctcaaactcctgacttcaagtgatcctcctgcctcggtttccaaaaatgttgggattacaggtgtcagccactgtgcccagtctctaattattttacatttttagcttaaaaatgttttaactaaaaaaaccccaaagaaataaacaaccaaaaaccacctcttgttacaatgtcagctgtgatggcagagacagagctatcaccatgcccactgcagttcctgccatggtgcctggcccctaggagagcctccctaaatatgttgaatgaatggataaaaaaagggaggacccgagcagtaaataaggtgccccgatgcactattcaccctgattatatgagtaatacatattgattgcagcaaaaaaatttgaaaatacatatgagcaaatgaaagaaaaaataaacacccatgatccaaccacccacaccatgtggacacccttccaaatgtttttcctgtctatatctatataaaggcagcacatatttttattaaaatggttcatttactgaattgtaatctgctgtctttccacctcacagtttatcaacctttcttaataaaggaacgtcagccacatcgctgttaaaggctatataacactccgctgtgcagctcaaccatgaagtgttgaatgattctggagttcagctgaagggaggtttcttcaatgtcaataaaggtaaaatgctttattccagcacttcccccttgccaagcttcccattttttccctctgtgtttgtattgctttagagctgtatttctacagaactgtattccccaccgcccattcaccacctggagttattagagtcctcgtcaactagagaagcaaaattgtttgcagccggaaaagctgatgtatgacgaagcaaggacgatgccttgaagttcaaattgggaatgtgctgctgatacaggaaacagaaatgaagagtgtgctttcttgccaagatttgaatagggagaagaggaaaagattttctgcacgccttcacttcttcccaagccctaccctcgaggagaggtttttcccaagggataggctgttccccaccatgctgactgatgctgtaagcagtttgcagaccaagcccatggctccatttacagactcactggctgcaaaaaaaatccaagagggcatgatcagaaggttccaccccttccacaaacagctctttcagcccctggtgtggttcagcagcacgaaggactgctcacttggcatgtttagctctgacaatcccattccttccatcaggaaaaggcacaggcacaggagggcgccacctgaaggaagggacaagatgccataaaatcatagatggctccagaggaacggaagggagaaaaagggtgggccgttcacttctgagcttcaccccactgtgaccccaaaacctatggagaggttagttcatctctgcttttccacccaccttacatagcataccatcagaattaaatctttgcctacagaaaaagagaattccagccaggtgtggtggctcacgcctgtaatcccagcactttgggaggccaaggtgggaggactgcttgagcccagaattgcttgagaccagcctgggcaacatgaggagaccctgtatgtagaaaaaatttaaaaacaaaggaaaattagccgagtacagtggtgtgagcctgtggtcccagttacttgggaggctgaggcagtaggattgctttggctcaaaaggtcaaggatgcagtgggtcgtgattgcactattgcactctggcctgggcgacagggtgggaccctgtctcaaaagaaaagaaaaagagaattcttaattgtgtctatagtcattaattttcaatgacattttaaaagattgataaagtgtattaatttatcaatgccattaaaaaaagatttgttgttttacagaaataccatcattagaagacaaaaggatttaatgtgaaatataatgacagaagaactattaccaccaatatctctgatcaattgcttagtttctgccattattacagaaagtgatttctacccatttataatgcaatccttacaacattatgaaagatattttattacttccctgttttcagatgagaaaatggagggacaaacagttcaagtactttgccataggttacatacctacgaggaggtgaaccaggattctagaccaagtcttagctccctgctttgcataaatcattccacctgccttgcttctccagcccgttttcctttctgtaaacattaactaaatccctcagtgaccaagctccacctgaaatactacactaaggctgggcatggtggctcatgcctgtaatcccagcactttgggaggccgaggtgggcagatcatttgaggtcgggagttcgagaccagcctgaccaacacatagagaaaccctgtctctactaaaaaaaaaaaaatacaaaaattagcagggcgtggtggtgcatgcctgtaatcccagctactcgggaggctgaggcatgagaatcacttgaacccagggggcagaggttgattgcgccattgcactccagcctgggcaaaaagagcgaaactccatcttaaaaaaaaataataataataatacactactcatctataaaacagccacaattatcacctacttcactgtgttattgtgagcactgactacaataataggtagaacttaggaaattgccaattccaactgtctttggctataaaaagcaacaattacataggaaacataatcagtaaaagtttgggtaaaacttaaatgtttggtaaactcttaaataaatgtatgtacctgattatcttggcttttgacatttgcttttttttcttttaatttgagagtttggggcatttttgttgacaattgctgttttaatattcaaactcgcaaagttgtgtatgatagaagctgacagtcagaccccgggcttggtcagccttaagttttaatcccttcattttctcatctataaaataaagacagtgtccgggcactgtggctcacgcctgtaatcccagcactttgggaggccatggcagacggatcacctgaggtcaggagttcgagaccagcctggccagcatggcaaaagcccatctctactaaaaatacaaaaattagccagacgtggtgacgtgcacctgtaatctcagctacttgcgaggctgagacaggagaatcacttgaacccaggaggtggaggttgcagtgagaagagatcacgccactgcactccagcctgggtgacaaagcaagaccatctcaaagaaaaaaaaaaaaatgaagaaactaatggtactcattgtcagatgtaaattatttcatgtagagtacttagcacagggcacagaaaatttaagagctcagtaaatattaacattttctattacttattattattgtttttattaacagacttgctttcattaagatgctgttggtataaagctgcccactgcagcattatttataataaaagccagacacaaattaaatttcccactatagggaaagggcatagtaggattctgaaagaaccatctttagaattaatgaaaatcactttaattacaatgtaagcccctgctttgctacttgggggcagtacgattttgagcaagtcatttattttctctggacctgtttcctcacctcagaaatgaagggtttgctctcaatgactcccatgtcttctcatgatttaaagttacatagtcctggccagacagggtggctcacgcctataatcccagcactttaggaggccaaggcaggcagatcactcaagtcaggaacttgagaccagcctggccaacatggcgagaccccatctctactaaaaatacaaaaattagccaggtgtggtggcgggagcctgtagtcccagttactcgggaggctggggcgggagaatcacttgagcctgggagacagaagttgcagtgagccgagactgtgccattgcgctccagtctgggtgacagagcgagactccatctcaaaagaaaaacaaagcaaaaaaataataataaagttatatagtcctaaggttctcaatacattaaaatccatcaacctcaaggacaacatacaactgaggacataagaaaatggtagaaacggccagttgcggtggctcatgcctataatcctaacactttgggaggccgaggcgggcagatcatgaggtcaggagttcgagaccagcctggacagcatggtgaaaccccgtttctactaaaaatacaaaaaattagctggccgtggtggcacgtgcctgtaatcccagctacttaggaggctgaggcaggagaattgcttgaacacgggaggcagaggttgcagtgagccaagattgtgccactgcactccagcctgggtaacagagcgagactccatctcaaaaaaaaaaaagaaagaaaatggtagaaacacaagaaactattttataaattaatattcccaatcttctttcaccctactctttgtttccataacatttgtcacctcctaacatcgtttgtattatgtttattgtctttctccatgaactagacctaagcccatgacagtaggcatttatggctggtctgtccacgaatgtgtccccagcccctagaacaatgtctggcatatagtaggagctcagttagcattcattgaatttaaaaatgtgaatattaagttaaaagaacaaagtacaaaactacatatatcataaaatgcaaaaattaccttttgtttttgtttattttttttgagacagagcttcgctcttgttgcccaggctgaagtgcaatggtgcaatctcggcttaccgcaacctccacctcccaggttcaagcgattctcctgcctcagcctccctggtagctggaattacaggcatgtgccaccatgcccagctaattttgtatttttagtagagatggggtttagtagagatggggtttctccatgttggtcaggctggtctcgaactcccgacctcaggtgatctgcccacctcagcctcccaaagtgctgggattacaggcatgagccaccacacccggccaaaaattacatttataattatgtatattacatgtatatgtatgtatacaataaatacgtaataaagttatatataatagaatgcaaaattgtatatacaattaatataaaatatgtacccctatggagaaatggtagagaggatcagagaaggtaaaactcaatgataacaagatgaatgtggaagtgaaataatattctttttcatttttctttaacgttttgaaccattttgtttgtccaaaaagatggcattttaaaaaggaagagtgtgaacaggagaaatatggaagagaagaggaagcagaagtggccaagggagagaacctgatggagaaaataaggaaagataggaggggccaaagcaaacagaaggctcatggctggtagttactctattaatggaaatagaatcacacaggcagaaagaaaagtgagtagataaaggaaagacaatttaccttgaacttttaattccaagctaatatctattaaactactcctaggttgatagaatttccccccattaactgcctcaatccacagaagctttggtaaattttagcacaaaggaacacttggaactgttacgtgttactgttcttcattccgaaccttctgttgatcagctgctttggaggcaagaagaaagaggcccacattctaagactaactgaatgccacaggcattttcattagccaactgatccatcaagcatttcatctagggtcacctacttgggggacatagagtgtaggaaacagacttgtcttctaggggatgaaaggcacactacttactccaatacaaagcaacgcacaactgccaaataaatgacacggatgatatatcctgtaaaattaaagggctagaagagttccttccagcttgggaaggtcaggggagggtggcagggagatgtccagggaaggacttgtcctgcactttatccaataacagggaccctagtgctgttcgtgagcggactcttgaccccttcacctggtcccaacttgtacttgagatcacttgctgctcttaatgcctagagcccccaggtattggcctgggttcctcatcacagccatgcatttgccattttgagcaaaccaggtcagatcccctgtgcacgtgctctcaacctctgtgcttcttgtttacagcacacaccatcactgcaattgtatggttattgtgtggttccttaaacactgtgagctccaggacggtagcggccacactattttgtcaccactgtatccccagtgagagcacggagcctggcacaaggcgggcactcaacaaacagctgcagctggtcaaggagatggcattggtccagcctgaatcagcacaggcctaggttttaacgctactgtgaatccccagcatggccacagagctggaaccagggaatcagataagcaagacaaggaggtaagattgaaccctcgcccaaaattagcctaaatgatcaggtcactactgtgtaacctagtatttgaaatacagagatttagacagaatgacaggaaaaagtcaaacataaactaaaagtccgaaagagcttaggttctcacagtcactttttgaggctacaaaaggaaagatattgcataaaccttaaaaaaaatggaccagttaagaagtgtaactggtttagcaagcttcccttctaaaatcctggtgccgatttcatgttagaacacaggtttaatgagaacgtatccctctccccaagttgtaatacacagaagagggcaaaggggagaatgttaccttgcccaagctctggtcttatctcaacccacagacttggagaaaatgtctatagtccatttcagtatttacttagctttttaatttttaattttttttttgacacagactctcgctgtgtcccccaggctggagtgcaatggtatcatcttagctcactgcaacttccgcttcccaggttcaagcgattctcctgcctcagcctcccgaatagctgggattacaggtgctggccacaatgcccggctgatttttgtatttttagtagagatggggtttcaccatgttggccaggctggtctcgaactcctgatctcaggtgatccacccacttcagtctcccaaagtgctgggattacgtgcttgagccactgcgcctggcctagttttttaatttaataggctgcttgtacttataagtgcctgcatcagagtttctggatgaaatgaactaattttagaaatgggaaaaactttggaattcaccttcaatctaatatttttgcttatgaaaatgcagggcccaagtggttaaggaacttgtctaggggcacgatcccccagtcatgaactctggacccagggggaagattagagggatttatgtctatactgtctttatttccaaaggttagtctacatcactgaggcatcagtaaagtcctgtgaaatatctatactaataagcagtgtgcaacatttggtatggtatctggtgtgatctttcagggtaaaagtaggtaaattaattgctgtccttatttggcccttactacacacaacacacaaatctcttccaccattgcaaaatgttagaagatgtatgtgctgtggccggacgcggtggctgacacctgtaatcccagcactctgagaagctgaggcaggcggatcacttgagtttaggagtttgaaactagcctggccaacatggtgaagtcccgtctctactaaaaacacaaaattagctgggcgtgatggtgcacacttgtagtcccagctacttgggaggctgaggcaggagaatcacttgaacccaggaggcggaggttgcagtgagccaagatcgtgccactgcactccagcctgggtgacagaacaaaactccgtctcaaaaaaaaaaaaaaaaaaaagtatgtgctgcatgatgaagaaataagtggaaatgcaggctttctgagattttccagtcacccataatagcaaggaatggtatctttctcggtcacaacactaagctgcttacagagttcatgtaaatactgtttcttgctgttccacctctgctaggaacaccttccacaacactcccacgtttccgcaccaaactcctacctacacatcgaggctcccatcagaaatctctacagacgtcggaaatctatagagatattagataagcatttcaaggtaacttatttcctcattttaccttatggtaacagccctatttacctcttacaagcgttctacggtgtatcaaaaagaccaacaacagtaagaggtttgcatagcactgtgtattccattgagaaaagtgctacaaaaacacaagatagcattttattaatttattaaatctgattccttgagacacatacaaagcggtgttgatggatgaaccaacaaacccaagattaatagcctggtttactgcactcttttctccttccaagccacaagccaaaataaactcaccctcaatttataatgttgcaaaatgtgcttctaagcaccaatgcctgaatccactgtggttattaaaaggatggttgcatccatcgggatgggataggttatgctgtggtaacaaagaacacctaaatctcagccctaaggatgaccacaatggtccctctggggtcaagaaggtaagcccagcagccccatctttctcattttcacctgacaatctggttagccaactctgtggcttacataagtttgaaagatatgaccctctcctttccttctccaaccacctacaaaactgtctcgtggagcgcagtgagaatcagaagtgattatctttgtaaaacatcgagaatgctgcctggcatataggtagcagccagtaaataataatgatggctactaccattgtcacttccattatccccaccccttctcaaataataataataatgatattataattctcacagagcagtgattcctgaacttaacttgtcctgaacattagaatcatctggagagcttaaaaaaactaatgcttgtgtcccacccctagagtctatgaagtaattcatctagtgtatgaccttaggcttgggattttaaaagattgccaggtgattccaaagtgtagacaagtttggaaaccagcctcaagaggcagcaagattcatatatacacatacatgtctttgtgtttgcacacacacacacacacacacacctgctcccaagttccatgaatcatgctccctgtatgacagtagtggttatatcacttagggtgagctgggttatgctgtggtaacagagcccctgaatctcatccctaatgaaaaccaattgatcacccctgcagggtcacaatgagcccagaagccctgtttttctggtctttacctgacagttaagcctattcttttttctttttcagtctttacttgacatttaagcctatttttccttccttccttcctccctcctccctccctccctccccccagcctctctttctttctttctttcttggctcttgctctgtcacccaggctggagtgcagtagcatgaccatggttcactgcagccttgacctccagggctccagtgatcctcccacctcagactcccaagtagctgggactacagacacacacgactgtgcctggctgatttttgttcttttcttttctattttctttttgtgtgtgtagacacagggtcttgctgtgttgctaggactgacctcaaactcctgggctcaagcaatcctcccaccacagcctccctaaatgctgagattacaggcatgagccactgtgcatggcctaagcctctgcattttatcctcagacctttctcatgttctattttcttctacttcatacctttccccaagtccaggtaaagtttgcctggcccagagtaaatcagcacccaaagatgacaccaatgtggacagacttaggggaaatctggttagaagaaggccactaaaggctatcagtacttaaggctgtactttgctcaattctctgtccccaagacttaaaacacagcacacaatgtggtagaaatttggatagttaaatcagttatcatcagtaataacctagaagaaaagcagacacaagaactcaaaaagcacagcatctaagctgaaaaccttatttatcaacttgtcaccaaccaccatttgaatttcaaatttttttattgccggcacgatggctcacacctgtaatcccagcactttgggaggtggaggtgggcggattacttgaagtcaggtgttccagaccagcctggccaacatggtgaaaccccatctctactaaaaataaaaaaaattggccggcgtggtggcacatgcctgtaatcccagcactttgggaggccgaagcaggtggatcatgaggtcaggagatcaagaccatcctggctaacatggtgaaaccccgtctctactaaaaatacaagaaattagccagggatagtggcgggtgcctatagtcccagctacttaggaggctgaggcaggagaatggtgtgaacctgggaggcagagcttgcagtgagccgagatcgcgccactgcactccagcctgggcgacagaacgagactccatctcaaaaaaaaaaaaaaaaatacaaaaaatacaaaaaattagccaagctaattagccaagtggcacacgcctgtaatcccaactacttgggaggctgaggaatgagaatcgcttgaacccgagagatggaggttgtagtgagccaagatcgtgccactgccctccagcttgggcaaagagtgagactctgtctctggggaaaaaaaatattaatttctccctggataaaattgtatctgctggggtggaatggaagtaggtgaggttgggggacctatgaagaaaaaagagcctttccactgggcagtgaagtgtgtacacacacactgggggcagagcagtgtgaaaacattctgcaccagcacacaaatgacttttggcaaatcatcttcctgatctgtcggatgttacgtctctgcagaatctggagaaaaccagaaaacccagcttgtttgccctcattttggcagtttaatttaggaatcacactggctttacataaactctttaccaaaaaaactgtattctgtattttgaaggcacaagttaacatgggcccaagggaaggaagcattgtatacaattacataatagctactctattactttaaaacctaatggcagcctcgggcagaaaagtcaaaaggggagagaaaccatttctgtgaaattatctgatgcaatcatctctttggagacattgtcagttgacaatggttctgctttttctctcgagctcattcaatttctgttatttacctgaacctggaagcagagttttcctcccatctaccactggtttaaaaaaaaaaaaaaaaaagaggccgggagcagtggctcacgcctgtaatcccaacactttgggaggctgaggcgggtggatcacgaggtcaggagttcaagaccagcctggccaagatggtgaaacccccgtctctactaaagatacaaaaattagccggctgtgatggcgggcgcctgtaatcccagctactcgggaggctgaggcagagaattgcttgaatctgggaggcagagattgcagtgagccgagatcatgccactgcactccagcctgggcaacagagactctgtctcaaaaaaaaaaaaaaaaaaaaaaaaacaaaggcaggcaggatttctctaataaaagcttgaaatgaaaagcagtaactactcccaaggccctgcttattgtagaaaagtcattcaacaaatctttttaggtctctattaacaatttattttctctacccccatcacaaaaaagcagaggaagtagtgtagcagccccagccacagccacagccacaccccactacttgcttcctaggtgtgtgtggtgtgtgactgcctgcaagcaactccagctctctgaacttgtttcctcatctgcaaactggaaatatttatttatttgacaaggacattatgagaatttactctgaaaaatacatgtagagtacctagcattcaattaagactaggtgaatgcccttctcaggaaccgtactagagaaggtgagtttctggtccagtgtgatgactcacgcctgtaatcccagcactttaggaggctgaggtgagaggatggcttgaacccaggagtttgagaccagactgggcaacttagcaagaccccatctctattattaatattttaaaaaataagaaaaaggtgagtgtctaataagagataatacttttacccatctttgtacgccaatcctaccacatctactccactccttccccatcaagaggcattcttcagtcaggcacaccttacctccaattccaagggcaggtcctgaatggtctaagccaatcagtattatcccatttcccaccacaattaattgaaagatgaatgcatgtcctgaaatgatccaatcaggacaaagttcaggaagtttgttcagtggctctagggagagatggtagctcttttctctcacgactatgaaggaagtcaatctgagaagagcccacagacagaagtacagagctgggaggatcttaaggaaaggaagacggagccctgacctatcctacctctacaatttttggttatgtgagccacttaactgcttttatcaattatcccatttgaactgggatttatgacacttgcaattcaaagcatctaactgatacatcctggtgcatggctgaataaatcactgaatgaaagactgcacacttccaattatttaactcagactttaagttccctgggagcagaaaccctggtcaatcttggtcacccagggccaaacagagtttctgtacacaggccctccttaagtactttttaaaataaatgaatgaaatgaaacttaacaaatcacgatcaggcgcagtagctcgtacctgtaatcccagcactttgggaggccaaggtgggtggatcacctgaggtcaggagtttgagaccagcctggccaacatggcgaaaccccgcctctactaaaaatacaaaaattagctgggcatggtggcgggcacctgtaatcccagttactcaggaggctgaggcaggagaataggataatcgcttaaacctgggaggcagaggttgcagtgagccaagatcgatcgcttaaacctgggaggcagaggttgcagtgagccaagatcaagccactgctttccagcctgggcggcagagcgagactctgtctcaagaaaaaaaaaaaaaaaaaaaaggctgggcatggtggctcatgcctgtaatcccagcactttgggaggccgaggcaggcggatcacaaggtcaggagttcgagaccagcctgaccaacatggtgaaacccccatctccactaaaaatacaataattagctgggcatggtggcacgcacctgtaaccccagctctcaggaggctgaagcaggagaattgcttgaacccgggaggcggaggttgcagtgagccaagatcatgccactgcactccagcctgggcgacagagcaagactcagtctcaaaaaaaaaaaaaaaagaaagaaagaaagaaagaaactaggaaacttaccaatcacctcacatttcagaagctttgaaagccctactccccagacctacctggatcaaaggagggtcaagaggaagcccatatgattttggagccatcagacagggctgggctcaaatcgtgactctaaataagcctcggcttcttcccctgaaaaatggagacaataatacctatttccctgggcaggaggagccatgtcaaagaaccagggggaggtctcattcaagaaatatttatttcccccctgttcagctaaccctacttcattccatgggttctgctctggggttcagaaacgggagtcatcatatggacagagtggtgggacacagcccagatcacccagcagagccagccctgggaggatgagaacaggtgaggcacaccctaagcctcccatacctcaatatccatcagtccctttaggagcagcatcctaggcagacagcatagataaaactgggccatccagcttcttggttttgctggttgcctccttacagaggggtgggactagtgcaactcccattatcatagatctgtacaaccttagaggctgtcatttaaccgtttagaagtaatatggaacttggccagactgtaagctccaagagggcaggggcttgaatcattcactagtccatctctggtacccaggtaggcaatcaatggaatatttcctgagtacatgagtgaagatgaatgagtggataaacaaatattgatgaaatcaagatctcagaagagaactatggcaaaaccctattatttagtacagtctgctggctatgcagcagctaaatcaaataccaggcaatgcaaggggcttctgaaactggcagacctagactgaattctggccttgtcagagcccaggcctatgacctcgggcaagttcctaaactctctgagctagtttctttaacaaacacaattatcaagattaaataaaaattttttaattgcggccagatgcagtggcttgtgcctgtaatctcagcactttgggaggccgaggtgggaggatggcttgagcccaagagttcaagaccagcctgagcaacatgggagaccccttctctaaacatacaaaaaattagccacgcatggtgctgcttgcctgtggtcccagctactcggggaggctgaggtggatcacctgagcctgggaagtcaaggctgcagtgagccatgattgcgccactgcactccagcctgggcaacagagtgaaaccctgtttaaaaaaaaagaaagaaagaaagaacaaaagaaagaaggacagaaaaagaaaaaaaattagctaggtgtgatgtgtgcctgtagtcccagatactcaggagggaggcaggatgattgcttgagcctgggagactgaggctgcagtaagctagaatcataccactgcacaccaacctgggccacagagcaaggccttgtctcaaaaaaatgaaataacataaattaaaataaaaataaacgtggggtgatgtcaattaaagtgtctagcccagcatctatggcataaaatagggacccagaaaatgtcccttccctatgaatgccctttacgtttggaaacagctatcatatgtctcccctgtctcctatttcttgttaaatatttcagctaatttaatggtatccttaaatgacttgatttcagagccctcttctatccctcccctctgcaaagtctccatctgttaaaaccccactcggggtattgcataaccagctcgcagaatcagcagcacgctcctgtttgctcattcatctgttaattcattcactgagtaaacactgattaaaaacctactatattggacatccttggcttttgcctacccaccattcacaaacggtacccgcatttccctggaaacctgcaatctttccctcattctcagtctctgtacctgagcaggtgcaagctgcacccaatctccctcagggggagggcatttgatccaagatggccaatcagagcgtcgcatttgcctgccacagcgattggttcagggctgtgcatgttacccagaaaagaccaatcagaaagacagttggactcagttctaagacttgttgaactactggaacagtggcctttttttacctcctgctagaaccgctgacaaccattttggaccacaatccacaagaaaagggaggcagcgttaaagatggtgaaaaactgtgtaagccttggcaacactttaagccttggatcctccaggccttatgtttcactcctagattcttcaattacataaaccaacaaatcccctttctgcggaagccagttcgaggcgagattctgtttcaaggtcgacagaatcctgactaatgaaatccgaagtgctgtggtgtatgctgcatgctggctatacacagatgaagcaaggtgatccataccatccttccaggcactcacaggctgatgtggagacagccacaaacaattacagctatttaaagccaataagataactgctttaattaaatactacacagtgcaatatgagcacagcaaagcacctgggtccaggaaggcctcacagagcaatggcgattaaacctattccctctctctattcaggcagtgaagatggaattactagttggaggagtcagataacactgttgattcacattcatcttacagtaaactaaaaccattacatcccacgttgcacagaagggcgatgatacttaaagctcttaacagctctctctgagcctacaaaatactgtctcaagagaccagcaaagtgctaaggtcaaataactctcacttgcaagtgtttcatctgaattgtgcagataatggaacgctcttaaatactacccaggtcagtttttgtgattttgattccatacgcttaaattttcattccatccttcttgaccatttggatttcttgtccatttgtgtgctgatcacatcacaacagcatcaaaacagccctttcaagatgaataacctacttactgaatttatttccagatgatcaagggaaggggaagagagaaagtctctggttctataaaacatttcctgatgggttagaaatgtggctgattgcagaaaacaacaataacaacaataaaaagcacctctgggaacatctgttttgagaagaaaggcccctaaaggtcagtctttttaagtgaacagaagctggtgtctcttagtcctttgatgatgcatactcaacgggaaagttgtaaagataaaataattcaggaaacgaggacatcgcaggacaaattctccttgcctttattgtttctaaacacatcagcaattcatgtggtccagaaacacaagctacagctttccagaacaaagaatcttacagttggaaaaattagtactgactgaatacttccatgtggactcaagagaggtgccagggactagtgtcaggagagacgaagttaagatgcctctcagataactcagatttctatgaagcagctgggttacccgtttccaaaacaccttgcaggccgtcatggaatttcccttcctctacctgcatgccacaggactttgcacaacaaaggtaccatccattttcttgaaaatgggattatcgggccaagcacagtggctcacacctgtaatcccagcactttgggaggccaagtcaggaggatcacttgagcccaggagttcaagaccagcctgggcaagatagggaggcccctgtctctacaaaatgaaaaaagtgagccaggcgtggtggcacatgcctgtagtcccagctactcaggaggctgagcctgggaggtcgaggctgcagtgagccgtgatcgtgccactgcacttcagcctgggtagtcaagcaaaagtctgcctccaaagaaataaagaaaaaggaaaagaaaatgagatttgtcatttatcacacatttactgggcagctctgtagtccaggtatcagcaggcaatggagagaactccagtgttatggatgtgtgaggacacctcctcacatccttacccgtgtgatctgtcttacctgtgagcagataacacagggaactgcctgttgcttggcaaatgctcaataaatgttggtttcccatggggcatatgcaaccccaccaaggggacctgccaaatctcctctataaacattcaaagaaacataaaaggacacatagcaggatatcttccacccacccaagacccacaatcccctaagcttttccaagagatatacagaattcccccagacactgtgtgtgtgtgtgtgtgtgtgtgtgtgtgtccttccagcaatcgcccaggcataatcaagcatgagtatgtgtgtgggtgggtgtgtataaacacttataccctcttcttgttttcctacatctggcagcataccacatatactttcctgcaaattgctttattcttaaacttaagaatatatcctgaaaatcattccttcttagcagatatgacctactattttaaacaatggcggagcaatccactttaagaatatacattcaggccgggcgcggtggctcacgcctgtaatcccagcactttgggaggccgaggcgggcggatcacaaggtcaggagatcgagaccgtcctggctaacacggtgaaaccctgtctctactaaaaatacaaaaaattaaccgggcgtggtggtgggtgcctgtagtcccagctacttgggaggctgaggcaggagaatggcatgaacccaggaggcagagcttgcagtgagctgagatcgcgccactgcactccagcctgggcgacagagcaagactctgtctcaaaaaaaaaaaagaatatacattcaatcaattcgctactttttgttttttggagttttgtttgttcattttttgaggcagagtcttgctcttgtcaccgaggctggagtgcagtggtgcagtctcggctcactgcagcctccgcctcccagattcaagctattctcctacgtcggcttcccgagtaactgggattacatacaggtgtgggccacaacacccagctaatttttgtattttttggtagagacacagtttctaccatgttggtcaggctggtctcaaactcctggcctcaagtgatctgcctacctcggcttccaaagtgctgattataggcatgagccaatgcgcccagcctaaatcaattccttattgacatacattaagttgcttccacagtctttctattactagcaatgctgcaatgagtatatgttacatgcatcttcacacacatttataactataggaaacatagaatttataagagaaaatccttgaagcagaattgcaggatcagagggtatgtgcactcagaatggtgccaaatggccctccaaagaagttgtactaattttcactctcatcagtagtagaatgagtatgcctgtttctccaaccacagtcacaaaaggttgttttgtttttaaatacaaaagaagaaaggcagagctcactcttgtcccattgtctcttcttgcccctgtgatatcattaatgacatgactacttcttaaaaattccacacctggatgcaaaacccagagatcaaagtttaaaaaaggccaggcgcagtggctcatgcctgtaatcctagcactttgggaggccaaggcaggaggatcacttgagtccaggaattcaagaccagcctctataaaaaataaattttactttatttttaaatttttaattaattatttttagatagggcctcactccatggcccaggctggagtgcagaggaccaattctggctcactgccacctgggttcaaacaatcctcccacctcagcctcccaggtagctgggaatacaggtgcataccaccacacccagctaatttatattttttttgtagaaacagggtttcgccatgttgcccaggctggtcttaaactcctgagctcaagtgatcctcccaccttggcttctcaaaatgctgggattgcaggcataagccaccaagcacagacaaaaataaatttttttaaaaattatccatgagtgttttttaaaaaattagtgcagtggcccataatcacttcactgcactcaagcctgggcaacagagcgaggccctacctcaaaaataaaaaaacaacaacaaacagagtttaaaataaaatgaatgccaaaggcagtggtgttctgaaggtggctatactgactcaagagtcctaaccatgttcatttcttccaaactccgtgttcagtggcatcatgttggtagcttgaaactggtcatggtggaagtatttacaccataggaatcagcaaatgctacaaattagggcttcttttcttttctttcttctttttcttttctttggttttgttttgttttgttttgtttttttgtttttttgttttttttttgagatggagtcttgctctgtcgcccaggctggagtgcagtggcgcgatctcggctcactgcaaactccacctcccaggttcacgccattctcctgcttcagcctcccgagtagctgggactacaggcgcctgccaccatgcccggctaattttttgtatttttagtagagacggggtttcaccctgttagccaggatggtctcgatctcctgacctcatgatccgcctgcctcagcctcccaaagtgctgggattacaggcgtgagccaccgtgcccggctttctttcctttttaaatcactgtaaacatttaccagcacaccaatgtagactacagtgaaaactgagggtataccaccctcctttgaatattttgccctcaatggtgacctggtcacaaattcttggaacctaaggattggaagatgtctgaaaggacatctaatccttacgtcttctaatactgcctctcccttagtccctctatgtagatgtaagtagtgccattgatacttcttcaccattatttcatatacccatctctttatcgcttagtgcctactcttggtgatttcccatagtataatacttgcaaacacagacccaaggctacccaagacagcctggagtcaaatcccagatccatcacttaccagctatgtgaccatgagctagtggcttaaactgctatttagtttatttgtctataaaattcagatgatcataatgcctcctcataattttgttctaaggagtaaatgaattaatgcaaataaagtacacagaacaatggcatgtactatgcacttaacaaattttaactgtcatcgtctctcagctcagctcattaattctctctttagctatgtctaatctgtcatttaactcttttgttggatttcaattttaatgattatttttcctttcaattcagctgctcttcaagtcaacctattctttttccatctttctttacattttttatatcatccttagttcttaatcattttatttcttttttcttgtgaacctaaactaagacatcttaatcattttaaatataccatttttatagtctcttataaatggttttattatttccaacttggaatggtttcctgaatatagtttttcattgtgaactcgtcttcagaggtcattctcactgtgggagtgctgttaggtataggttgttgaaatatgcctatggaatgactttgcgttcgcagtagaggtttccatggtactagaccagttcttacgttaatttttcaggttgaagggtctcatacctcataagtaataaaaaatacagattccacaaccatatatagtacaatcccatgtgtttaagttcttgctggtaactttttttccagtcaagtcaagcttcctctctatttctccaagtattgaagtttttctagccccttttcatgaaaaagtcagaccttcaaggctccagagcactcaattccaccttgagtccaggcctccttcctagagccaccgtgccattaaaactttggccctcaggctctatagcttctgtgcaaaagccccaggagtagtcatggcttcagctcacatgccaccatttagcttaaatttgtcctccttttttttttttttttgaggtggattcttgctctgtcgcccaggctagagtgcagtggcttaatctctgctcactgcaactttcccctcccaggttcaggcaattctcctgcctcagcctcctgagtagctggaattacaggcatgcgccaccacacccggctgatttttgtattttcagtagagacaggccttcgccatgttggccaggctggtctggaactcctgacctcaagggatctgcctgccttggcctcccaaagtgctaggattacaggcgtgagccaccgcggccggcctatcctcatttttgacatttgcaggtttccctttcttcagcgctcccctagataaaattcttatatttccatcaattctgtattcataccaggaaggactcacacaagtcagcttagtccaccatgctgccagaagtattccaggtcactaaatttaatataaccacttatccacacttgagttctgcccacattaaaattgtatctactcaagggttagcttctgaagccagcatgttgtgtgaaaattgaaagaagccaaaattccccttgaaaaatcccacaataaggtctcaggttggagacaaacaaaccatctttcatgaagtccaacacagccagtctttccttcagcactggatttggtttcttagggttgggcaccatatgtaataactggcttagatttaggggccatgttgtgtgataattaaaatccataaatatgagaaacatatttggtggcacaagatgctcacatcctaaaaagccatgagaacaaatgaccaacagacggaatagcagatccatgtctgccattcacacccactccaagagagacgcccattgggtggaatgacaggatcacctacactatttaaagtggtgttttatccttttgcttttgttgagcaagtatatttggatacggccaaggtggaagcatgaatctatgttgacagacgtcagaatagtgcttatctctggggcaacactaagtgcaaagggcatgagggacctttctagaaatattgtatatcctgatttgggtggtgattagatgggtgtaacatatcaaaatttcaccaagctgtacgattaagatttgtgcattttacagcatgtaagatagctcgattaaaataaaagttaaaagcacgcctacgtagaaatggctgtacagtattttgccaaaggtccccatcctatggttaagcctcaccagtgaggatagttgggagtctaggaaaccgggggaaaaaagaagtagaaaagggaagtgcactgtcacagacagagggcacccaggctccaagagtcaatggttttccgtgaaggcccttatagggttgacaagactacattagttaagagcactgactttcttttttttttttttttttgagacggagtcttgctctgtcactcaggctggagtgcagcggcgcaatctcagctcactgcaacctccgcctcctgggttcaagtgagtattttgtatttttagtatttttagtaaattttgtatttttagtagagacgggatttcaccatgttggccaggctggtcttgaactcctgacctcaagtgatccacccacctcagcctcccaaagtgttgggattacaggtgtgagccactgcgcccagcctatagttcttatttaaactaataatttgacctaaaaaccttgtaggttcatggaatgaatgaatattcatagagtgaatgaaggggtgtatatgtattctgatttcaacagaggtaggaggttcttatttctatgcaactgaaatccatcttgtagccatcaccatccactttaatttttcctcataggaagtgtggttaagagtgctggctctggagccagatgaccatggtcaaattccagctctgttacttaccaactgggtaaccttgaatgagttaatcaaattccaggcctcagtttcttctcctgtaaaagagttatagcaaggattaagcaagttacaacagttctcagtacacagaaagcccccggtaaatcctagctattgtttttttcccatagtagaggtacagtttgggaataacaactccaaatagcatttgtttgtttgattgtttgtttgtttttaagacatagtcttgctctgtcgcctaggctggagtgcagtggcacgatctcggctcactgcaacctctgcctcccaggttcaagcaagcatgcctggctaatattttttatttttagtagagacagggtttcatcatgttggccaggctggtcttgaactcctgacctcaagtgatccaccagccttgacctcccaaagtgctgaattacaggcatgaaccaccgcacccagccccagatagcatttgtacagtccattatatcactgaattgttttgcaaacagttttctcatttaatgctcaaaatagtctggtatattacaaataaataaacattcagagaagttgaataatttgctgaaggttgcacagcaagtaaagaacaaagacctaaaccaaactcctatgactgaaggacagtttggctggactgtgttgtccttaggagcatatatggtggggccagcgctatccatggagattcagtataaaggatattgggacccttggctgcagcagcaagtcttggtcccagcaaaatgctcagttcaacttgagtttaaaacggtcttagtcattctgtcccctgaatcacttcctgtttcaggtttctactttgcagagaaagaaacacaaacaggtacattacgccagccttgtcaccctccaaaatctcctacagcaacaaaagctgatgaattaaagagaagtttcataaaaccacagttaacatcccatttaatgcattagccagcagttagtgtgaagatctgagcaaagtcggcagtgtctagacactcttattattgaatggaagagaaacaggatgactttttctctggcctttattctgattaaatctttagctgccttagtgttttctctttgcttttcattgggtgctgaaactaccggaagctacttaaccagccttgttttattcacaaaaggtttaggggccatgtctaattgtccagagagaaccctatctgctgataatttcagccacttcggctgcttttgcagctttttgtttgccagtgtaggttttctttctgtcgttcttcttgctatggcatgagtgtggtttcacattcccttttaaataataatcaccgaactgctcagtggccaagaagaggatttaagaaccatctaggccaggcacggtggctcacccgtaatcctaacattttaggaggctgaggtgggaggatcacttgagcccagtaatttagggagctctcgtctctacaaacaatttaaaaattagctgagcgtggtggcacatgcctgtagtcccagctacttggcaggctgagacaggaggatcacttgagcccaggaggtcgaggctgcagtgacccatgatgtgcactgtgctccagcctgggtgacagagcaacccgtctccaaagaaaataaaaaaaagaaccatctaagcatactgcatactcacaaactatgtcctcttatgtacacacatagactccacacataccacacattcattccatgtacacacaccacacatacaccatacacacatcccatgcacacaccccacacacatcccaggaacataccccacgcacatgcacaccacacacacacaccccacatcactcacacacccagcacacccagggcatagagtgtggctctgatagaagtaacatgggcctctaaacaagtgtggcttcttttcatttccaagctataggcagaaagcctggactacagctctagaaaccagatctcgcctcctcttcagcctcatagcatgtgtctcatcccttctcagtctttcggagcatctgacttgggcaagtcacttaacttctgttataaagtgaggacactcattcactcaatagctactgatcacctattgtgtgccaagcattgtggccatggaaataattccatgaattaaaccgtcccagccacccaggagctctccaagattaggggagcaattacaggcagatgaacgctctgaaggaaaggggatgaggcaatctctgaaaagggtatttaattaactcagcaggggatggaaagtgatggataatcgaagaaagacttccccaaggaggtaatactgaagctgagaagtaaaagttaagttagaattggccagaggcaggaagggatccaggcagagctctccgcacaggcaaaggctggcaagttagactgctggtccattcagttaagcacaggaggtggaagagggatgggcctcggtatgtcaggggtgggcttgccagggttacccgcctgggccaggtgcccccctgaggtccctcccagccctcaaggcagattctatcatcttctgagagcccaggtcctctccttccctgacagccttttcaccagcatgctgaagtcggctccagaggacaaggggagtcccaaccacctcacgtggactcctgctccttcctctttcgtctcctctcagcagtgaccagacagtgactcagggaagggagctgtcctctatttgtcatttagttctttaaaaaatactcgcctgtagtcccagctactctaggggctgagaaaggaggatcacttgagccttggagttcaattccagcctgggcaacatagtgagaccctgtctctataaaaataaaaattaaaaaacacccagcgctcttatacccaactagccttctaaccaactccctcctttctcccacccagtccctcacctagctgagaaaggctggatttctctgtgtccttatccgtctcctccaagagactttaagctttaagctacctgagggctcatgctaggttttggtcatcctggtgtcccccacacccggtactatgcctgatgtctagtagatcaaactgattcccctccctgaaaatgagcactgcccagaacccacccacagggcagcctgtctgaggccaaggcaggagacccagaatccagccgacccaacactcctccccacagcactctgtaggagactctgccctgtgaatcccaatttgaaaactgacagctatgttagtctaattccctcattttatcaacaaagaacctcaggcccaaaagaatgatatgacttgcccaaggtctctcagcaaatgtgatataaagtttttttaaaggagcaaaacatcgcttaaatggaagcctatctatcacccctaccagaaacgttgcttattttaagaagaaaacccttaatgtttgcaagtcgaatggaagctttcctttctctgaccaattttgccatactttcatgactcctgggatgctctaggcagcactaaaagttcccactgaagcaaatctatttacaaaggtgaccaggaattgttttagggattggatatatttttgattatggatcatttttaaagttaattatctattatgtgatctaaggctataataattttttaaacaattgagcctcccaaaccacttagatgcttcctggtttttaaaaatgttttgctattttaaaatgttttgctattaaacaactttactagaagtaaaaaaaaaaaaaaatcacagatttttttttttttaaacttcaaacagggtctcactttgttgcccaggctggagtgcagtggctcaaacatggcttactgtagcctcaacctcctgggctcaaagtgctcctcctgcctcagtcccccaagtagctgtgaccacaggcacgtgccaccacacccagataatttttttttttttttgagacggaatctcgttctgtcacccaggctgcagtggtgcgatcttggctcactgcaacctctgcctcccgggttcaagagattcttctgcctcaggctcccgagtagcttgggactacaggcacctgccagcacgcccagctaatttttgtgtttctagtagaaacagggtttcaccatactggccaggctggtctcgaacgcctgacctcagaatccgcccacctcagcctcccaaagtgctgggattacaggcgtgagccactgcgcctgacctaattttttttatttcttgtagagacagggtgtcaccatattgcccaggctggtctcgaactcgtaacctcaagcgatcctcccgcctcggcctcccaaagtgctgggattacaggcgtgagccactgtgcccgaaacagatgatttttaaggaagacatttctacccataatccctccaccaaaagaaagaattccttacaattctgtgtcctcctaaactgttttatccacagttctgtactctggacatatgtatgtatttcattaaaacacattacctttagtataaaagattgttaaatagtttccttttttcttaaaaaataaaaaagacaaaaacttttattatgcaagtcactggcaccatgtttctgataaacgccacggagcaaaacccaggctacaagttaagagcacctggaaattctgggtttgagacttttaaagcaacattttctagcctgcttcattccataattattctgacactttccacatcccacttaataggaaacagacgaaggaaaacaggtgttttgcttattctacttggcatagcatgctctactgcagaagtttgcagcagttgcttattgctgtatttttcctgcaagtgaaatgacatctctggtttgtccagagtttaaaaatactgcagccgggtccccactctgcataattaaacagactctctggggaagcaccccagcaccatattgctccaaagctccccaggtgattttcatgtgcagctgggactgacaagcaccaggctaagataactcattagtcaaaggaagcccatgggaaatcttatctggaaatgaagaactcttgtaattaaataaaatagcagatgtaaaagtccctaacagtgcctgttacccagaagacaataaatgttaattaaacaaaaaaaaaatttaaataattactccttcccctcagtggattcatcttgttattttattggcttgtttatcacttgtttttttttctttaccatgattcattctatccctgttaataaaattataaacttatgcctataatcctgttcaattacaagagctctgtaatatttctaacaacgctttattgctttatttaataaaactttcccccagtacagtggcttatagcaaatatgcaataaacatctgctatttataataataatggatattcagaattactttaattcagaattcatgaccgtttttctaaactagactgaaatttatttcacattattaggaccagttagcaacaatgtaaaaaattattacggcaatgtttaacaaacttaagaaaacagacctttaagcaaaccaattcttttttataatttcctgggaaaaaactaaatgcagtcattacacaggtgaacttatctcccattcaaggaggccttgctcagctcttcccatagttacctggagaggctaatactgcaattagttataagcggtttttccttccaatttctccctacggctgcctctctgagcgtgaatttggaaggtgattcttaatgtttacattacccctcagttctgagaagccaaacatttgtttgaaaaaaagaaatagaatttctgaatcagaagaaagagtttttgtgtgtgtgtttatgtgttgttgtttttttttgttttttggggtttttttttaattgagacaaagagtctggctctgttgcccaggctggagtgcaatggcgcaatctctgcttactgtaacctccgcctcctgggttcaagtgatcctcctgcctcagcctcccaagtagctgggattacaggcatgtgccaccacgcccaactaatttttctatttttagtggagacggggtttcaccatgttggccaggctggtctggaacacctgacctcaagtgatccacccacctcggcctcccaaagtgctaggattacaggcgtgagccaccgtgcccagccagaacaaagaggtttcatgaaggccatttccaaatgtcttgccttgctggcacaaacttccccagtcatcttttcttgtgttgtgccagacagagaaggcatctaacaggtatgtgggaagctgggccatgttcagctcaagattcacactcgttcacagtagacctctgtatggctcacacatgaactctgctatgcttcagttcctaaggccatccagctcccaaagtctgccatgtcatgttttaaataaactggactcgacacccagccaaaaataataatgatgtgcacgtctctgtatgtaaatgtcaataataaggtacaaaatgatcacacatgggccaattcccatcctatactatttggtattatcacctaatatttgtcctcactctttttttttttgagacggggtctcgctctgtcacccaggctggagtgcagtggagcgatctcggctcactgcaaactccacctcccaggttcacgccattctcctgcctcagcctcccaagtagccgggactacaggcgcccgccaccacgcccggctaatttttttgtatttttagtagagatggggtttcaccgtgttagccaggatggtctcgatctcctgacctcgtgatctgcccgccttggcctcccaaagtgctgggattacaggcgtgagccactgctcccgtcctgtcctcactctttcaatgagatcataagcaccttgagggtggacatcttgtattagcagtagtagaagtattaattttattgatttatttatttttaatagaatcttgctctgtcacctaggctggagtgcagtggcaccaccatatctcactgtggcctcgaactccggggctcaacagatcctcctgccttaagctcccgagtagctggggtactactcagttgtacaggcgtgtgccaccatgcctaattttttttttatttcatgtagagacgaggtcttgctatgtgcccaggtcaatcttgcactcctggccttaacaatcctcccatctaggcttcccaaagccacagtgggccaccgtgcccagtctaattgtagtttcgatcctcttaattgaattgtctatagtgtgttatatagctaatcagattacctgaataataaaacttctctttcttatgttttcatttaatattcgatcagccaagcactaaatgactattgtgagatggttgtggggcaggcttcacacaagtgattccaatttgtcttggttgatttgaacttgtaggaaaaactgcaatgtctgaaacctccaccgtaacagatttagagagaatccctggagactcaagcctcgcgctgtgggcaccatctccccaggcatgtgccaggatgatacagaacaaaagatgcacctcaaaaatgaatacatttggaggaatcctcccctgtgctagagttttctaaagtatccctcaatccattcagaacatgtccttttatattagccaggttctctaccactccatcaatgtgtgttattattattatttcccaagtatgcagttcagaaaagatgctaatacactggggttggggggtgtcctttgaaacacattcccaggtgtttaatttcctattcataactagtgctaaccagctaagtgcgtgtacacacacacacacgtgcatgcacacgaacacacacacctttttaaaaatatatcaatgttggccgggtgcggtggctcacgtctgtaatcccagcactttgggaggccaaggcgggcagatcacttgaggccaggaattcgggaccagcctggccaacatagtgaaacctccatctcgtactaaaaataccaaaaaaattagctgggcgtagtggtgtgtgcctgtaatcccagctactcaggaggctgaggcaacagaatcacttgaacctgggaggcagaggctgaagtgagcggagatcgtgacactgcactccagcctaggtgacagagcaagactctgtctcaaaataaataaataaattaattaattaattaaataaataatatatcaatgttttacaaccctaataccaggaaaacacaaagtacttctggttttcagtgcatgtttaccaccaagatgcaaatcccatacacattttggggtgccttggaaataacataactgattcttgggtccactacaagtttacaaacattctctggcttggattttctgtcaatagtagcataacatttttctatgctaacatatgaaggaataaagcctattagaggttcttttattcacaaactgtcttctccgagactataaccttttaggttgaaccactattagctggaaacttcctctggaaggataagtgagaacagcgcccacagtgcaccttttgcccagaactcgggcccaagatctggggagatattgctataatactgggtcgttctctttcaaagatgataaacagcaggagggtctattaattatcatttcccagctggccatggtggctcaagcctgtaatcccagcacttcgggaggccatggcaagcagatcacctgaagtcaggagtttgaaaccagcctggccaacatggtgaaacccagtctctactaataatacaaaaaaaaaattggcctggcatggtggcaggcacctataatcccagctatttgggaggctgaggcagaagaattgcttgaagccaggaggcggagggtgcaatgagccgagatcacgccattgcactccaacctggatgacaagagcaagactccacctcaaaaaataaaataaaataaaataattatcatttccctttaaactcataaacccttaaacatgaaccatcttccagaaccaattctgatgcatgataaaaataaaaacacagtttctacattttgcctaccacactcctggcataggctgatcacagcttaagacacacatcttcatttttccacagtatcatgatctattgcttacatagttaaaattgtttttaatgggccagagaaggaggttgcagtgagccaagattgcaccactgcactccagcccgggcaacagagcaagactccatctcaaaaaaaaaaaaaaaaaaagaaaagaaaaaagaaaaaaagctgtagtacttgcagctctatgtccaagtgacaaatctgccttccagaaatctgatttttgcggtgggggaggacaactacatagcgtggtgcttaacatgttgataaatgttcaaaagaagttttttgatgctttaggccaatcatctgtttaaaccaataacattaattattactgtgtattttaatacgcagtcttgtttttcaagaagtccagttcagcacaccattgatttaataaacaatatgcgctgggcgtggtggctcacgcctgtaatcccaggtactcgggaggctgaggcaggagaatcacttgaacctgggaggcggaggttgcagtgagccaagattgtgccactgcactccagcctgggccacggagtgagactctgtctcaagaaaaagaaaaagaaaaaaaaaaccatactatgaggtcaggcacagtggctcacgcctgtaaccccagcactttgggaggccaaggcaaaagaatcggttgagctcaggaggtcaagacgaggctgggcaacatagtgaaatcccatctccaccaaaaatacaaaaaaattagctggtcgtggtggtgcacacctgtggttccagctactcgggaggctgaggtgggaggatcgcttcagcctgaggggtggaggctgcagtgagcagaggtggcatcactgcactccagcctgtgtaacagagtgagacactatctcaaaaaaaaaaacacacacactcacaagacaaacaacaaaacaacataatatgaagatgggaagaagacagaggaggaaggaaacgaactatggtgtactgaaaagccagatcccaataccatctcagttaaactgagagacagagttagccccccattccccaccttttttttcaagacaaggtctggctctgtcgctcaggctggagtgcagtggtgcaatctcggctcactgcaacctccacctcctgggctcaggccatcctcccacctcagccttcagaatggctggaactacaggcacatgccaccacgccttgctaatttttgtttgttggttggttggttggtaaagatggggtttcgccatgtcggccaggctggtattgaactcctggactcaaaagatctgccaacctcagccgcccgaagcgctgtgattacaggtgtgagccactgtgcctggctccagccccacccttttttaagtggagacatggacaggagctcactaatagatgagcaagataaaaatgatgtttctgaagcaatggagaactgattatcaaatacttccccagtgtaaggatgtatcacttttaaaggtatgtcactatttacttgaaaatgtgacatttgcagagatagagaatattatttctgggtatctggtccaactccctgattttataggtgagggaatctaaagtctgcaagaaaagaacacgcctggggcctgggagtgggatcacagcagagcaggaccaggaccaagcttcctgactgagcttcctcccatttccaaagcccttcacctggagaactgcttcccgggcttcaggtttcagttcagggagcctgctgtccagacaggtgcccccgctggtccacccgaccactgtccccctctctcagagcactcctcaagctataggtgaaggacaccatcatctattcatctagcttccccgctggactgagagtaactcgagtgggcattcctctttgtgtcctggtactgagtgcagtaatgacatcacatggatactgtgtgtagtgaacaggggatcaacttgtccccattggccagggaatttcctagctttagcaatgcaagtcccaagtcctggaaaacccctcaaccaagatggctggtcactggtagcgacattaacaggatcagacagcctggtcacactttccccttctctaactgtcctccaacacccagcccaggccccagagccctgtctgtgccatgcagtccctccagctcagccctgtccaatagaaccttctgcctcgatgaagatgatctctgtctgaactatccaataccttagcttgggccacatgtggttactgagcacttgaactctggctactgtgactgaggaactgaatttttaattttatttaattttaactaaccgaaacataaatagccccatgcggctagtggctactctgttggacaattcgattctggttttccatttatggaattagtgtgccatcactgcacacagggatgaactttaaagccagacagaccttgatccaagtcctgactcatttaccaatacagcacttcttagggaatcttgttgcttcatctgtaatcctcacaaacttactttgcaacaatgtatggaaagtgaaatgactggccaatagcagaacgtcaagaaacaggatttctctagaagcaactaaaccaaatatatgtccaaatgcgagaaaaatctgattctgaaccaaaaaagcaaacgcatgagcatcatttccagcagatctctaaaacccttgcctgttttaaattctcattctaaattgtcatggctgcccagctgggctcaccacctctttctgtccccaggcctgcagctggctgtcaccaagccactacagaaggtactgcagccaacacagtctaggtacaaacatacatgtccagctctccaaaatgtatacactaaatatgtgcaatttttttcatataccaattataccttagtagagctgttaaaaaaaaaaaaaaaaacacccttggaagtggctcatgcctgtaatcccagcatttggggaggcagaggagagaggattgtttgagcccaggcgctcaagaccagcctgggcaacactgcaagacgctctctctattaaaaaacatataaataaggccgggcgcagtggctcacgcctgtaatgccagcactttgggaggccgaggcgggcagatcacgaggtcaggagatcgagaccatcctggctaacacggtgaaaccccgtctctactaaaaatacaaaaaattagcgaggcgtggtggcgggcgcctgtagtcccagctactcgggaggctgaggcaggggaatggcgagaacccaggaggcggagcttgcagtgagccaagactgtgccactgcactccagccagggcgacagagcaagactccatctcaacaaaaaagaaaaataaatatatatatatgtataaaaaataaacctgttaaatctgctacattaacaacaaaaaaaagtttttaaataagaagacaccattgggcagcaggcactgggtgggagttactgtgccaggtcaccctgagtgtggccccacacagccccaccggcaggaagggatccagggcagggagggatccaggccagtcccagagcagggaccaggcagcgctcacgtgcgctctgcaccagccacagggatgcggggacgctggggacgcggggatgcggggacaccggggaccgcccgggagcacgtcctgcgcatcgccgggctccgcgaggcctgcagaggacgcagccctctccctcccgctgggtgcggaaccgggtgcaagaggccgaagcgctgccccataaagccgatcttcgccggggccccgcccaggccctaacgaatacatcccattggcaggaaccggcagcaggtcctaggagaagccagcctctgattggaatcaaccgggagctttttaaaaatattgttccccggaatcggagatcagggtttacagacagctcccaggtgatggtgctgcacagctggggcctccgtatttttcctctgaatgcctgaggaggtgatcctgctgagccgccaaggcggggaacaccgcccaccagcagggagaagcactatttagggctgtggcaagaagtcctatccttaacagtcccctgcctctctctggctgcagggacaacagtcagagggctgcaggggcctgaagccagacacgggacacaagctgcttccctctccttgcagatggctgagcactttccagttgcccaggacctccccatccagtgtctcccaggcagggctggcagggaggccctcttccccacccactgagcatccaagtgcgggaggcctaatccatgcacctggcacttaggaagcccacagtcactgctgttactgtggttgctaccctcatctcactgggaaagaagccggctcagagagatgggatgagtcacccaaggccacatgatactgggggcagggctggcacaggaacactgggctctagggctcattctcctccctgtaccccaggatgcggccactgccctgccctcccccaacaccttttttcctccctcttacagaaaacaggcaggctctaccagtcaggataacacttcattcattgcacacgctagggctttaattcatgggaccccacctgtcctcctcaaaatagtcctgggtcctctaggaatgccctccaaccaccaagtggtgggggttttttttgtttttgtttttgtttttttgagacagtttcgctcttgttgcccaggctggagtgcaatggcgcgatttcagctcactgcaacctccacctcccaggttcaagcaattctcctgcctcagcctcccgagtagctgggattacaggcatgtaccaccacgccaggctaattttgtatttttagtagagatgggatttctccatgttgaggctggtctcgaactcctgacctcaggtgatcgcctgcctcggcctcccaaagtgctgggattacaggcgtgagccaccacgccccacccaagtagtggtttttagtacagctttgaagcctgacacaccagggttgccactcagtagctgggtgatctgggacaagtttcttaacctctctgggctcagtttcctcttctgtaaagtgggactgataatatttaccagtaagggttgtggtgaggattattaggtgagatcatccagcggatgggatgggcaccacagcggctggcagcaagtactaacaggcagtaggtgccactatccagaaggccggtctttctcacggcctctccacgctccatcctggcccgggaaagctccacactgctcaccctcttgccttactcacccccttgaaattccccaggctccatgagccggtgacccactgcctctcgcttgcccaaattcctcttgggtgcctggtccaccctggagacaatggtgacccaccatgtggctggaggtaccacatcctcccccaccccccagaaatagtaaatgagaagtaacctttttctattccccattccagacttccttaattaaaatcaaatatttgcacactctccaaagcctataaacctgattgctctcagaaaaaaaaaatgcttcagagcaaatagagtgagtgtggcacaggttgtctggcaggacctcagggtacagggcagcaggtcctgaacaaccacaccagcccagagcagtcgccctccacttttctcagtccacctccacaacaaatcaatgcaacattcactttgcaaaaggcccactgaaaagcccctgagggtgagcaggtgttgggaagggatggaaatgaggaacagtctaccccagccctaccctgaacactttcaaaccagccacttcccaccggcatggctgcccagctgttaaaatactgagtccttccacacaggctgggaagtagctgctgccccaggagtcctcaccctaagtgtccctcccccagcactcccagacctcccccaggatgcagcaaggaaagaattagtgtcagggcaccagtagaggcttccagaaagtactgcgatctgtgcccgaggttaaatattctggccatcacccctgagcactggtaaggggcatgaagatgcaaacgaaattctgggggattcagaagagggacaaggtttcaataaatgattgctaaaggaagagagaggggaagcaggtgaagtggagacagaagggaaagtgattcaagtcgtagttcagtggccccgaggacaggccccagaactgcccacacctccctcctctaggccactcactctatcccagttcaggtcaccattgcagaagtctccctagccaggtgctacagtttaaacatttgtccccctcaaaattcatgttgaaacttaatccccaatgtggcagtgttcagaggtgggaccttaagagatggctagatcctgagggctctgccctcgtgaatggattcatccattcatggattaataggttaatggattaatgggttatcttgggattgggactggtggctttagaagaggaagagagacctgagctagcacgagctctctcagcccctcaccatgtgatgctctgcacagcctcgggaatttgcacagattccccaccagcaagaaggccctcaccagatgcagcccctcaaccatggacatctcagcctccagaactgtaagaaatagcttccttttctttataagttacgcagtttcaggtattctgttgtaagcaacagaaaacggacaagacaccaggcaaaagcaaatccagcactgcatgccagcctccaagccccttctggtaatggcactgtcttcctctggggcatcccctaaccctcccctaatgctccaggggtggcacattacctagaggaggacagtcaaagcacggaacctccagaaccaatagacggctcaaatgcagccatatgcccctaactagacagtaagagacttctctcacactttggctgaagccactaggaaaggggtaccttccccctaccctacagcgttgctaacatgagtggataaaaacctgaatccaagctgatggcctcttgccatcttgaaaggagagactgcttgagaaacaagaaagaaaagcagggccacgacacaggagacaaaacctggcccacacagctggggcccctggatcagccatgcctaaccaggtagtgacttgacacaataaatgatcttttctagatttaagctaccttgagtttggttactgtcacttgcaacataacgctgacacaatgttctgcgggttaatgagaggctgctggttgctactaggtcccacttcctaccctggctaccatttcgggtctgactgtggcttgttgatggcacctgggaggctgagctaagtccccaagccctccattcatgcaaacacaccatccctctctcattgtgggccccggactacattctctcgcctgccacctcccaccttttcttttctttttcttgtctttttttttttctttttttttttttttttatgagactgagtctcgctccgtcgcccaggctggagggcagtggcacgatcctggctcactgcaacctccacctcctaggttcaagcgattctcctgcctcagcctcctaagtagctgggattccacaggcaggcgccacctcgcccagttaatttttgtattttgagaagagatggggtttcaccatgttggccaggctggtctcaaactcctggcctcaagtgatccacctgcctcggcttcccaaagtgctgggattacagtcgtgagccatcgcgcccggccccaccgtttctagtacacaaatcctccgctggctcccacggcctacagactgggacgcaagtccctttaatacaccttacaaagccaccatcagctgaccctgatgtcttcaatgtaaagtttttgtatcggttggaaccctgcgagcacgccaacagacaacacgaggcggtgtggagcaacatgctgttttaatgagcgcctggatgcaggcgggctgaggcctaaaatggcgtcagccccaagtgaggacggaacaaaggtttcatagtctcctgtaacaggaagtctcctagtcgtacgaaactgctacgtgatacccggatggcctctttctcgatcttcaggggtacgtatcttccggccagggcaggtgtcttccggccggctctcttcctgattccgctatcttgcttcggcacgctgctgacgcaagtagccttgcgccctgggactgggcctgagaagggaggagtgatgcatctccttaagctttcaggccccggggagaatcttacactcaggaaccctctaattcagccacgtggacctgtgaatgttctttgactatgctgagatccttcccacctccaggcatttgcacgtgtcacctgacaggaacagtgtttccgaatgtttaggagtcttagcaagcccaccttataccataagctctctgaggatgagggtaactcctcatgttctataacccacatccagtccactgaggtcaaagcctctgctccctgtgggcgttggataaatattgaaaggacctcataaacatagcttcttcccctccgtgattaccaaggcccataatcccccaagctgtctaacacccacactgggacagaaagaggctgagttcaatatgtccttgttatgtaaattatggcgggtggggtttttttttctccttgttttaattgaaaaacgaccagatgtgtacatttcagcaagagccctaaggaaaaaatctacaaagaaaacttctctcaacgctgcacatgaactgagagcgcttatcattgcaacgttgggagagttcatttcaaaatagaccctggagatcttctagtacaaccttcccattttacagaaatggaaactgaaatttcaagaagcgaaatcaccgtccagcatcacacagctaggaggctgacctgccaggacaaataccaggttctgtcttttccccccaacatttattaataactgaatcttcattttcacttttctttattacaacactcattacgcactcaagaatggaagccacagagaagcatatgtgttttcggctctttgcaccacctctcagtgggtctctggaaaatggggtctctgtgtttaccagcaggacgactggagccttccaggcgttagactttctgtggtctctcaccctctctcctaccggtaaatatggccaacaccagcagcacagatggcagctgcccactgagcaatgaaaggcggtctctacttcccaaagcggaccgaggctgttctcaagtttccatctcactgattattttgaaggaactcaaattaagttactcctcagacaatctctgattttggcaagcacctaaatcaacacgtaaggggcactctgagtcgttccctctgcagggaccagggtgtaggtagcaggtgcatggccagagggggtcctcatgaaggcagcagagcagcacaaccagaagtcactcccaccccagcctcaggacgtgttcaggacctcgcaagcctgatgccctttcttttttttttttttttaattatactttaagttttagggtacatgtgcacaacgtgcaggtttgttacatatgtatacatgtgccatgttggtgtgctgcacccattaactcgtcatttacattaggtatatctcctaatgctatccctcccccctccccccaccccacgacaggccccggtgtgtgatgttccccttcttgtgtccatgtgttctcagtgttcaactcccacctatgagtgagaacatgaggtgtttggtttcttgtccttgcgatagtttgctgagaatgatggtttccagcttcatccatgtccctacaaaggacatgaactcatcatttttatggctgcatagtattccatggtgtatatatgtgccctttcttatttcacatcgttgactttccgaggcagtaagagggccacctctccaacttgtcctcagttttagagcacttccccatctatgaaggcacagttttcttctccatctcttctactaggctgtgctctccctggtgcccagcacagtgtgggcaccaagtaggtgctccataaacacgtgaatatacatatatgtatatactgtatatgcatgttttatacatacaaacatgtttatttgtagcatatagttggcattcaataaacgcttgttttatgtagtcttaacacacacatgcatatgcatgctttatatatctagataaagtatgtttcatctataatacataataggtgttcagtaaatgactggtatatacgtaatatgtataatatttcatgctgctgagcaaatgaataggtaaagaacaatacggtgtgtgtgtgtgtgcatgcatgtgtgtgtgtatgcgtgtgtgtgtgtgtgtgtgtgtgtgtatatattttttttcttccccaagacagggtttcactctgtcaggctagagtgtagtggcaggatcacagctccctgcagcctcaaactcccaggctcaagcgatcctcctgcctcagcctcccaagtagctgggactacaggtatgtgccactacacctagctaatttcctttttgtttttttagagacagcgtctcactatgttgcccaggcttgtcttgaactcatagcctcaagcagtcctcccacctcagcctcccaaggtgctaggattagagttgcaagccactgtgcccaaccaagacatggtttaaaggtacaacaaggccaggcacggtggctcacacctataatcctagcacttttgagggccaaggtgagcggatcacctgagatcaggatttcaagaccagcctggccaacatggcaaaagcccatctctactaaaaagacaaaaaattagccaggtgcagtggcaggcgcctgtaatcccagctactcgggaggctgaggcaggagaaacgcttgagcccaggaggtgagggttgcagtgagccgagatcgcaccactgcactccagcctgggcaacagagcgagactctgtctcagaaaaaaaaaaaaaaaaaaaaaaggtacaacaggcgaggagttgaaatgaaaactccaggagggcaaatactgtgtcttttgttctccattgtatctctaggccctaacacagtgcctgcctggcactaagtatgtgctcaataaatactggctgaatagaatggacatttgaaagtcttctccaaaactcatactgaaacgtaatccccaatgtggctgtattgagaggcagggcttttatgaggtgattggatcatgaggactctgccctcgtgaatggattaatccattcatggattatgggttggtgagttaatggattaatgggttatcatgggaggacaactggtggctgtataagaagaggaagagagacctgagctaccaatgtaagcaagcttagccccctcaccatgtgatgccctgcacagccttaggactctgcagagagtccccaccagcaaaaagactcaccagacgcagcccctccacctgggacttctcagcctccagaactgtaagaaataaatttctggccaggcacggtggctcatgcctgtaatcccagcactttgggaggccgaggcaggcagatcacttgaggccaggagttcgagaccaacctagccaacatggtgaaaccttgtctctaccaaaaaatacaaaaattagctgggtgtggtggcacgcacctttagtcccagctatttgggaggctaaggcaggagaatcgcttgaacctgggaggcggagactgcactgagctgagattgcgccactgcactccagcctgggcaacagcagagtcgcaaaaaaaaaaaaaaaaaaaaaaaaaaaaacaataggaagctattaagggttttaagcagaggtgtggtatgatccgagtaatactttttaggctgagcatggtggttcacgcccgtaatcccagcactttgggaggcctggctgaggcatgcagagtgcttaagccaaggagtttgagaccagcctgggcaacatagcgagactctgtatctacaaataatagaaaaattggataggtgtgatgatgcatgtctatggtcccagctattcggagggctgaggcaggaggattgcttgagctcaggcggtcaaggccctccagcctgggcaacagagtaagaccctgcctcaaaaaataaaaataaaaaataaaacaaaaacattttttaaaaatctgatacaatctgaaaatgaattggaagtggggaaaatgtcccctcaggaccctgcccacttgtcagagcaagaaatgaccctactgccaccccctcttggaacagcgctcacaaagataacagagtttcagccatcattattatgagttcactgtttttcgctgctctttaacgaacactgtgaggcactgtgataaatgctggagaccctgagatgaaggacgcacagaccttgttttccaagagcctaaaatccctaatctccaagatcagccagtctttccagagaagcatttaactcagaccaatacttttggaagagggcagagctgcagagccctgatcacccattgttcgtatctctacctttctttgtcatgtatgtgtttattataccttgcctctttccaagagacagttgagatcgctaacaacaagaaaagaacccgtgagaattacaaacagaagaaaatatgatagtgggaaccatgacaaagcaaatggcctgaacctgtgggctggcgacagctgctgtgactaagcgcaaatttggctccgagcttcctggcagccagggaagaaaggaatacacggcaagaaggaagagcaacctttcctctctggtagcatagtgtttcctggctgcctttaaattctacaaaacaaaggtggggcctactgtggatgggcaaggctggggtcagcagggtaaccgtggttgcaagcaccctctcattcatcttgttcattacagaactcaacatcttccccaccgggcacggtggctcacgcctgtaatcccagcactttgggaggccaaggcgggtggatcacttgaggtcaggagttcgagaccagcctggcaaacatagtgaaacccccgtgcctactgaaaataaaaaaaattagctaggtgtggtgatacgtgcctgtaatcccagctacttgggaggctgaggcaggagaatcacttgaacccaggaggcagaggttgcagagagccgagatcacaccactacactccagcctgggtgacagactaagactttgcctgaaaaaaacaaaaaaagaactctggctgaacacaggggctcacacctgtaatcccagcactttgggaggccaaggcaggcagatcacttgaggtcaggagttcaagaccggactggacaacacagggaaacccagtctctactaaaaatacaaaaattagtcaggtgtggtggcaggcacctgtagtcccagctactcgggaggctgaggcaggagaatcgctggaacccaggaggcggaggttgcagtgagtcaagatcatgccactgcattccagcttgggcgacagagtgaaactctctctcaaaaaaaaaaaaaaaattagccggacgtggtggttcacaccagtagtcccagctacttgtgaggctgaggtgggagaagcacttgaacccaagaagtggaggttgcagtgagctgagaccgcaccactgcactctagcctgggtgacaaaaccagaccctgtctcaaaaaaaaaaaaaggagtccttgtgccaccacagcacctctgcctacctccctcaattctcccaccatctggacaccatcatccagttgtgtgtctctctccacctctggactgtaagctccttaaagtccaggattactgcttggttatatactgaattgtgtcccccaaaattcatacactgaagtcttgacccctaatgtcaaagaacgtaaccttatttggatttaggatctttgcagatgtaatgagttagcatgtgatcatagaggagtagggtggggcctaataaggtgataaccacgtgaagacacacacacacagggagaaggccacgtgaacacgagcagacggtgtcacacctgcaagccaaggtacgccaaagactgccccaaaactccagaagctggggggggtggcatggaacagactctcccacacatcctcaagagggaaccaaccctcccggcaccttcgccttggactgccagtctccagaacagctctcagacagtagatgtctgttgagtccccagtttgtgagatgtgtaaagcagccccgggaagctgatacaggtttctttatctttgtatgcctgtgcttagcacagtggctgccacacagaaggtgggttcacctctatggaactgaaccgcagaagcctgggtgttcaaggcacggcatcaggctggggggccatctacctcccagaatgggaggcaggtgcagagagacacccaagctccccgtttcaccatgtcaccaaggcccacagcaggcacagggtgccttgctacagcctggcggtacacaccagtcagggctatggaacatcgacaacagaaatcagctatgactattttatggaaaagaggattttgatgagaaaatatgagaaactcccagaatcaacaggcaaagtgcagagccatgctcagacaaaggaccacggatactgtgcagggggaaaatgtggccaaggccacgtcacaggacgtctgctgcagacactgccactcctactgggcctcaactctaaacaacctcttcctgcccctgcatctgtgcagtactcagcccagggtcagagcagagggtggcagtggtcatgtggccaagctgaggccacaggctgcgagaaagaatgtgtggtccacctcagcttccatactggcagaagaggctctgcctccctccaagacttacatactgagggttcccccaaccaggaaggtgggtggaatgttgagcaccccaaaatataaaaagtacccatgagacctaccaacccaccaagctgcagaattaagtaaaggtagatccctgagtgccatcacaccatgactgagtcctacagagacctacagaatggactcaggctcccagggtggcggaagtgagggagaggcctctgcatgtctacacagccccagagccaagtgtgaacaaaggaagtgtttcttcatctcttaccacagagaacaagtgtgaagcagaatttcaagcatctgctattgcaaaacatctaaagtagtagcaaaaggtcatttccagaaacatccctcttcccctaccctagaagccattcagcatcagttacattgtgaataacactatctgaagcttgttcattcattcagcaaactgtcctaagacccagatgtgcctggcctcgtgctgggcactggagttacaaagatgaatgagttgccatccctgaccacaagctcagtaagctggaggagaggagaacagagaaggcttcactggggatggcaactgtcatggagggttagaggttagtgatgtgaatttgcattccagatgttttttagcatttgctgggcatcacagatttctaaacacacacacatacacacacacatacttcctcccagtcagttacctccttaatcagccaccagcccgaggaccgtggtccagaggactaggcctggatatgcaaacctaggtccttttaggaagggctgcaggctaccaggtaggctaaagatgtcaacatggtagatggcaatctgcttccctgggtggaagacaagacacagaggctgaccccaacacgccagttggctgtgctcttgggcagaccttagctcttggtcagcagctggtcctcaggaaactgggaaatgaaccctgttttaggtgcccctgctctaccctccacaatcataataccagcgcttaccatttgcactgcacactccagtttgtaagacacttttacaggcatccactccttcattcattcattgaacaccaaggcactttgcttagagctaagaacctaaagagtaattaatcacagccgctagccgattggttgccacttcctatgggaagccctccttaacctctcaggctgggatcaatgtcccccaacccccacctcacaccccacaggccacggcagctcagacttccctacatcacaagctccctgtatcagcactgggtctccttctatctaaacttcctggtttagatgtgaaagggactcatccaccccatccaccactgcatcctctgagcctagtacagtgcctggcacacagtgaagcagaatggatgtcctgaggaagtgccagtgggaagacccaggaggacagaggggccgtggggaaacagaagccaagtgggaaagggcaggggagactcaaggtaagaatctggcattatcattccctactcatttgtggattaggacatttatctcagagagcttgagggacttgcccacaatattactgctagtaaactagctgggtctctgcactcactctcttcataccaatttccaaaccaactctctacatctcagacagctttgagccctccctcccccacagcccgcagaattccatctctcttcctgtgaccaacttactgtttgggatctaatgtattctgtaccctccctccggggtattttttttaagataccctgaagatagaagcctgtgattaaaagaaagaaaaggattcctaacgatggaatggcaggaactcacttattcattaaacaaatatttactgaacacctagagtatgttctattctaagtgcaaatataccagcgtgaacacaggcaaaaatcactgccctctaagataccatcatgaaatggtgttatgaaaacccagtatgcctttgtgaaggaaggaaggaaggagggagggagggagggagggagggagggagggaaggagggagggaaggaaggaaggaaggaaggaaggaggaggaggaggaggagggaggaaaggagggagagggaataccaagtgatctattcaagatgtcacttaagctgacccagggaacatggtctattgggggcgaggagacaccacacaatccttcaccccaagaccactctattatctactgcaggataccctgtcctcattcactgtcctttcaatatccacagtagaagagaaacagacagaatgagcctccttttttggccattgctggcttcctaattaaagtcaaggatttgtgtttattcagggtctataaacacagacccaaaaaagtgtttaagagaaagcagatgaaatgtgggtaaggactagctaataaaatcacgggaaaatgctgtgcgttttcagtcatgaatgtgattaaacaaaacttgcaggaggatgctctgagggccaaggcacataaatgtgtgcagggcctgagcttccaggggaaaatgtaaaccataacttcctgcagaattaattggtccctggtgggagatacgtgctaagttcctctggacagagccagagaatcacgatgcagctaatgtgggttcccctccccctcctgccactaggttgtcacatagcctgtcaagactgcattttaaaatcctgtggatttgcaggttccttggggacagcctttggaggaagaaactctgctcaaattacaagaggcacctaaagaagctcagaaacaggccaggcgcagtggctcacgcctgtaatcacagcactttgggaggccgaggcgggcggatcatgaggtcaagagatcgagaccatcctggccaacatggtgaaaccctgtttctaataaaaatacaaaaattagctgggcgtgatagtgcacgcctgtagtcccagctactcagggggctgaggcaagagaatcgtctgaactcgggaggcagaggttgcagtgagctgagatcgctccactgcactccagcctggtgacacagcgagactctgtctcaaaaaaaaaaaaaaaaaaacaaaaaaaacacctcagaaacggaggctgccccttccagagcactgtcagctcatcgcaggacctcagtgtccacatctggccactgcaccagatactggctaaggtccctcccaataacagcttctcacacactacgtccttccaagtcggtacctgggtacagaggaggaccctgttatgaaatatatgggggtctggtctgaatttgaacatgagtggcaaagatgttgaggaaccctgaggattccacaaggaagtggatgactttgcagagatcaaagagagcaaaggaggggtaacatccagggccagccttaatgaaaccctaatgcacaagtttccacaattaaggacaataatgggacaggaaccagtggggcccagaaaacaatcaatgcctttgattaagcactgctgacgaaatttcccattggtgctttaatatggctccccgggggggttgttggctttgcaatgtcttaaggaaactcatctcttttttttttttttagatgaattcttgctctgtcgtccagggtggagtgcagtggcatgatctcagctcactgcaacctctgcctcccagcttcaagtaattctcgtgcctcagcctcccaagtagctgggattacaggcatgtgccaccccacccggctaatttttggatttttagtagagacggggtttcaccatgttggccaaggtggtctcgaactcctgacctcaagtgaaatatataaacccctttctgacttttttcttctccttcttctttttttgaaaattcaagacatggtgctcgatcaatgctaagtagaacagagagccaggaagctcatctttaattcagcgccgacaatcctcagctcagctcaaacttggcaaaacgctttcttccctcgcatctattcatagccgtctgttcctagagttaacgctcaattattcaccctaacagaggaattgtcccatgctctgagaataacgtggggggggtgggacgcaggaggggcagaggagcagggacagagtagaagagaccccagctgccgccaagtaggcagccacactcctctgagagagcagcaaggtgacaacaccctccaggcatggccagtggggaggagccgaccttagtcaccagggcctgcaacacaccaaacatgctgaactgcatccaccaggcccgtctcgggatccctgtccacagggaagggaagggaggctcagacaagtgacatgaccccccaggaacacagagtgagcaaatggcagggctagtgacacgatgcagaggcaaggcccacgtgcgccacgcacccaaggaccagatgcaattgacaccctcaggtgatgaaaaccttggagctgccacaggccccaactcctcccagaactaaaccttttaccagaattgcttcctgcctggtgggcacccccaacgattggctaagttggatggaatctcccacaaggttttgtgcttttgtatttttaatatgctggagacagagtctcactctgttgcccaggatggagtgcagtggcacgatcacggctccctgaagcctcgacctcccggttcatgcagtcctcccacttcagcctcccgaatagctgggactactgatgagtgctaccacgcccagataatatttttatttttttgtagagatgggggcttactgatgttgcccaggctgctctggaactcttgggctcaagcgatcctcccgcctctgcctcccaaagtgttgggattacaggcatcagccactgcacccagcctcccataaggttttgatgaggattaaacgagatgatgtacacccagcagaaacctctactgttaccgtgtcccccttgtgttttagtccttcattttcttcctctgaccctcgaaactgtaaggacaaggagcatgcatgactcagcatgactcagcttggtgagcccagggcccagctcagcaagtagctgagttcattcttcactccttcagccacagcacctgacttacttatcacttcctttcccaggtgctgaggagaagagagcccagatgtgaggacaagagaaaggtggggtaagggatagagacggggaagacaatgagcaaacctagggttttttctggacattcaataaatgcctatttgagatgctaagacatgtcccccttttgcatctaatcacagaaatacttatatacacacatcaaaatgataaatcctgggcatgaaatgaatagttttaaagatgccaatttaggccaggcacaggggctcacgtctgtgataccagcactttgggaggctgaggctggcagatcacttgaggtcaggagttcgagaccagcctggccaacacagtgaaaccccatctctactaaaaatataaaaattagccagccgtggtgtctcaagcctacagtcccagctactcagaggctgaggcactaggatcacttaaacccaagaggttgaggttgcagtgagccaagactgcaccactgcactccagcatgggtgacagagcaagactctgtctcaaaataaaataataaataaataaatatgtcaatttaaattatcagccaggcacagtggagagagcctgtagtcccagccctttgggaggccaaggtgggaggatccctggagctcaggagttagaggccatagtgagccatgattgcacctggacaacagagcaagaccctgtttctaaaagaaaaaaaaaatctaataataaaaaattgtcctcccaaaaaaataattgtccacccaaagtagaaaattaactcatatactcattcatcaaacatatgtttggtacctacctaccaggtactttctatatttggtgcctccctttaaaaaatggctgaggagcattgaatccgaacccttccaaaacacaggcaaagatgacaagtgggctgcatcacacaccataagagtctgtctggaaatttgcaatcccataaacggttatagctcagccagccgctggggtgccttcgtctgtctgctccgtatgggcttctcagaggcagatccatccttttcttctgcccctgcctcccaccacagagcacaggaagagggttctgaaaagtggtccctctccccaagagaagttgggcacaccctctgcatccttgctccctggacgtccaggaggcaggagcagagagattggtcaggtgcttggagccataaggtcactcaccttccattgagaacacactgaccacagctcccaccacctgaaccaaagttcatttcgctttggaaattacatgaagcccccaaacagaaaacacttggcaactgttcgtcagtggctctcattcatcttacctttccctgaaaataatttctttttttttttttttttttttgagattgagtctcactctgtcacccaggctggggtgcaatggcgcaatcttggttcactgcaacctccgcctcctgggttcaagcaattctcctgcctcagcctcacgagtggctgggactacacgtgcgccaccacgcctggctagttttttaaactcctgacctcaagtgatctgcccgcctcgacttccaaaagtgttgggattacaggtgcaagccactgcacccggccctgaaaataatttctataggacctgaagatgggtactggtatgtggatgtctctagattccttaatcccatcagctgtttgcctggaaggaatggtgagattctagaaaaatcttgtgacctccctctgaccccaggtttcctcatttataaaacggcaacaataatgtcttctgcatagacctaggagatgtctatggtggctgttctattcaagaattgctagctgtctttctttaatcaggcctgtccgtatttcacctcagggatgcctgggcctaagttttattaattgaactgtttttgttgtatatcttttatgaagagtcatctaaactttggttttctctgttttcctgaaagcagcagtattttaggtttcttagagaagaagaaaagaggccaagctcagtggctcacatctgtaattccagcactttgggaagccaaggcgggaggactgtttccgctcagaagttctagactagcctgggtaacatagggagaccccatctctacaaataattaaaaaattaatcagatgtagtggcatgcacctgtggtcccagctgctcgggacgctgaggcaggaggatcacctgagccagagaggtcgaggctgcagtgagctgtgatcacaccacagcactccaacctaggcaacagaagagaagaaaagaagaggagactcttagtggagaggaaaaaagaaggggagaagggaaggttttcttacaataaaagtaacataatcacattagaaaaaaacgtgaaaatgagagaaagggaaagaatatctccatattcttatctccctcacacaacctctgacaccattttggtctatttcctcaaagtcttgtttcctataaatgacagatggttttctaagtctcctcacagcctccatggccctgactttgaggggccgtgtaatattccaccatgtggctaaagcataactggtttaagtacgtggttactgtcagacacttagattatttccaatttattttgttactgtaaaaagctgagctagccaggtgcggtggcccacgcctgtaatcccaacactttgggaagccaagcgaggagggtggcttgagctcgaatttgagaccagtgtgggcaacacagcaagacttcatctctactaaaaataaaaaaatgagccaggtatggtggcaggcacctgtggtcccagcttctgcctctagagatggcacttgccaatctatgtgagtatctgtaattactccagaggattctgaagaagcctatggaatcaaattagggaaccactgctgttcccaattgaattgaaaactgaggtactcgggaggctgaggtgggaggattgcttgaaccctggaggtcaaggctgcatcatgatcgtgccactacactccagcctagttgacagagtgagaccctgtcttaacaacaacaacaacataaagctgagctaaaaatctttatgcaacattttgtccatattttttactgtttttcttaggaaagattcccaaagtgggttccctgggtcaaaggttatgaagatgttcaaggctctggacatcaattgcaatagttgcccagaagggtcactcgaagacctggttggccaccagcaagaaaatgcatgcaccttcactggggtgacacctttcacaggcatcacagcgcagggtcagggacacctgttgggttttctctggagtgagttcttatggaacattctggtctctgcacattagctgcacaatctcaggtgcttttcagctctgccctgctgaatgagagatccataatgcatgcgaggataagctccaaggtggaatcaaatgctccctcctcacccagcagctatttggggatgatcagggaaaacgaaagatcaggttcctcttcttttggttttaggtgtccaaggtgttgggacaatgatgagtttatctagggagaagcattttccaaccacattgatcatgggggacagtgggggacgttcaaaggtcatacctcgtttattcctcatttattctgagacaggtccactcaggcagggcctcaaggactatgggatcaaatccaaaggcccaggaggccgaagccctttcagatcaactcctggatggggccttcaactgcagatttgagacgtgcaggaacaatgacaaagtcagaaggggcctaattctaggggctgcggtaaccaaaaagactctgctttatttatttatctatttatttattttggcctcaccaggtcaagaaaggctgtctccctctgtccactctgtctctcacagcagacaactagacatccagaaactctctccaaggttatcacactcaagcatgagagaccctcggataatcacacatacacaggtaacacccccactgggtatcaagacaacttagcacattccgaagatgccctcagtgcatcaaacatacaatgggattcctctgtaccctcattttcttttttattttttgtttagagacaggggtctccctatgttgcccaggttggtctcaaactcctgggctcaatcaatcctcccacctgagcctcctgagtagctgggacggcaggcgtgtgccacccagccataccctcgtttcactgagccgaattcagctatactcaaagggccaaatgcttttctttttccattttaaaaactttaaataatataaaagtgtattttgcctattgtatttatttgtatttgtttctacaggtttttttgtttcttagtgtgggaaaactagaaagcctgctggacaaattctaaaagagctatagtactcttttttctattttttgtatattgtgcattgtactttatcgtatattgtctactgcagtttcttttatgcattgactcactgatgttcctgtacagcgtcacacacacaaccagcgcatggaaaaccaaccttcaggaacaactcgggagattgtcaggaatttttttttttttttttttttttgagatggagtctcgctttgttgcccaggctggagtgcagtggcacaatctcggctcactgcaagctctgcctccccggttcaagtgtttctcctgcctcagcctcccgagtagctgggattacaggcacgtgccaccacacctggctaatttttgtatttttagtgtagagacaaggcttcaccatgttggtcaggctgttctcaaattcctgacctcgttatccatctgcctcagcctcccaaagtgctgggattacaggcatgagccaccgtggctggccaggaattttttattttttattttttgcctactgtgctgacttctgaacttcacagaattttttattttttatttttttgcctattgtgctgacttctgaacttcaccatgaagatgtgactctgttgagcagagtttcttctcctttggtgcttttaggtcttgggggcacgtgtctgtctgttaggaaccagcggaaaatcagcccagctcggatcagaacaggaaaccaggacccaggctggtgggtgctagggcagggccttgtggcttcacaacccgcctcccagggacaggctatctggtcaaaagaactcgccctcctcactgctgggtcccttagcgggctttcacgtgcctggcctggtccctccttctttaaatgaagagtggcctagatgattgtcacactcctgtgtgacactggacaacacacatcacctctctgggcttccattgcctctgaacagtcttccaccttcgactggaatcagagccccaaaagcgagattctaacaagaggttacattgtgtgagatactgacctcctcagcatctagggtgatggggtccccgggtgggtcacctctagctgggagatgcttcctctttcacagctccatctgtgccttaaaaattaaaagctgggaacctataattccagcactttgagaggctgaggcaggaggatcacttgagctcaagagttcaagatcaacctgggtaacacagtgagacctcatctcttaaaaaaaaaaaaaaaaatgtaaaggctggaaaagatgggactaggtgatctccactgtcctttccatctcacaccagccaccccacgcccaacaccctcagaatagatgacaacgggcagattacccttaacagatatttctctaacccagtgacagggacctctgcatcagaatcacttagaatgctcattaaaaatatgactccaggctgggcgcggtagctcatgcctgtaatcccagcactttgggaggccaaggcaggcagatcacttgaggtcaggagcttgagactcacctggccaacatggtaaaatactgtctctattaaaaatacaaaaattagccgggcatggtggtccacacctgtgattccagctactcaggaggctgaggtatgagaatcgcttgaacccaggaagcggaggttgcagtgagccgagatcacgccgctgtactccagcttgggtgacaaagtgacactctgtctcaaaagaaaaaaagaagaaaaagaatctggcttgccgggtacagtggtgtgcacctatagtcccatctacttggggggctgaagtgggaggatcacttgaacccaggagagtgagtccagcttgagcaacgtagcaagactctcatctcaaaaaataaaataaaataaaataaaataaaatatatatatatttatttatttgggaggccgaggcaggtggatcacctgaggtcaggagttcgagatcagcctggccaacatggtaaaaccccgtctctactaaaaacacaaattatatatatatacatatatatgtgtatatatatacatatatatgtgtatatatatacatatatatatgtatatatatatgtatatatatacacacatatatctggaacctcccacccaggaagtgtaagcacacccaaggtatgagcagattaaagaaatcctgcagaagggggaacacatgcatagagtatgctggcaaggtcacatatagaaaatgggtggggggacttgaaagcagaggtataaatcctatgtgcaccttatttgctcaagtctacatggaccagcatccaaacattgaaattttcctttcaaattcaatcccccagagtgtatggtctcaggacccttctttcccccaaatcttttctagtggggatgcatgtatgcagacaatgcaaagtgctacaaatcgcaacaccaaatgcatcaagaggtagattattagtatgagtcagtttcacactaactttaccaaaaacctcactgctcacattagctcaagtaatctacttacaaccacaattataaattctgagcttccttggctgacgagtttgcagtaggtggttcttggccctgagggctgctgagatgcccgccgttatgagatgcccactgagaaaaccaccgccctctcccagcagggtccagcaggagcagtgtctgctctcggctacacaactccattcatagacttttccagttacgtttgaggttcacccaaaggaggtagtaaaaacaggaggtgggcactgaagctggcctggtatgtttgaattccagctctgctttttatcagcctccaggttttctcagtttcctcatctgtaaaacgggaataatattacctgcctcacagagttaccatgaaagtaagaaataaaatattcaaagtatatgacatggctgggcgcagtggctcacgcctgtaatcccagcactttgggaggccgaggcaggtggatcgcctgaggtcaggagttcgagaccagcctgcccaacatggtgaaaccctgtcgctactaaaaatacaacattagctgggcgtggtggcacaggcctataatcccagctactttggaggctaaggcaggagaattgcttgaacctgggagacggaggttgcgctgagccgagattgcaccattgcactccagcctgggcaacaagagcgaaactccatctccaaaaacagcaacaacaacaaagtacaggacacttgctccatgctccataaaagaaagttaatattgccataaaggagaccaaaaaaatcacagaaacccacgacgtgatcctgatgggagccctgttaagaggggcttccaggccaggcatggtggctcacgcctgtaatcccagcactttaggaggccgaggcggccagatcatctgaggtcaggtgttcaagactggcctgtccaacatggtgaaactccatctctactaaaagtacaaaaattagccaggtatggttgcgggcgcctgtagtcccagctactcgggaggctgaggcaggagaattgcttgaacccgggaggtggaggttgcagtgagccgagatcgtgccactgcactccagcctgggtgacagagcgagactctgtctctaaataaataaataaatagaggggctttctgccaggtccatagctgcctgcacacatagtccagaaatgtgacctcactccctagctcctgctccactcgccaccatcaacctgctggcctgtcattcatggtgtctggtgactctccctgccatcccattccaaacccctcagaaaagcttatccaattcctgagtgaaaagaatgggcctagaagggctgagtttaagttaacccaaagaaataaacccaaactccttcattctccaagctgttcaggcctcagggacatgtgtggggtgactgtggggcacacactatcattccccatgtggatccatcacggggcctagcacacaggaggtgcacactcagtgactgttctgttgttgaatggcaggatgaatctcactcctccctcaagacctgaaaacttgagagttatgaaggcatgtttaggaatgactgtaaaataccacttttcagaaaacacagaaatctccatttgattctttcatttgcaagcctgtttgatctgtctacacactggttggtctctcgtgtcccagaagcagagggcaagacacaaaaccagagttcaggggagcaaagcagacattttaggaagttattgcccaagtttcacttccacgtcgtcttctgcattctacttcaactctggttttgagcaaagctggggctggtgaagaaacttcccttagtctacatgttcctctccctgagtcccagcactgaggctctgtagaccagggactcaaattactgagcactcactgatgctagaccctatgtcaggcatattcagacatcttctgacctaagagccacaacaagctggaaaacagacactgagatgccaagagaggttatgcaatgtgcaaaagacttcacagtcagggagtcgggtctgaatcaaagatctccttggctccaaggtccttgcttctcaacctgccactgtcctttttcaaaggcgccaaccactaacatggcaaagtgtttcatttttcataaagccatctgaggagttcaaaagcatctttttttttttttttgagacagagtttccctcttgtcacccaggctggagtgcaatggcacaattttggctcattgcaacctctgcctcccaggttcaagcaattctcctgcctcagcctcccgagtagctgggattacaggtgccagccaacacgcccagctaatttttgtatttttagtagaaacagggtttcaccatgttggccaggctggtcttgaactcctgacctcaggtgatccacccgcctcggccttccaaagtgctgggattacaggtgtgagccactgcgcccggcccaaaagcatcatgaaaaactgtccccctgcattaaattcagatcccatctctgccagaaggatagccctggacaaatcatacagctctcacccacctgtgactatgccccatgggagaaggacgtgtatatggaggctttctgctagactatgctagatgctttgatacacattatcccactcaatcctccaaacattccagggaagcaggtgatagtagcccagcttcatcaatgacaattctggttctgcagtgggatgtgatttgcccaaggtcatgcagcgctgagaagcaggcccagggctccatcagccctgccatgcaataggctttgttgagtgagcactggatgtaaattccaaagagcttaaagcggccagacagagccagtgacaggagactctattaggcagatgaggaaagaatggagcttttcttcctcctaccgcccaagcctttcccatccttaactcctctgcacaacggggccctcactgtccttcccccaccttcttatcaaaggatgctggtgctgggagggggaaaagacagaaagaggattagtctctggcatggtttatgttgatttcaaagctgtcacttttcccacattgggccttctttttcactgtggatttaagtgcctagtcccctgatgaacgaaggtcaagggcagaggtacattttgaactagagaaagtcctcagcatcctcctgctctcacagccttactgctaaacacagcagtggatgcagagggtggcactgtggagcggtgagcaaaaaccaggctcaggagccagaggcctaggttccagtcctgactgtgcctcttggtcaagatgcttccccccaggaggtcccagttcccttgtgtgttaaaattagagtactggatgcttaggcctgaaactctgagtatggggtttctgctcagtccttcagctcacactgcctctcctcccccgctccctgaaggcagccccatctcaatggctcacagcatctaggccctcctgggcttattcagcacctgctggcagacagaggtggtctctctcccaccccttcctgctcccactgtcacctgtcctgaggtccatcctaggcctttgtcactttgtcatatgtgtgttttcgcatgcatgcctcctcctctaagctaacttggaaacctccagggtcatgtagagatttgcaccatcagcatcagcctggctcctgaatgaatgaaggggagagggtcaggttggatgatctcctggcccactgcactcaaagtatggtctacaatccagaggcatcgcatcatgtgcaaaagtgttcaaaatgcagcatctcaccctgccccagcccctgctcagaacctccgaggcaatccccacgtgatgcgcagcacactcaagtttggaaagttctcttccaactcctccctcccttgcttctaccacctagaagcctccggaactatggccttagcaggtctcactaaaacatagcccatcattaaccaaaagagatctgccttaggaaccttctagaagcccgccactgactctcacaagcagaatctgaaatgtgtgctccccggggggactcctggcacacattactcagtggccctctccgaccctcaaggaagcccaggaagctttcaagaacgctgaggcggccaggcgtaatggctcatgcctgtaatcccagcacattgggaggctgaggtgggtagatcacctgaggtcaggagttcgagaccggcctggccaatatggggaaaccctgtctctactaaaaatacaaaaattagcctggtgtggtggtacgcgcctgtaatcccagctactcgggaggctggggcaggagaatcgcttgaacccgggaggcagaggttgcggtgagctgagatcatgccattgcactctaacctgggcaacaaagcaagactccatctcaaaaaataaaaattaggctgggcatggtggctcacgcctgtaatcccagcacgttgggaggccgaggcgggcggatcacaaggtcagcagattgagaccatcctagcaaacacggtaaaaccccatctctactaaaaatacaaaaaaaaaagaaagaaagaaattagccaggcatggtggcgggtgcctgtagtcccagctactcgggaggctgaggcagaagaatggcatgaatccgggaggcggagcttgcagtgagccgagatcgcaccactgcactccagcctgggcgacagagcgagactccatctcaaaactaaaaataaaaataaaaataattaaaaaaaaaaagaacgctgaggcctggcagagtcagacagactggctgcccactcacccacacggatcccatgtccacgttcagaaagctctcttccctcatttctctactcttgacatttattcagcttgtaaagaaaaggatcctttccaaaacacgtcttcagttttttaataaaccccgcaattcctttaatgatttcagattatcttaaatatttataaaaatcactctcagcaacacttctttaagcaaacctcctcatcaacttcgattatttatatatttatgaacacgatgttcaaggagcagatggcagctagtaagtcctccaaaagaaggaaaaaaaaaatcaatgggacagaatgtaagctccatgactcgtccatgtactcttctcgacaagctctggtacaattatctttccattcagcggaagcgccacacaaaagtccacaattggtttaaaatagcacacttggacttcataaagcttggaggctccaagtttaatccaggaatgacctgccagccaagggctctattcccaaaggaaactgaagctctgtcaggggagggtaagacattggatgcagggacagatgatgggaccaggggagggacagaaagagcaccaggggctgagggaagaaacagacattgctgagcacctctaggtgccatgctctctgctgggcactttccatacaacctctgggttgatcgtcacagcaacacttccaggtggcgactgttagtcctcatttgaaagatgaagagaaagacaaagagaaaggaagtatcttggccaagggcacagagctagtgagtggcagagccaggatgtgaacccaggctgtagggccccaaaaccttcactgcctctagaaagagaaaaggaggagaggaaaaaaaaaatattgctctcaacctcatgcatcctaggctaacaaagttgcctttctttcagcctggtgaggccaatcacccattttaagactatcaaagacttaattgccaaagttctactgaagcaaaaggacctgatccatctgagagcccagagaaggatgaaaaacaagattacaaggcgtccgtcttcaacaggcctttatcaagtatcccctttagggaagagaaaaaaaatcaatccttcactcctcccacccgaatttccttctttcaagaagctccaattcaagctaaaacagagagatgaatctggcctttgagacgcctatacgcttgctgagcaaacagtgattattactgttgttgatgatgataacaataatcatggatggtgatcactattatacggggtgtgcaatgggaacaggggcctatgctaaggactttgcttatgctactgccaggagcaacacatccccgtgacacatgcgcccattttacagatgagaacactgaggctccaagaaggcaacaaacttggttccatgcacacgagcagtgagaaagaaaaccaaggcatgaatttggatcttactctcttactcaggagccctgggagaccaacggggattcttttgcctgtttagagatgaggaaaagagggggccgagagtgtagtgacctctagaaggctgcacagccaagagatagtgaaggtgtgtctgataaaattcatacttaaaatctgaattttcagctatacaacacttcctttacaatgctcagtggtggacgattttgctgaagacagccaagtcccagaccgccaaagccacatgaatcgtggtctcttcaattaacgagatggcagtaatgctgagcacgggtgaggccacaacctcctggcacccgcgtccctcgggcgtccttcctgttcttcgtgtgcatgggtctctggatcctgatataagagctgtcagggaccaggattccacatagggaggaaccacgggacaaccatttcaaggtcaactgcaggccagtgcgctgaccttgagatggaaaaagaatgtacatcctcaaagagcaaaggggaacccatcattcttctgcccattctgtcaaaagacacgtactgtttcctgcatgggccaggcagcaggtcaggtgccagaggaagcacaaagaccactcagcgtctgcaagaagaaaagtgagctctgcaggctgaagacttaggcaaggaccctcaatctgccccttcctgactgaaggtcttgggccaagtcctgcactctctctaagtctcaggaaaacgagaaccctagctctcctttacaggtaaccctggccactccacagttcagtcattaaaaatgaatctgggccgggcacagtggctcacacctgtaatcccagcactttgggaggctaaggcagcgaggatcccttgagcccaggagttcgggcaacatggagagaccccatctctacaaaacattaaaaaattagttgggcatggtggtgcacacccgtggtcccagctacttgggaggctgaggtaggaggatggcttgagcctgagaggtcaaggttgcagtaagacatgatcacgctacttctgcactacttcaacctcagcaatgcgtgagaccctgtcaaaacacaaacaaaatgaatctgcacatgctcaaactgcagcacgctgctgcacagaagggtctgcactgtctcttaaaaataatagtagcacttacgggggtcgggagttgggggacccacatagctaaggatcctaagagaggcacacagaagactttgggagctgagaaaggagaaggggtggctgtcagagacagcaaaattacttgaaaatctcccaaagtgaagggcagaaacatatattggcctttatctgaaaaccatttccaagtctccctgtgctggaacccacttcagcctcctgcatcacacactctgcccttctccgtgctgtgagcccagcaaggatctagagtgcaaattccaatgtgcctcctcaggaagaaaactcaggccagctgaccacttctgcatgccgaccaaggtagaaaagtcacctcttccgggcttcccccacattacaggaaccccaggcctgggaaaccatcccagacgtcagccctggctcagtcttggctgttggcctcagccagtcacctggcggtggcaatcaaaatgacgccttctttttatttttcccccagtgcaatcttccaagaatgggagagtctcaaagtcagagtttaagccctttttcacaagggagtcagtattttcacaagatggtcttcctcagagaggggaggagtccatccaacccagatagcaaaattgctccctggagatcctggatggatgttacagggcaaggaagccaaaatgtggaagcacaccgactcacctctcaaaattcaccacccactcgttcatctcacaattatctatggggtgcttcccacgtgcttcaacgcaccctttctaggtgctggggatgcagaaattcaaggtgactggcaatgacactttctatcactgcgccccctgcaggccaggaaatctacgctcgttttctcaaggccccactcgcagcagcccatttcacagacgggaccctaagactcagagagggtaagcgacttgcccaaggtcacacagctagtaagcggcagggccaggaattaaacatagctgcaaagtgcatgtgacactcccccgcagccccagctctatccctccgcacccctccacctcttgcagcagggtgggtagcaaaggcacactccaagtagctccagcatggtaagacctcgattcctccttcgttccactcctgacacaggacacacgtttcaaaggacacacaggtttttcccaaccccagtgtgtgtgtacacagccccaggaaagccctgcaggctgcaagggcacccacccgctaacactgaacttccatttaaaaagaaagataatgaaaagataaaaggcgaagaggaagtgctctttaaacacaggcgggtggctaccccaggaggaagtcttgaggccagtggagattttgttcaccccctctagttcctcaaatccaatgcgactggtcttccaagcccctgatgggaggtggccgggggccagcgctgctcccggggtcagtccccgcaccgacacccggctcgcaggaagggtctgccagggaccagccaccccgacccgagcgccccctgcctcgaggcgcacaaggcgccggctccgcagctgggtggacccgggcggcggccccgctgcgcgctcccctcgcgtccgcccgccgccccccgcgcactcgaggcgcctcccccgggacccccgcgcccgccggcccggacgcccccaccacggcggcgccccctgtccacccgccgcagcgcccggcccggcggcccggatggtacctccgcctctccccgcacccatcacgcgcgcgccccgcaccccgcgccctctccgggggcaaatcggatccaggggcgcgcgcgcgggccggccgggcggcggcgccttcagagccccggcacgtacctggcggcccgggcgggcgaggggagcgcggcgcgggagcgcaggagcctcggagcctccggtgccgccgccgccgccgtttccgggttggcggggctcacgtcaccgccacaggtttgcgagctgcccccgccgcggcggcagcagcagcagcagcagcagcccgggcgagtgccaggcgagaaataactataaaaggaagaggcgcggcgaggaggaagaggaagcgctgtttaccttcgagaagccgagccgccggcgctcgcacaaaaggaggacgctcgcctcgcgacgcgcctccccccgcgcccagtccccgccgcatcgcggggccccggcgtcagcgcgcgccgcgccccgggaccgccccgcgccggcccccaccccagaaccccgcgcccgcctggcccgtgtcctcccgagccggggcgccacgggcccgggacggtggtgaccttgggcaagtcaccgcggggcgcgctgcgattgggggtcatcgccctcattgtgcgaggaggaaacccggctccgagaggcgcaagagtgacccccaaggtcactgcctgtcaggcagggcttgggctcgaaccccggtctccagaccttcaggccggccaggttcccatccctgggtcgcttccccctcacctggacttcaggaatggtgacagcccctgcctggctcacctcgcagcggggtcagtgagaggaatgctgtccacgcacccattcagccctcccgcagatacttactgggcctactaagtgcccgggctgttctaggccctggagctgcagctgcgaaccaaaacaaaatccctgcccgggaggggcagcggggacaggccgtaaatatctgatgggtcctatggtgctaagtgctgtgccagaggaaaaataaagcggggtgaggggacggtgcgggctgtcggtgctaccctaagcggttctccaaggactttaaatttagtacagaaattcccacataaaaagctcctcgccataattccagtttcaggtattatgggagacctcatctttcccctgatctagaatggaaaatactgtgtttttctccctgtaacaggacatgcctaggaaactgatactctccttccctctgccttgctcccctggcccagaagcccatcctatcattatcttgacattcaaccagaaatttctcgggaagatagacaacattctctcaagtatctttctgctgtcctctagcagggtatcaaaagggttacatcaaaggcttccattgtctttccacctccacctccagctataggggggttggagtgtgctcacatcatactcagtgctgagttacctgattaggagccagttgttccatttcttttcttttttctttcttttttttttttttgtctaagacaggattttgctctgtttcccaggctaggtagcgcagtgatgcgatagctcactgcagcctcaaattcctgggctcaagcgatcctcccacctcagcctcccgagttgctgggaccacgggtatgcaccaccatgctcagctaatttttatagatttttgtagaggtgggtctccctgtgttgccctggctggcctgtttctcctgggctcaagggatcctccctgcctccgcctcccaaagtgtggggattacaggcataaaccaccacacccagcccgccaattctttaacaaaggtgccttgcgccttctcttggccaggcccagttctcggagctggggaccctgagatggtgccatttcagcagtactccctggactgctctctaagcttacccgagcgccagtgccttcattcctaaaggaagggaactaatgtccaccttgctgtgggggctgagaagtaggtggggaaacactgggtcctgaactatgaccttgaggagaagcaggaaaagggtttggaagcaggcagagctgagccgcttataaaatgagcattaacaattctgaacatttataaagtactaagcaggtgccaagtgtgtgcaggcccatgaagcaggtttatcatggcccagtgtcatgcattaagatactgcagctggaagagagatgagatttgcccaagatcacacagattagacagcggtggagctgggtatgtacctagattgtctgactccagagcccaagcacttagccactctcagcctcagtttgttcatctgtgaaatggaatggataataatgacttcgttaggttatggtgagggttaaatgaaatagcgaatatatagaacctaatatggataggacccaggagaaagcaatcaccattgttgttactattatcataactgttacaatttacctttttttttttttttttttttgaggcagggtctcactttgtcacccaggctggaatgcggtggcgcaattttggctcactgcaatctctgcctcccgggttcaagcaattctcatgcctcagcctcccaagtagctgggattacagatgtgcaccaccacgcctggctcatttttgtatttttagtagaggtggagtttcaccatgttggccaggctggtctcgaactcccaacctcaggcggtccgcccacctcagcctcccaaaaaccgcacccagcctaatttttgtattgttctgtgatgacaagattttgccatgttgcccaggctggtctcaaactcctgaactcaagcgttccacccgcctcagcctcccaaagtgctaggattacaggctcaagccactgcgcctggcctaccataataattgttaaaggcatgaggtaaggaactttcaggcaagcttgggatctgtaaatagtttgatgtgagcgtaacatggaatgcaaatttgggggtccaggaagcagggaagaatagatgaaggtgagggcagggcttggatgcctgctagcctgcactctactgaattctgaaatatgtgggatggagagtctaactctgatgtgtgtgtctcagaggagaaagtctccattcactggatacagtgaggctgagagcatgagcctaggctcactctgatcctgataggtttgaccaattcaagccattgggaacctgggaataatacccggggaaacctctggcaattctgtagtgactgctctgtttccccgggatgtcaaccctgacaatggtaggcagaagtccagcatcctatagacagcactgtctttggagttgggaaagcctgcctgccattttcagctgtgcaattctgggcaagtcatttaacctctgacttcttgaatgttcttatctgtaaagtgggaataataacattatcttctgttgttgagaggactatgtaagaaaatgagtttttcatgctttataactggaaagcagcatgcacattttactttcaacattagaatctggtgctttcattggccaagcaaagaatcttgaaaaaccaagattttaaaaattaaaaattaaaaaagaaggctgtgctttcatagcacatgtggtccacacagctttcaagcaaaaaaaaaaaaatagctatttccttcatatatgcaaaagtccctcaaaaatattcctccaaaatgcatttccctgctgagcatttgcaagagtgctattatgtacaaaaggtaacagaaggtaaagttgggagacacagagactcagtttttgtcctgctgttagtattttgcaattaagcccactccacatcccatcgtgataaaagcaaactcagcggcattagtctcctcacacctgcttttcagtctcctcacacctctggccattgggaaccgaaagggaaaactacgcccaagctcactaaggaatgccgtcctggcactggagcacagccctcggaagatgcttcagaggctcagctagcccctttaggctgggaatcccactcagtgaggtggaatgacttcccgggacacacagagctaaccctcaagttggaacagggtctttaccgggagatgcagagcctcgggcttcaaaggctgataagtgattgtttcctggggctgggaggaggggagaatggggagtaactgcttaatggatatagggcttcttttgggggtgacaaaaatattttggaattaaatcaagtgtggtagttgcacattagtgaatgtaccacatgccacccaattgttcactttaaaatggttagctatgtgtcatatgaatttcacctgaattttagggaaagaataacttgacggataaaaagctagtgagcagaaccttaagtatattttcagtatttcagtatatccacaatagcattgcagaaatgaaccaatatgtcagaatcatagcaacagagtgcggtaactaagagcagccggtttatgtaactaatcctttcacaatggaaagtaaaaggatttaggattgaataatgtagtttgaatattattgttattattataacttaattggtgctttttgtgttttttgagggttttttgtttgtttgtttgtttttcggtagagacggggttccaatatgttgcccaggctagtctcgaactcctgacctcaagcaatcctcctgcctcagactcctaaagtgggattacaggcatgagccaccacagcccgctcattaatttgtgtttctgaagaagagtgtaacatagtggaaaaaccaggctcaatttagagagagctgaattcaactcctgcctttagttcctattggctgcaggggcttggaaaactactgagcctctctacgccttgcgtttcctcatcaggcaaaatgggggcggagatgctgcgtcaccgtcatctcaggactgtgggggggactgggtgggacagcataggtgacattcacccggaaggtgcctcatcggtgacagctattgttattgttgtcattgtcgccatcgttgttgttactatacggtgtagaaaatctttcagaacatggacccatggggaaaaccgggtacatcttagtccattagggcttctgcgacaaagcaccacagactgcatggcttataaacgacagaagtttccttcttgcagttctggagtctggaagtccaagatcggggtgccggcatggtcagattctggtgggggtcctcttcccagctgcagatttctgcctcctcgctgcatcctcaagtagtggaagggccagaggagctctcaggggtctcttttacaaggacacttgtgcactcatgaggcccccaccccgatgacctaatcacctcccaaaggccccacctcctaataccatcacattgcgggcttaggatttcaacttacaaattgtggggggacacatgcagttcatctcagggtaattttagaaattgctgcctacagcctagttccaagtcaggaactgtacatgctacagttactgatgggacacagaacgtttccgagaggtattttccccccgcccattctggcacagagcacacacggtagatggtggtgacatggctgaagcaggtgcagcaacctcctctccctgtcagctcctcacagcctctgtggacacgagctgagaagaggatgcctgtcatgttactggcactttacaaggtgacagctactattaagagcaagaaagcaaacagaaacactgccaactacctgggatggctcagtgggagagcctctagcccttcatactccaccaagagccttaaatcctcaagaaaagctgcgaaacatgatttgtcttggagacactgctgttaagtgcttaactttttgtggggggacagtctgactctgtcacccaggctgggtgcagtggcaaaataaatgggtcactgtaacctctgcctcttggactcaagccatcttcccacctcaatctcccaagtagctggggttacaggcacaccccaccccaccacacccggctaatttttgtatttttgtagagacagggtttcatcatgttgcccatgctggtctcaaactcatgagctcaagcaatccacctgcctcagcctcccagagtgctgggattacaggcgtgagccaccacacccagcctgttgaatagttacttacagagagaagaattgcataactaggttaactttcattgtccagataaactcacttttggaggtggggggtaccttattccccatcgaggtgttgctggcatcctgtgtcagtgatgctgaatgagacatcaaatggccctatgtgataagagataggagttgtctccctctgatcacagtgaaataaaaccaccccctccctacacttaatatgaataatttctctaagcataaaacaactgtctatcctggtccacaagcataggcgtgtgcacacacacatgcacgcatgcccacgtgcatactcacaggaagaggacaatgtttatgtgagttattttttctaattctgaaagtaacccatgttaatcatagaaaaatcaagagagggggctgggcgtggtggctcacgcctgtaatctcagcactttgggaggatgagttgggcagattgcttgagctcggagtttgagaccaaactgggcaacatagtgaaactccatctctacaaaaatacaacaaaaaattagtcgggcatggtggcaggcacctcagaatcgcctgcacctgggaagcagaggctgcactgagccaagatcacaccactgcactccagcctggacgacagaacaagacactgtctcaaaaaaacaaaaaacaaaaaaaaacagaaagaaagaaagaaaggaagaaaaggaaggaagggaaggaaggaaggaagaaagaaaagaaagaaaacagagggagaaagcaaaactcacccataatgctccagggccaggcattctttcttgacatttaacttattatctcctggtatttggggaatgcattttaacacagttgccgtcacactgtgtacatatgtcgaatcccacggtttgattcacatataggtgaggatgttaatctgacatggtttttgtttgtttgtttttgagatggagtctcactctgtcacccaagctagagtgcagtggtacgatctcggcctactgcaacctccgcctcccaggttcaagcaattcccctgcctcagcctccagagtagctgggactacaggcgccccgccaccatgcccggctaattttttgtatttttagtagagatggggtttcaccatgctggccaggctggtctcaaactcctgaccttgtgatccacccgcctcgtcctcccaaagtactgggattacaggcgtgagccaccgtgcccggccttatgttttttaaatagtacactgcaaggccactggcagcccaaaacccaggcagggaagaagagtgtgagagagaaattgctgttttcctcttcagggtaatttcctccagggctgacactatcttattcagaccttagtcctgtaccagaaacagagatgctaagtcaaagtttcatacattcatgaataggtggatgaatggggaaaggatacaatgtcaatgataaaagggccaccaaccttgcccgacaggtccagccacaggtctcctctgcaggctctcacccttcatgcagagaaatctgcctggttgagggtttaattttgcaatcacctcgttctagagcccagtcagaaggtgccaaagtcagtgcttctcaaactccgatgcataagaatcacccaggggccaggcatggtggttcatgcctgtaatgccagcactttgggaggccgaggtgggtggatcacctgaggccaggagttcgagaccagcctggccaacatagtgaaaccctgtttctaccaagaatacaaaaattagccgggcgtggtggcacctgcctgtaatcccagctacttgggaggctgaggcaagagaatcacttgaacctgggcagtggaggttgcagtgagacacgattgtgccactgcactccaacctgggcagcagagtgagactccatctcaaaacaaaacaaaaaaacacccagggagcgatcatagaatctccaggaaaaagtggagactctatggcacagtttggttactagctctggcgtggggctcggagagctgcctttcctatggattctccactgccccccaccaccaccccgccccccaaccccagccccccaccccccaacccccacccccgccaccccgccccgcccccaagctgatggtggtttctgctttgagaaattctggcctggagactgtctatgatccgagtaaagctggaacttgtcattgttgtttactgagccatcagcaaggatttggtaagcctgcaacctgcctcagttgggctgataaaaatagtgtgtgcaattgacttgccacgagttccccatctcactggggagagaaatgcttgtggaaaataagagtgaggagctaagttttgcagcaacctcaggagcgctcctgcaatctcctgcaaccctcaggagagcttaagaacaggaagctgcccacagacctattgcatcccaaggagggtgggggagaaccaatattgtggtttttgtttttttgtttgtttgttttttgagacagagtctggccctgtcacccaggctggagtgcagtggcaccatctcggctcactgcaatctccacctcctgggttcaagtgattctcctgcttcagcctcctgagtagctgggattacaagcgtgagtgtggcctggctaatttttgtatatttagtagagactgtttcggcatgttggccaggctggttttgaactcctgacctcaggtgatccaccagcctcagcctcccaaagtgctgggattacaggcatgagccaccacacctgagaaccaatatttagcaagcacctaccatagggacagaaactggctactaaagagaaaaagtgcccataagtggttttctttttgccagcacagtgctgggaagtttggaacatctgaatacattagggcacatattcttcaattgtatgaggctcccagactccctatgttattacatgaaacccccatctgcttgggcttcctgttggtacctcaagcactgacattcaacttcaagttgaacatgttcaaagccaaatggaagagtcagaattggaaccctggtctgtctgatgctaaagccctgtttcttgcaactttgccatgttgcttcttgaagagaagggatgaaggtataaataatgttttgttagatggggaagattccaggctgggtaaagttgaaataaccccaaactcagtgccatttattatggttgtgtctatgccaggtactgagtgcctaccagggatcatttgtttttttgtgtgttttctttgagatgaagtcttgctctgtcacccaggctggagtgtagtggcatgacctcagctcactgcaacctccacctcccgggttcaagaaatgctcctgcctcagcctcccaagtagctgggattacaggcacctgccaccaagcccagctaatttttgtatttttagtagagacggggtttcaccatgctggccaggctgctctcgaacacctgaccttaggtgatctgcccactttggcctccaaaagtgctgggattacaggcatgagccaccgcacctgaccaccagggatcatttgtaattcaggcaaggagatttcatgagtgaagcaacagatcaggaaggttaagtcctctgctcaaggtcacacagctagtaaggggcagaactgggcagaacccccaaaatgttaactgtcctaactgctttgattattgaatttaatcctgtggtggggctcaggacacaccaccccaaaatatgactgtaggagaccagaatatgccaacccaaaatatacttctttggcgtattttgagctggttattctgagaaactgcagacataggagtagctctgaaaagctgtccttttgtaaaacaaatttacatctatgaaggaaatctacattagtcaaactatctgtatcaggaagcgggctgctccagacagcttctattacctgagagaatatttttagagatgaaattgcgctatgttgcccaagctggagtgcagcggctactcacaggcacgatcatcattcactactgtctcaaacttctgggctcaggaagtcatcccactttggccgcccgagtggctgggactacaggcacatgccactgagcctggctacagaggctgtttatctgtgtaacaagacaaccttattcaccatacatttcttcccatcaccctcccataacttgtgtcaaagcccccttgagaaacctcaagccctattcctttctgcagctcaggatgctatataagcttcaatcatcgacccttcttcgagactcacgttttgtgggactcctgtgtgaatgcatgttaattcaaatgatttttctcctgttagtctgtcttatgtcaatttagtttgtagcccagccaaagaacctagaagggtggaaggaagccatttcgctatcccctatgcctgatacaagagaattaaaatcatatgtatcgagccgggtgcaggggctcatgcctgaagtcccagtattttgggaggcagggacctgtggatcacctgaggttgggcgtttgagaccagcttggccaacatggcgaaaccttgtctctcctaaaaatacaaaaatagcctggaccagtgcatgcctgtagtcccaactacttgggaggctgaggcaggaaaatcacttgaacccaggaggcagagggtggaggttgcagtgggcggagattgcaccactgcactccaacctgggtgacagagcgagattccatctcaaaaaaaaaaaaaaaaaaaaatcatatgcattgaatagcaaaggcatttggtcctattctcacagctagagaatggttcctttgatatagctttcgttatacatattgttgttaatgtctgtggacaattaatcacattttgcagtttccccacattcaacaaacagctttgctagaaaggtttcaaaggttcattccaggctggtcatggtggctcatacctataatccaacattttgggaggccaaggcaggaagattgcttgaacccaggagttcaagaccagcctgggcaacatctctacaaaaccccatctctacaaaaataaaaaattagccgagtgtagtggctcatgcctgtggccctagctactcaggaagctgaggttgaaggattgcttgagccccgtaggtgtaggctgcagtgaactataattgtacatctgcactccagcctgggtgacagagtgagaccctgtctcaaaaaaaaaaaaaaaaaaaaaaaaaaaaggggccaggcatggtggctcacgcctgtaatcccagcactttgggaggctgaggtgggtggatcacgaggtcaggagatcaagaccatcctggctaacacggtgaaaccctgtctctactaaaaaaaatacaaaaaattagctgggcatggtggtgggtgcctgtagtcccagctactcaggaggctgaggcaggagaatggcgtgaacccaggaggcagagcttgcagtgagccgagccgagatcatgccactgcactccagcctgggcgacagagcgagactctgtctcaaaaaaaaaaaaaaaaatggtttcattccagcttcagccccagctccagcattctgtgagtttgccagggcagcaaaactcaaccactatcaaggccaggcaagaaacataaatgagtgaggtgcacccaactgcacgatagggagcagtggggactggggcaaaaaggtgtgacctgtctttaggcatattcacattcaaacctttacaaaaccctgtgctcatcacagcaggttcctgtctgcaggttgcaagcttgcaacactgagagcagtgtcctcaaagcacagtccttggaccagcagcatcaacagcatctgggaactgcttagaaaagcaaaacctacagactcggcagacccggggctgggacccagcaatctggggtttcacaagccttccaggtggttctaatgcagctgaagttccagcaacacctggggaacttctaccacctccaatacaagctcaggcttcagaaagtcttgaagttcttcaagtgcctttgttgttgttgtcgttgtcgttgtgatgaagtctcgctctgtcgcccaggctggagtgcagtggtgtgatctcagctcactgtaacctctgcctcccgtgttcaagccattctcctgcctcagcctcctgagtagctgggattacaggcacccgccaccacacctggctaatttttgtatttttagcagagatggggtttcaccgtgttagccaggctggtctcgaactcctgatctcaggtgatccgcccacttcggcctcccaaagtgctgggattacaggcacgagccaccgcactcagcccatttgctcttttcttccatgtggaagaaggttccccagctccccaaggatgttccctggccacgccacatcaagactgcctggtctccagtcctccctgaaatcctaaatacctgttgagtgggtttcatgtgtccctgctttgctgcctgcttgattttccacgggactgtgtttcataagattagcacttcctactcctcaaaggatttccacagccattgtcttcagcgcttttgcctaacaatcccgtgatagagagaaagcagcgccattcccttccatttgcacacaaggaaattgaatcacagaaaggttgagtgccttccagaaggccacagagcaagttagagacagatttaggactaaagccctccagtgcagaccctcaatcctacgttctttctaacatgtgtattatgaaattaattacatttaatgcttctatcaacacttttgagttttattgctattctcattttacagatgagaaaactaagttttcccagaacatgatcccagagccacttacatcagaaccccctggagtacctgtttaaaatacagatttccagccaggcatggtggctcatgcctgaaattccagcacttcggggaggcctaggcgggcagatcacttgaggtcagaaagacttccagaccagcctggccaacatggtgaaacccgtctctactaaaaatacaaaaattagccaggcatgatggcatgcacctgtaatcccagctactcaggaggctgacgcacgagaattgcttgaacctgggaggaggaggttgcagtgagctgagattgagctactgcattccagcctgggtgacagagcaagactctgtctcaaaaaaaaaaaaaaaaaaaagaaaagaaaaaagaaaaaaaagtcacatttaagcaagattcactgagtgcccagcacctggctgagtgcttcacatacacgacatcatttaacagtaggcactgctattattcccatctaacaaatgaagacactgaaacccagagggcctaatgatttttccaagggtcacagcaggcaaacagatgcctgaacgtgtgctcttcgccacaatttaatgctgccttcccctacaagtcttttttttctttttatttacatatttatatattttgaaaactgatttgggggtcttgatgcattgcccaggctggtcttgaactcctgagctcaagcgatcctcctgctttagcctcccaaaatgctgagattacaggcataacccaccatgcccagccataaaagtcacttttatctgccactttagcatatttttttttctaaaagtcattttttaaaatgttatttttgtatacttggcatagtgcctgggactcagtaggtgctaagtaaatgagccaaatgaatgaatgaatgaacagaagtgaattttgtaggaccactgatgtaaaaagttccagcataatccctcaagctgtatttaaaaaatgggggagctaggcgtggtggttcacacctgtagtgccagtttcttgggagaccgaggcaggaggattggtcgagcccggagctcaagaacagcctggccaacagagcaagactctgtctctaaatttaaaagggcaggtgagggaagaattcttaaaataagtttctgtggtcacttgctgcttttctcttgaagtctgttgagcctgaaaacacatacacacacacacaaagttagtcaaaggctctaattggaaacactgcggctatgtagaatctcacttgatttgctttaattgttaaaggttttggaggcaggaactgccacttcattctccaaattctccatgtctcagttgactcatcagtaaaatgaggctgatcatagtctcacaacagggggttgccgtgaagattcagtgagataacacagcccaggtgcttaatgcagcacacggcacaagagaagctgccaatgatgttagtgactgttattcttcttttattgtcactatttgtagggaaaggcacagatataagaattattctggccgggtgcagtggcttacacctgtaatcccagcactttgggaggctgaggtgggcagatcacttgaggtcaggagtttgagaccagcctggccaacgtggtgaaaccccgtctctactaaaagtacaaaaattagccggacgtgatggcaggtgcctgtaatcccagctactcgggaggctgaggcaggagaatcacttgaatccgggaggtggaggttgcagtgagccgagatggtgccactgcactccagcctgggcaacagagcaagactcttaaaaaaaacaaaaacaaaaattattcttgtgtcatactcatgcgaaaggcaaagcccctgtagtttaggttgtaaatacaaataaagactgagaggtagcaatggcacctacatattatccctaaaagactaattccacatatatgtacaatttgcatttgtctttgaaacacattatgatttttccaaaatattgcaattgtgtttcatttccatttacaattacaggttgcttaagctactgtcaaagtattccttgagcactagctttgtttggttgattagaagcagggggcctgtaaaaatggctaatgaaaagaccttacaatgatatggggctctagagtttacatagggattttacacacattctcttttttttcttttttgagatggagtctcgctctgtcacccaggctggagtgcagtggtgcaatctcaactcactgcaacttccgcctcccgggttcacgccattctcctgcctcagcctcctgagtagctgggactacaggcacccgccaccacacccggctaattttttgtattttagtagagacaaggcttcaccatgttggccaggatggtcttgaacttctgacctcatgatccgcccacctcagcctcccaaagtgctaggattacaggcatgagccaccgcgcctggcccacacattcttgttaatcctcaaccacctcatgtcccctgtggtgaggctggtactatcactgccacctgacaaagttgaagtgatgtgcccaaggtcatctagtcatctatttattattatgtatgtgtatatatacacatttttttttttttgagacggagtcttgctctgccacccaggcaggagtgcagtggtgagatctcagctcactgcaagctccgcctcccgggttcatgccattctcctgcctcagcctctctagtagctgggaccacaggcgcccgccaccacacccggctatttttttgtatttttagtagagacggggtttcaccatgctatccaggatggtctcgatctcctgacctcgtgatctgcccgcctcggcctcccaaagtattatgtgtattttttaatatttttctgagatagtgtctcattctgtcgcccaggctggagtgcagtggcaggatttcggctcacagcaacctcccctttttgggttcaagcgattcttctgcctcagcttcccgagtagctgggattacaggtacccgccaccacacccagctaatttttgtatttttagtagagacagggttttaccatgttagccaggctggtctcaaactcctgacctcaagtgacccgcccactctcagcctcccacagtgctgggattataggtgtgagccacagcacctggcctatcatctatttagtagcggaagctgggcttgaaccctgtttccaaactctaagccccacagcaagaactgactctaggattccaattcactcttggatacttagtaaccaagtcactggtgtgaaagttggcagaatcaaaatggagtcactaaggttaagaaaactctggccaggcatggtggctcatgcctgtaatcccaacactttgggaagccaggtgggaggattgcttgagcccaggagtttgagaccagtctgggcaacacagcgaaacatggtctctacaaaaaatacaaaaaattagccaggcatgggggtgtgcgcctgtactcccagctgcttggaaggctgaggtgggaggatcatctgagcctgggatgttgaggctgcagagagctatgattgcatcactgcactccagcctgtgtgacagagcaagatcttatctcaaaaagaaaaaaaaattaagaaaactctgacagaggaggagaaggccatgaagatcaggttctcaggcttgtatgcctgataatgaaacagactcggctgggcgccttggctcatacctgtaatcccagcactttgggaggccgaggcgggcggatcacctgagatcgggagttcaagaccagcctgaccaacatggagaaaccccgtctctactaaaaatacaaaattagctgggcgtggtggcgcatgcctgtaatcccagctacttgggaggctgaggcaggagaaccgcttgaacccgggaggtggatgttgtggtgagctgagatcgcgccattccagcctgggcaacaagagcgaaactccgtctcaaaaaaaaaaagactctgctaaaaccacagcttggcacgaagcccatcacagccttacacaaacaatttttctgcaaggacatctgcccagcaactgcctgtccaatctcagactggcgtcacccttgttattgatctttgtagccaaggatgatcatcttaaagcaatcatataaacctcttcatttttcatttaaaaacctttgtcttcctttacctccctgaacaggcacgtagtttacaatggcccatgtattcccactgcaatggtccattcccaaataaacatcttctcttttgcggagcctctctgtttgctatttaggttgatgctgggtgaccacatgaatgtgatagtggggattgccaggaggaagagactgtctccccagtaaaaacacatttggggagacttcaattcaagatgtggtaacaaggactgaatttatcctccagcctcaaaaactgggaaaaaaatgaaaccactgtttgcaaacacgggacagcagacagcaagggtggtgatacctgagagagaataaaggctactacccagcctctgctccttatctggaaatcccttccttcaaagccgccttaatgccaccagtgccacgaatggcccccaattccctgctggaaggagtctctgttctgccgtgaatgtctccagtgaagcctgtctttcaacttgtgccatcgtatgaggcccagcatggctgttggtgcctgacggccaggcctctggagcacaggagggcgcctcccatcaccgcacatcagagaaccgacacttcacagatcagtgctcataaaacgtttctggaaagaaggagcaatgatacttcccatgaagtttatcatgaaaaggaaaaacaggccgggtgtggtggctcaggcttgtaatcccagcactttgggaggccgagtcaggtggatcacctgaggttaggagttcaagaccaacctggccaacatggcaaaaccccacctctactaaaaatacaaaaattagccaggtgtggtggtgcgcacttgtaatcccagctactcaggatgctgaggcaccagaatcgcttgaagtcaggaggtggaggttgcagtgaggcaagatcgcgccactgcacttcagcctgggcgacagagtgaggctctgtctcaaaaaaaaaaaaaaaaaaatgaaaaagaaaaacagttacaataaaaaagaaagagataaatcatacagtcttcacagtcccccttgatatagatatatatatttttaatatatatatatatttttttagacggagtctcgctctgtcacccaggctggagtgcagtggcgcgatctcggctcactgcaagctctgtctcccaggttcaccccattctcctgcctcagcctcctgagtagctgggactaaaggcgcctgccaccatgcccagctaatttttttgtaattttagtagagacagggtttcaccatgttagctaggatggtctcagtctcctggcctcatgatccacccgccctggcctcccaaagtgctgggattacagacgtgagccaccgcgcccggccctcaccttgatatttttgttttgcagcttaaataagtggatctctggataagcggcctgactgatgagagaaagagctggcttttcttccgacaatagttgttgtgacctctttgcggcaagaacagtgatagaacagacattatcatcaggagaatcagctcgtaaaagccacattcttggcacatcaaaggtatttgagagggacagaaagagtaaagcgattctttccaactaacagttgggaaagatggcactgttttaacttgaatacccctcttttttaagaaaaagaggatcataaggctaaaacagatttttttaattgagaaagtttattttaaacatttttgagaaaaaaataagaagcctctaaattactttggcactaccaagtgacaccagtcactatcgagttttcttgtttgatttctccgtgacacttattatcggctattctcttcattttacttgtgtatattttgttttctccctttgaacgtgagtgccaggaaaacctggactttgaattctctgtgtgatcccaagtaccagaacagccgcccagcaggggctctggaaatgtgccctgaaagaactcagacaacaggagaccctcctcagctccagggctgctgccatttgcacacagaagggagcagcctgtgtttcaaaggtgagatccagatactttttaaaattattattatttttcttttttctttaaaattttttttttgtatagacaggggtcttgccatattgcccaggctgatctctaactcctgggctcaactgatcctcctgccttggcctcccaaaatgctgggattatagatgtgagccactgcacctcacccagatactttcttaccagtctctggctgaaatttcacaagaagtggggacaccaaagacaaaaatgaacaaatgaaccgaggtaaggttgggcctggtctggaggacagaaaggaggccatcaggccgatagcttatgtccagggaaacaaaaccattttggattttcatttctttattattattttttgagacggagtctcgctctgtcacccaggctggagtgcagtggcatgatctcggctcactgcaacctttgcctcccaggttcaagtgattctcctgcctcagtctcttcagtagctgggattacaggtgcccaccaccacgccaggctaatttttgtatttttagtagagacggggtttcgccatgttgaccaggttggtctcaaacttctggcctcaggcgatccacctgcctcggcctcccaaagtgctgggattacaggcgtgagccaccgcgcccggcctggtttttctttaaagtgctgaacgtttggtcacaatgatgtagagaacagggtcagttcagacagcccctccctcctggaaggctccctcctccctggcgcctcctgtccatagatggccaactccagtctaccttccccacatactctctccagatcttaacatttagccatgttcgcatcagatcttttttttctttatttggtgagggaaaccctgtgtcccctggtacccacggctctccctccctcctctgagataaccagtctcctgagtttggggttaattatcccaatgtttccataaacggtatgtaaaaatttgcagatcttggctgttcgcggtggctctcacctgtcatctcagcactttgggaggctgaggcgggcagatcacctgaggtcaggagttcgagactagcctgaccaacattttgaaaccctgtctctactaaatacaaaaaaattagccgggcatggtggtgcatgcctgtagtcccagctacctggggaggctgaggcaggagaatcacttgaacctgggaggtggaggttgcagtgagctgagattgtgccattgcactctagcctgggcaacaagagtgaaactcttaaaaaaaaaattttgcagatcttaaaaagtcagagaaatggtttcatttggtatgaatccttctgtaactttctttttcactcagcactattcattcatattgttactcagcactattcattcatattgttacatgtagtcctggtgtattcatttagtgattcatgccactcatgaacactgtgaaccaccgaatcttcctacctatccaagtcttattacctatattcctccataagacagccagctctgtgagagcaaagattattttttaggtactagaacagcatgtagcatgtaatgtgacctgaaaagctggttaattcgttccaagaattaatcaaagctgtgtagtatctcaccattgaaatgtaacacaattgttttgctcattcttccatggatgacactttcattactccagtattttgcttgcttatttatttatttatttatttatttattcattttgagacattcttgctctgttgtccaggctggagtgcagtggcgtgatcttgactcattgcaacctccgccctctgggtacaagtgattcttgtgtgtcagccgcccaagtagctggaatcacaggcacgtgtcaccacgcccggctaatttctgtatttttaaaatagagacagggttttgccatgttggtcgggctgatatttttgctaatttaaacagtacttttgcaagaatatttcccttgtctccttttgcacgtgtaggacagaatttttatgtactcaaggatggattagctgagtaatgggtagctatgtgcagcttcaaatttattaaatattactatctgctttctaaactggttatactgagagtacataaaaagtctgacctcagaaccagggcactcaaatcctttcagaacttttttccatataaaaagcaggtatgttactgtttgacacatcgagaatttccatctctttctttttgccggctgttagtgttccattgtcaagagtcacctgacttttgcaaatcagtttcctgttggtggatgttggattctgctctgaaacatcatgtgttcagcatgtttgcatgttctgtggttctgtttttgtggttacatattattttattgggtggctctatcaaaattaactactcacatatattttttaaataactgcataaaataaatgttttatttttcttagggaatttcccaagaattaaaattttggtcagtgtattaataagttttgtgcttcttatgtattgccaaaaatattattataatttagattgtctgttgcctggaaaactgcttaagtattgtgtgcattttttttgttgttttttctgttttgtttttttgagatgaggtctcactatgttgcacaagctggtctccaattcctggccccaagtgatcctccttccttggcctcccaaaatgctgggattataggtatgagccacggtgcccagcctatatgcatttattttgctgacttgactctgagtctccacataggcagtgctgtgttgattattttctgtgaatggaacctggcacatagtatatacacagttaaaagaaaaaaatgggggccaggtgtagtggctcatgcctgtaatcccagcactttgggaggcggtggcgggcagatcacttgaggtcaggagtttgagactagcctggccaacatggtgaaaccccatgtctactaaaaagaccaaaattagctgggtgtggtggtgtgcacctgtagtcccagctacttgggaggctgaggcaggatagttgcttgaacctgggaggcagaggttgcagtgagctgagatcacgtcactgcactctagcctgggcacagagcaagactctgtctcaaaaaaaaaaaaaaattaaacaattagctggacgtggtggtgaacctatagacccagctattcatgaggctgaagcaggaggatcacctgagcctaggagttcgaggctgcaggaaactatgaccatgccactgcactccagtctgggcaacagaacgagactctgtctctgaaaaagaaagaaaaaatggctcccagaggagaaatggctatcagtctactataaagatgggcctccaggtataaggacaggttgctccaagcctaagtcagttagagaaccagagctggtggtgagggcaaggctgtgattcctggggggctacctggggccacctgggcctgccttctcatccattcctgctgcaggcagtcagctggctgggctgcccctgcccctggctggtgagcgtggggtagggaaaccggccaagggcagagccaggagccagcctcgcctgcctgctgcaggcctgagacagctgtggggtgtgagaccaggagggagctcacagcgcacaagcttgtagtcacaaggggtttgagggagcaagccacctgggcgacacttgcccaagacatacgctctagctgtgtgactttgggaaaatgagggatcttcaaatggggagattatcgtgaattacctgggtggacccaatgtaatcacagggatccttatgaaggggaacgaaagggtcaaagtcagaaacaggagaggaaaccacgcagccagaggttggagtgaaacgttttgaagatagaggaaaggtgccacaagccaaggaatgcaggaagcctctagaaaatggaaaagccaaggaaggaagttctcccctggagcctccagaaggaacacagtccttccaacaccttggttttagacttctgacctccagaagaggaagagaataaatctgtgttattctaaacgactaagttcgcagtaatttgtcgtaggaaatgacaccctctaagcccctgagacctcatctgtaaagtggagatgctaatagaacctatttaatacagctgctttgtgatttacacacattaaggtatttgaaatgtttagaagaatgcctggaaaatagcatttaacaaacacttgggcaggtcactcaagctctctggacccagagacccccaaggtcaggaagggctacttctgagtgcgtgttctcagcggctgcggccacctctggtctccctggaccagcagatccttctgcagccctcctctttagcaggtgcctgaagctgtcagtcagacaagctctaggaaggtgccaggatgggtatctttctgcatcatgggggagcactgtgacctgaaaccctgacccagcattcccagggcatcagaggggagttaacgggttcgttggagtggagaagaaagccccttagctcccgaccttcctgcagggctgcattacatacagccgagcagccaggaaagcaacgagaggcatccactttccagaaggtcagggaagaggaatcagctcgttaatagaatagtgatttaccatgttcaaagcttacacacaggccgggcgctgtggttcatgtctgtaataccggcactttgggaggccgaggtgggcggatcacctgaggtcaggagtttgagaccagcctggccaacatggtgaaaccctgtctctactaaaagtacaaaaattagccggacgtgatggcaggtgcctgtaatcccagctactctggaggctgaggcaagataattgcttgaacccttgaggcagatgttgcagtgagccgagatcgcgccattgcattccaccctgggcgacaagagggagactccatcttaaaaaaaaaaaaaaaaaaaagtggtctgggcacggtggctcacgcctgtaatcctagcactttgggaggccgaggcgggcagatcatgaggtcaggagatcgagaccatcctggctaacacagtgaaaccccatctctactaaaaatacaaaaaattagctggcgtggtggtgggcacctgtagtcccagctactcgggaggctgaggccggagaatgacgtgaacccgggaggcggagcttgcaaagagccaagactgcgccactgcactccagcctgggagacagagcaagactgcatctcaaaataaataaataaataaataaaaagcttacatacatatatatatgcacaagtgcacacacacacgtaagaacatctatgcatgtacatgcacacacacacatgctcccaacagtgccaggatctaggcagaactatgtaatctctgttttccagatgaagaaactcaaacttagagggaaaaatgctcgctcaaggtcatcaagttggctataggcacccagcaagggccacagcctgggccacatccccgcatcttggttcagcagtcctgggggtgggtgatctcagcagtcaggttccagtttgtctcctgccattgctgtcctgcagggctgcccctcctcattccttcttcccctcctaattgggtgcaggtacaaataggattatattgatagcaataccaattggatgaggtatcagttgtttttgaatgtcctctcctaggccagaaggcaagagaatggcttctgtggttctcacctcttctctcagtgtatttttggtaggagggggtcaagtttttgatttgtttatctatttttttttttttgagaaggagtttcactgtcgcccaggctagagtgcaatggcgcagtcccaactcacagcaacctccgcctcccaggttcaagtgattctcgattctcctgcctcagcctcctgagtagctaggattacaggcgtgtgccaccacacccggctaatctgtgtatttttagtagagatggggtttcaccatgttggccaggctgctctcaaactcctaagtgatctgcccacctcggcctcccaaagtgctgggattgcaggtgtgagccaccgtgcccagccatggggtcaggttttaaagatgttgaggagctgctgtgcatatcactgcagagagcatcagatgggcagacacaggccatgcctagcaagctcaacatctggtcatggcctgagccccacaacttgccggaggttacacaaggtgctgatggagtgtggagggaacaaggagagtggcttgtgcaggaggtgcctcagggatgagggaaacgctaaagcaagtgagaaaagcatggcctgatggcctcgcaggactcagtggtagaggccaggccaggatccagcccatttccatctaagccctcctttttttttttttttttttttttgctttaatatccacatattgctttaagaaaaaaaatcaaaatgtgtaaatgctatttttcaaaggatagtctgtgaccaccgacatcagaatcacctgggggaatctgcaaagacagaatcctgggcctctgccagctccacccgacctgctgactcagagtctctgagagcggggtgcagggtttgcattattagcactcaagtttgagacccacaggttaagtaatgggaaaagcaaagactcagagatttggcagggaccaatgggtctgcttggcagaggcggaagggtagcatcagggtacctgctctgggcttggctcctcttggccttggctcctctggggcatcatgggaacaaggaggagcagacacctcgccagccggggtgtgtctgagccccaggaatcctgcctcgcagggaggattctctgagtagaggtgatgtgttatcacagtatcagcatttctcagcctgactcatggaggggagtgactttactgttagggcctgaggggaaataatgaggaacttctagaccagtttcatttttatttttaaacccacagttcacccttgggccttttgccagacccactgttctagaacctaacaccggcctggccctttcttctcccccaggccactgtgccacctgactttggaagcaaagcatggctgtgggtatcatcagagtggcagaacccggaacagactaggcccaaaggctcccggcacatctgtccaggcagcactccccattaggctgggatgtggcagatgcgatgctgtgggggagactgaaaccccttactagggccaaaaggctgtttcccctagacaggagacaaataaacgacactttctcttgctttcggctgatggcaaacttcttactggcccaacaggctgagaatcatttctgcttgtctctgctttagtaataataaaagcaaaagcagggatattttgccctttctccctctccattgccctaaaagagcagtttcaggcttcctctactaaaagcatatgatcattgaccagttatgatcaaaaaagtgaaaagaaaaaaagcagttataagccattaagaatgctctgggtcaggtacagtggctcatgcctgtaatcccagcactttgggagggatttctcttcttgggaagctgcccaaagtgctgggaaaatggtgtcaccactttggaaaacagtctggcagttcctcagaaggttacacatagaattatctataacccagcaattccactcctaaaatgtatatataagaaatgaaaaccagcagggcgcagtgactcacacctgtaatcccagcacttggagaggcccaggcaggcagatcacctgaggtcaggagtttgagaccagcctggtcaacatggcaaaaccccgtctctactaaaaatacaaaaattagctgggagtggtggtgcacgcctgtaatcccagctacttgggaggctgaggcaggagaatcgcctgaacccgggaggcagagaggttgcagtgagctgagactgcgccactgcactccagcctgagcgacagagtgagactccattgcaaaaaaaaaaaaaaaaggaatgaaaaccaacatccatacaaaaaatatgtacacaaacttcatagcagcattattcataatagtcaaaaaaggtggaaacaacccaaatatccatcaacggaaaaacaaaatgtagtatatgcatacaacgaaatactatttggtactaaaaagaaatgaaatactgtcccataatttgagggagaaaaaaaaagaaatgaaatattgatatatgctacaacatggaaaaacctcaaaaacatggtaagtgaaagaagctggtcacagaggcccacctatcatatgattccatttctatgaaacgtccaaaagagacgaatctacagaaacaggaaggagattagtggttgtcaggggttggggaagatggggagtgagatgggtaggggtcttatttttggggtgatgaaaatgttctaaaattatggtgatgattgcacaattctgcaaatataccaaaaaccattaaaatgtacactttaggcctggtgtggtgactcacgcctgtaatcccagcacttttggaggctgaggtgggaggatcccttgagcccaggagtttgagaccagcatgggcaacataatgagaccccgtatctacaaaaaatttaaaaattagcctcgtgtggtggtgcatgcctataatcccagctactggggaggctgaggtgggaggatcgttggagcctaggaggttgaggctgcagtgagcagtgatcatgccactgtactccagcctgggagagagagagaccctgtctcaaaaataaacaaacaaaaggtacactttaaatgagtaaatgtatgatatatgaattctatctcaataaaggtaagtttttttttttttgaagagtaaagagaggtggggaagtaggtgatgggtgtgctagcaggataccaagcaagaaggaacttaccccgtccagcattcagtttcacctctcattttagaagactttacttttcaaaagatctctttgttgaagtataaccaatggtctcctggagctggctcaactgagcttgcaagaaccaatcatatgtctctttgcccaactcagaattgacaccacattcgtagcatgtaatcaaccatggtagaaatatttacaccacaggaattgacaaatgctacaattaagggctttttaattaaaacaaatttttttttttgcgagttaaacatttaccagcttatctgtggggataacacgcatagagaaaagcgcatgtattagaaatgaatggcttgatgaattttcacaaactgaaccgacctttgtgaccagcacccaaagaaagaaagagaacagtgtcttcacccccaaacccttcctccagcgtcctcttctagtggttacccaaaggtaacaactgttcttttttttttttttttttttttaagatggagttttactcttatgcattggtgcaacttcagctcactgcaacctctgcctcctgggttcaagcaattctcctgcctcagtctccccagtagctgggattacaggcgcctgccaccatgcccagctaattttttgtatttttggtagagacggggtttcaccatgttggccaggctggtctcgaactcctaacctcaggtgatccagccgcctcggcctcccaaagtgctgggattacaggtgtgagctactgcgcccggtctgttctgacttgtaattgcacagattgcttatttttccacattaagtggaatcaaagagtgaattctgttgagtctggcttcttacacgcaatgttatgaaattcatccaggtcactgcatgtggttatagagtgctcattctcattactgaatacattgtgtgaatagtccccaatttatatgtatttatatatttcactgtgggtggatatttgggtaacctgcaggttttactgttgcaaacaggactgctacggacattctagtgcatgtctttggccaatgtatgtcacatttccactcaagaatctatgggtcacagaacacgagtatgtccagcttgagtagatatgtagccgacttcactttgactctattcctgttctctgcctcctatcccatgcccttaacttccctttccttgcaagcaagcagggtcaccaccctggcatcttccactctggggcagaccagacagggcctgggttttgcgtgggaaagtaaaccccaggccactgggactagttggtgggtaaccctggaggcaccgctgttccttcatcttcagagctcacttagggtggcagagccataaaaggagcttcagatagggaagtagctggtaaccggaggtggagccagccagggtagtctcggtgtctgacgtttctaagtgcttccagctgagcaggaaccaggcttgcacattcagacaatgtattcctgtgaatctgttcagcggcttaatgcaccataaaaagaggtccattgtcaagcagcctgtttcccgggtgggagtcagcaatatgcagcgtaagtgggtagagccactgtggctcagaggctccccggctttggccctcggttgggggcgggtgctgcccatgcttttgaaaggagagcagctaatgtgactccctggactccgcccctttcaacagcgggcgctctgctcgttatttttgaccggtttcatgtgctcactcgttcaagaaatactcttgtgatcaccaactgcaggtcaagcatggaggaggtttatgtctctaatttatcacttgtcaccggggaaggtgaggagttttcaaagttctagtcattttattattctattttgcacatggtggtcagtgtgcaagttctcatcatttttgaagtggtgagtgctgaggattagtattctgtgctactttgtgttaggcactaggacaagcatgttacatgtaccgtcacatcagtgatgtcatttatcacaccaattctatgatactaagactaccattatcccatttgggcaaaggaaaaatgctgaggcttgaagaggttaaggctcagcacattgttttctgatttcaaagtccagactcttaccctcccctgatcctatccctctggacccaggtaacaaatggctgtggctggcccagccaggctaccaagctgccacccttagggatgaacagaagctgtgctgcaggtgatgaaagtcccaggccctgcatccagttcacactgcacggagaagccagtggctacgcatggacagtgtgtgtctggctttatagagatggtcacacagcattgggcgggtcactgagcactgttccaccttccagcccacagactcccaagctgtgtcacatctaatggaacttgaggctcagagctcagtccatgtgcctgaggttagagatggctgttcacacgtgggcgtctcaataaatgttgcgcacatttgctggtaagtgaccaaagcagaaggtcaactaggcctgtcaaactccaacttgtgtgtccttttctttttttgagacaggatcccttgctctgttgcccaggctggtgtgcagtggtgcgatcatggctcactgcagccttgacttcctaggctcaagcaatcctcccacttcagcctcctgagtagctgggatcacaggtgtgcaccagaacgtcggctaattttaagttttccatagagatgaggtctcaccatgttgcctaggctggtctcaaatgctggggtcaagtgagccttccgcctcagcttcccaaagtgctgggattacaggcgtgagccactttacctggcttctgtggtcttttcactgcatcttaacatagcaggaaaaagagctgtagttctgtaagtaccgagcccaggatgagggttctctccactattagaaggtgcccctgtatggattccaggtaatcctcccttgtggtgtcagttccagagtctcagggattcaaggtggcccaggagcgacctgagtaccccacccagggacgctggctaaatgcagattctcaagcccttcctgagacttggaatctgccggcactggggacctcaggtgatgctgccaaaatgtgaaaacctggccctaatatattttaggccagtgtgcatgtgacacatttgccatcttgtgccctcatattttctcagagctataaagttttaagttctgttgaagagtgaacccaaataaggcttctcccctggcggttttgcagaaggtgaaagttttggcctcctgagcttcagaccagggtttgctatgtggtaagattttgcaaaacagctgtttatctgagctttaattctggtgttcaggagctcaagtgtttgtgtacgggctgctgtgctcacacacagacatgcacactctgctttcttctcagtcactcacattgtacgtgcaccaagtcaccctgtgtgccagctccacctctagctcccaagtgcacagtggctgtccatgacatgttatgagaaatgctcgctgtggggccctctggcaaatgccttaatttccgaatccggaacttcattgcccttcatggttcacccctccctggtgctgacctaatggtagagggccgggacaggccagctttgaccagcagcagccaagaggcagcagagggttgtggccaggagctccatggctgaaccctgatgtcagggctcaaaattcttgcctccacccttcatgagtgacttgactttttggcacgccacggctcagctgctctgagtatcagtctcctaatctgtgaacggggaaagtaacagtccctgcctctcagtactgctgagagaactgcaatcgtgctgctcaagcgcttggcctggtgctcagcccccgtggaggcctcagtatgatgagctgctggtggtccacggatccgcctgcacagagtgctcctcagcacagcacagggactttggggctggtcctgcctgccttcagtctgccgtttccttctcctgtctgctccatctgttgcagggatgccaccccatcccagcagctttgcaggagctcaatctgtgcaggctcctaggatgagctacgctcctttcttcaggcagctccctgccaggtgaactctacagtcatcattacttacctgtgtttctccgcttctcagggacagaatatggggctgtctttgcaaccaaaggcctggcactgtctagacaaaaatggaatgcttgtggaccatgtgagcctcaggtgtgtaagagtaaggtgacctaatttagtggacttcacctccatcccaggcagctggctggagaggccaggcctctgtgggagggacacgtgctcagacacccctgctagagatgtgagcccattcactccaaattacccacagactgcataatgaggagaatcaaagatttccatggggtcggagaacacatgggggggcagaggagaacacatggggggcagaggagaacacactgggggggcgcagaggagaacacattggggggcgcagaggagaatacatgggggggcagagaatacatggggtgcagagaacacatggggggcagaagagaacacggggggcagatgagaacacatggggggcagaggggaacacatggggggcagaggggaacacatggggggcagaggagaacacatgggggcagaggggaacatatggggggcagaggggaacacatggggggcagaggagaacacatgggggcagaggggaacacatggggggcagaggggaacacatggggggcagaggagaacacatgggggcagaggagaacacatggggggcagaggggaacacatggggggcagaggggaacacatggggggcagaggagaacacatgggggcagaggggaatacatggggggcagaggagaacacatgggggcagagggggaacacatgggggcagaggggaacacatggagggcagaggggaacacatggggggcagaggagaacacatgggggcagaggggaatacatggggggcagaggggaacacatggagggcagaggggaacacatggggggcagaggggaacacatggggggcagaggagaacacatgggggcagaggggaacacatggagggcagaggggaacacatgggggcagaggggaacacatggagggcagaggggaacacatggggggcagaggagaacacatgggggcagaggggaacacatggggggcagaggggaacacatggggggcagaggagaacacatgggggcagaggggaatacatggggggcagaggagaacacatgggggcagagggggaacacatgggggcagaggggaacacatggagggcagaggggaacacatggggggcagaggagaacacatgggggcagaggggaatacatggggggcagaggagaacacatggggggcagaggggaacacatggggggcagaggggaacacatgggggcagaggggaatacatggggggcagaggagaacacatggagggcagaggagaacacatggggggcagaggagaacacatggggggcagaggggaacacatgggggcagaggggaatacatggggggcagaggagaacacatgggggcagaggggaatacatggggggcagaggagaacacatggggggcagaggagaacacatggggggcagaggggaacacggggggaagaggggaacacatggggggcagaggagaataggttgaatgatctcagtaatgatcatccccaccaccactgcacccctgccacacacacacacacattcaagcctgaaacagtatccaatggggggctaggctgggcatggtggctcattcctgtaatcccagcactttgggaggctcaggtgggaagatgatgtgagcccaggagttcgaggccagactgggcaacaaagtaagaccctgtctacaaaaaagaaaaaaacaaaaaaagaaaaaaacacatacgaaaagtgggcacaaggttaggggaggggagaagaacaagggtgtggagagtagggggctgtggctggggccacaaggacctgggtccacacggctgcccatcactcaactgtggtaatgtgcctaacggtgtcacgcgccctgccaaagactaaacgcaggtaaaggaaacatgggcccaagcacagtaagccctcaaaggacctgaggtggagagacaggggtaagcctccagctcctggcctcaccttggaggctgggctgtcgggggctggtggataaagggaggggctgctttcaacggagtcagggggtggtgaagggggacgtcagttccaaacagatactgttccaggcttaaaaccacatacaaccgatgtgaaagaacattttgtcatcagataaaaagctggcttcgcctccccctggattatccaggtcactatgttagcttttcccagaaatatcccgatagaaagccgctggcttccatgcccaagcccattttccccggtagcacggtgtttaaagggtttgtcttggactatgaacaggcacattatgtctaccaacttttttttttttgacagagtcttgctctgtcatccagaatggagtgcagtggcgtgatcttcgctcactgcaacctctgcctcccgggttcaagcaattctcccacctcaacctcccgagtagctgggaatcacaggtgtgagccaccacacccaactaattttttgtatttttagtagagacagggtttcaccatgttggccaggctggtcccaaactcctgacctcaggtgatccacccgcctcaggctcccaaagtgctgggaacacaggcgtgagccaccgtgcccagccatgtctaccaacttccatgaaagatgacagaaggaatgctgagaccagcacttcgggatcctccctgccgcagtctcggcctgctttccgccactgtggttctccataaaggagagtgtcttccaggcagtgggaattgcaaggatggccttggagccagaaccacctgtgtgcactcccaccttagtgatttacaagccacatgtctcctgtgtgtgaatgaatgcctctgagcctcatttgtcagctctgtaaagctgaggggctcacgcttctcctgggcttgctaaggattcaggggttaatgcaggcagagtgcctgggccaggtctgctccactgcgtggcagcactagttgtgacagctacgtgacagaagtgctgtccacacgacaacatgtaagcctcgtgcccctccaccctcttcttgccctgttcacatcaacgggcgcacaagtggacgtggtggaggtggaatgcggaaggtggaggacagaaaggggccgaaggcccacagtttgtaagccggggcaagtgccacatatttttatgtatccagagtgatctctgacaagggttggagtgacctgtgtcatctatatacccgaaagcacagccagaggaagccttgattctctcctgtcagcagggtagtgaacaactcacaaaatggcctgatttcagaagtttgggatcaactgagaatatgtttatttaaaagcaattttaaatattaaaaaaagtagaaattaacacatacagtactgaaaaactgtcacattaaacacatgtgaaatgacaagtgtactgatgtttgatggtaacatccagatgagaattcggcatttaactagtggcactacaggattcctatacaacatgttgaagttctaggcaataaaaaaataaatagcaattgctgttcaacagtaaaataagacacacactatttgcagaacataactttcccctctgggggaaaaagaactaatttgctatttttttttcataaggttccatatcttcaaaatactatataatgtacaaaattgcagatagtggcttactgagtttaagatcaagatcagacttaaactcaacaagatcaccaaaggtatttctactgagttttcctatgtcccacagtaagctgggttagagagaactcaaattcctgatggaaaacaaaaccgaacaaaaaaactagaaaaaaaaggtgttaaaaatgctgtgtaagttgctgcaaaaggggaaaaagaatagacactaactccatgtaattttagacatgcagcttttgtgttttttttttgtttttgttttttttttttttttgaaaaaaaccagtttattttgagatcagtgaaaagagtctaggccacagaaaagaacagctctttaatgcaagttaaaatgtgtaaatgaatgaccgggacactgagcaacctcagatgcagacttccatccggacactggtgtggcttcagtaccgaggctgctaaagctgccagtcacaacccagcatgtcaactggttcctcatgctctgtttggtgtggaaattcacatgtgccctgacactgaggaagcaattgcttaaaatcactttccaataacagctgataaaatattttgcaggtttgtcatgcaaggtttatttattaggtggctattcaaagtttgtatagcaaccacttaagcagaactaaattaatattcactgagcactgtaacgatggaagagggcttttcctaagggttgggttgggagttgtgcttctgtgaaattaacatctctcactcattgccaagattctctgcttaaaaatattagttttctgtgctgttgccaaaatagcaatttaagcaaatgtagtgccagaatgacacatgagcctcggactcagggaacagttccactgactgtggagtacaactattgcattcttttccaaaattcagactgatgtaaaagactgaaatacaatgttcttaaggatctgataaacatggctgggatgaaaagaaaactgagagggaagagtgcttttcacagtgcaattcatagcagcgttcaaaaacttggttatgaattgacttgaaggtggacagagcttaagactggaaaaattatctataattggggtttaacaaagagcatgggaaaagaaacacttggtttcagcacctggattctacatacagtagggaaactgtgtgaagggttgacttttaaattcatcttgaataatcttttaaaagtttaaatttgtccaagaacaaaactaagaaaataataaaaaatggatgcaatggatgcttcaacacatctgagagatgtgcattcataacacaatatgtcaatccatactcttgagaaagccagtgattagaaacaaatattgttgcaaccttataatttctgctttaatggcaatcaagtttaaaaaatgtacaattccacttatccatactattcctttataaaaggcagatttcaggtaagcttctaaatgcatgcgtaatgtagaggctaatattttctggcagtccttggttcctgaaatttgaacttcatatgtgttttaaacttttgtcaaaatagtcatgaaagatatgttatttttgcataatgaggtaatatatcaggggcgggcactcataagacagtataaatccacttgtctaaacttgcatgaggctgtgtgcattgtaaaatgccataaagagttttgggtcagtgaatattttgctgaaggaataacacttacatttaactgagcacttttctgtaataaataccaaagtaggtttttgtagctgtaaactgtgtacacagataactacaggctggtctgtcatggagctaaaagtttcacctggaaaacagaacccacctctttgctaatgttgcattttcagtaacacaattgagaatactgcattgttaggaacagagtcaattctatgcctttcaacggttgctggagaccacttctatttgcaaagccagcagttcctatactcctatttttgtttgtttgcttgtagaacagcatagagagatgtaagtgctagatgccaaggatggctttggcaaaccagtaaggcgcgccgggtccgaggctaccctcatactggtgaaggcagaaaaccacaggatatttacaacacacattatatccccctcctgaggtggcccttccatgagtttcttactctgtaacagcagctatatacacactgtgcccagggttacatgaaggcagcagtcttgcatgaaggatgtggacaatcttaaggttctgcgttttgctagtcagacaggatatgaacaaaggacactggaaagacccccttcctttcaggctgtccttcgatgtggccaatctgcagggagaaaagagagtggtcaggatggaggcagcaggcagtggccccacgacaaacccagtgggtaagagcccagcctagtctgcccacagacctggcggtggaatcccaggcttacccttcttcccaccctttagtgaactacagagagcttaacggtcataaactacataaggaaagagcaaacgacagaacttccaatatgctcagcattctacatggatcttgctgtacccacacagcaaccccctgaggtggatatttcttatacagtttacaatcttcattttacagatgaagggacagtggcccagagaggtgacatgctctcccacaggcgtggggctctagagtccttgctctgaaccagggcgcctggctgcctttacagctgggtgacctcacacaaaccttgctaagccttttctctgttaagtggggctaaagaaaatcccttctctccaggcttgtgtgatacatttaaaaaagaaaaaaaaaaaaaaaagcaaatgaaaaggctgctatggcacctggccaatcccagtactattacctattcctagttgggaaggaaggggtttctttgcccacagcccaggtaggatgcatacagaccattaagctgtgtcagctgcctggcaagacccactgcggggtaccatactcaaatcaaagctaatcttgttctgtctcttctctttgtgagtaaagtgttgttctagccagtaaaaaaaaaaaaaaaaggctgctatgtactatcacttgttttctggttaccgtggaggaagaatactgtgaaagtttgagactgatggtggcgaatggcaattttattgtctgctgcattggcctgtaagccagttacctgtaaaaattttctaattacctcaattagattagtattgattgcactaaagagaatcatgtaatgggccttcaatagaaaaaacaaaatcgtgcatattggcttccaatgccaaatcgatagagaggaaggtggttttaagagtggaacagagtcaaccaggcctgcccagctctcctgaaggcttgcccacccaccgcgtgtggtcttagttggcatcatgcatgtgtgaggtctttgtgaatttcacatcacagttagcatgtgtgtgtggcaccatctttacatctggcgaggcacgtaatggtggcacacacaatgtcccctaggaatgatgctagggacaccaatgacagcttcccattccccgcaggtatctctgctgtagtcatcagttgcttagcaaagaacatgatcactgcttgattataataatattaacagattacaaagtgagttcctcaacatccttgtgagaaacgattaatcatgtcctatttttcagaggaaagtgaggcttacagaagggacatgctttatccaaggcccatagagctagtaactgattcacgtgggggggcttcagagcccacctcctcgtcatgagatgaagtggactctctgacaggcttcatgccaggggctggccccactctgctgacagaggctggaggtacccctgggcctccccaggctgatcccttcagtccagtttctcaaccatggtgctactggcatccttgcttgtgggggctccctgagtactggaggatgtttagtggcatccctggccactaaacttccatctactagttgttggtagcaacccccttcctaggtcctgacaatcaatatttccagatattgtaaatgtccctggagggcaaaattgccccagttgagtccaaacaaaatccctacagctgtgattaagaatctgaggtcactgtctaggcctgaaggaagaaaagtcaaaggtgaatgtgtgcccatgcctatgtgtgtgtgcacacatgtatatacatatgtatttctgggtattcttaggtactgctggctcaactgcgagcctcaggtcccttcctggcagacagaactgagtccctcttggcaggacggggctcaggctgccaaggaaggggaattttcaccctgatgtcaggaaatgatcaacaaggagagcagaagaggtggcttattcactgtaccttggcctggcagttcccatcgggagacttactccctggcaacgtgaaaaccaatagatgtgtggactgccctcgcaggtcactcacagcctgggtacctagcagggcctatgaggatgctgatgtctttccctcctgatgcctgagctgcaggttttaatgtaaaaggagttttcatagatattttcatttaatcttttcctaaaattacgtggagaaggtgtcttggcctatttgacaaagaaagaactgcagactggattaagaattgagtctgaggacttgtcaactgctcagcctgagcaggaacttgggcattctgattcccagcctggggacagtgtggaatggtgagcaaagcacataggctctggggtcagggccgatctggaatcttgacttagcctgcttactggctgagggaccacaggcaacatgctcaactttcttccgctttagtatttatatgaaaaatcagaaaatgcctacaactcacaaggttacatgataccatgggtaaagtacatacaaatgttaattctcttgacctgtcttcaaagccccatggctgtttttcttttttttcagatggagtctcgctctgttgcccaggctggagtgtagtggtgtgatctcatctcactgcaacctgtgcctcccgggttcaagcgattctcctgccttggcctcccgagtagctgggactacaggtgcgtgccaccatgcccagttaattttttgtatttttagtagacacggggtttcaccatgctggccaggctggtctcgaactcccgacctcgagatccatccgcctcagcctcccaaagtgctgggattacaggcgtgagccactgtgcccggccagctccacggctgtttttctagcatgtaatagtgtgtgacatagaaaagacaccaaatgcaatggctgttgggtgagtgatgcagctgacagggtccttgtgctcaagagccctcttttactgcactgtctgtaggctccaatgtggtgcctgcccaggcatgctgtatgaatgtacggatgaagtggatggatattcgtacgtacccaccactcctggtcctcttcccctgtgacgataatcacttctccctcgatgaatgtgagctcgtcatcgttgtctgcctggcagtcataaatggtcttcactcgcctcactttatttttccccttaaagaaagaaactgggttttaattgaaagaatggactgaatggaaaaaaagagcagcggttctttgtaaaatggttgaccttggccagtaacttaacctcgctgagccttgatttcctcacccttgaagggcgggaagaagagtgtctgtcaggcacccagcatactgtgtactcttaactacaggcccttcctctccccccatcatcagggtggccctgcattggtgattgggcatcatcaagttattttcaccagaaagcaaacactatgggtagggatcaaaattgagcttcaccaaaaaccatcaagcactctgtacgcacccccaacccacatcagcttgcagaatgacagcagagtctaaaaatgtttttaggaaacatgatgtaaagcaaaatctgcagcttctgcataatgaatgtgcagcataaacaaatttgtcagtcccctcatgcaaaacagcaagtcagtacatgctggttaaacacagcaggatcggcctggggctcggagaagtctatgcagttcctaaaacagttttaatttttgattagttttgatttgagcatttatttgttgaacttccagttctttgcaaatagaaaagtgaaaatagaggtatcaccttctaaatgatgggtttttgttttgcacctggctaattggcaattttaaaaaaagcaagctgtctctttaaatgttttgggtggagtgcctcttcctctctgtcccctggtttctcctttaatcaccctgatagttccagctgctttccgagctcccttctgggccgtgcgggtgggttggagaagcctggcagaactgtggcagtgactgcgtgagcaactgagaggcctgtagtgtgttaatttataacacagagattaaatgacataataaaactatatagtgtgtagcatgaaatgaaaattttgcatcagtggtgcttgggagtcatgggagagttcccttttgaatagcagaagtatccaccatcagacacggcagcctccaacctacaggaagatgggttttatttttcttaatttaagtattgatatgacacacttttactgcaacatttaaattttttttttttttgagacggggtttcactctgttgcccaggctagagtgcagtggcatgattacgctcactgcagcctcgatctccagggctcaagcaatcttcccgccttagcctcccaagtagctgggatcgcaggcatgtaccaccatgcccagctaattaatttttattttttatagagacggtttctctgtatgttgcccaggctggtcatgaatcctgggctcaagggaacctcgcactttggcctcccaaagtgctgaaattacagatgtgagccactgcacccagccccattttaatttttttgagacagggtcttgctctgttacccaggctggagtgtagtggtgtgatcacagcagccctgaactcctggcctcaagcgatccactcgcctcttcccaaagtgctgggtactgtaacattttataacagaatgtgaggcaggtagagctgcc

SEQ ID NO: 871 - DNA, 8669 bp, Homo sapiens
aggtgttcagtaaatgactggtatatacgtaatatgtataatatttcatgctgctgagcaaatgaataggtaaagaacaatacggtgtgtgtgtgtgtgcatgcatgtgtgtgtgtatgcgtgtgtgtgtgtgtgtgtgtgtgtgtatatattttttttcttccccaagacagggtttcactctgtcaggctagagtgtagtggcaggatcacagctccctgcagcctcaaactcccaggctcaagcgatcctcctgcctcagcctcccaagtagctgggactacaggtatgtgccactacacctagctaatttcctttttgtttttttagagacagcgtctcactatgttgcccaggcttgtcttgaactcatagcctcaagcagtcctcccacctcagcctcccaaggtgctaggattagagttgcaagccactgtgcccaaccaagacatggtttaaaggtacaacaaggccaggcacggtggctcacacctataatcctagcacttttgagggccaaggtgagcggatcacctgagatcaggatttcaagaccagcctggccaacatggcaaaagcccatctctactaaaaagacaaaaaattagccaggtgcagtggcaggcgcctgtaatcccagctactcgggaggctgaggcaggagaaacgcttgagcccaggaggtgagggttgcagtgagccgagatcgcaccactgcactccagcctgggcaacagagcgagactctgtctcagaaaaaaaaaaaaaaaaaaaaaaggtacaacaggcgaggagttgaaatgaaaactccaggagggcaaatactgtgtcttttgttctccattgtatctctaggccctaacacagtgcctgcctggcactaagtatgtgctcaataaatactggctgaatagaatggacatttgaaagtcttctccaaaactcatactgaaacgtaatccccaatgtggctgtattgagaggcagggcttttatgaggtgattggatcatgaggactctgccctcgtgaatggattaatccattcatggattatgggttggtgagttaatggattaatgggttatcatgggaggacaactggtggctgtataagaagaggaagagagacctgagctaccaatgtaagcaagcttagccccctcaccatgtgatgccctgcacagccttaggactctgcagagagtccccaccagcaaaaagactcaccagacgcagcccctccacctgggacttctcagcctccagaactgtaagaaataaatttctggccaggcacggtggctcatgcctgtaatcccagcactttgggaggccgaggcaggcagatcacttgaggccaggagttcgagaccaacctagccaacatggtgaaaccttgtctctaccaaaaaatacaaaaattagctgggtgtggtggcacgcacctttagtcccagctatttgggaggctaaggcaggagaatcgcttgaacctgggaggcggagactgcactgagctgagattgcgccactgcactccagcctgggcaacagcagagtcgcaaaaaaaaaaaaaaaaaaaaaaaaaaaaacaataggaagctattaagggttttaagcagaggtgtggtatgatccgagtaatactttttaggctgagcatggtggttcacgcccgtaatcccagcactttgggaggcctggctgaggcatgcagagtgcttaagccaaggagtttgagaccagcctgggcaacatagcgagactctgtatctacaaataatagaaaaattggataggtgtgatgatgcatgtctatggtcccagctattcggagggctgaggcaggaggattgcttgagctcaggcggtcaaggccctccagcctgggcaacagagtaagaccctgcctcaaaaaataaaaataaaaaataaaacaaaaacattttttaaaaatctgatacaatctgaaaatgaattggaagtggggaaaatgtcccctcaggaccctgcccacttgtcagagcaagaaatgaccctactgccaccccctcttggaacagcgctcacaaagataacagagtttcagccatcattattatgagttcactgtttttcgctgctctttaacgaacactgtgaggcactgtgataaatgctggagaccctgagatgaaggacgcacagaccttgttttccaagagcctaaaatccctaatctccaagatcagccagtctttccagagaagcatttaactcagaccaatacttttggaagagggcagagctgcagagccctgatcacccattgttcgtatctctacctttctttgtcatgtatgtgtttattataccttgcctctttccaagagacagttgagatcgctaacaacaagaaaagaacccgtgagaattacaaacagaagaaaatatgatagtgggaaccatgacaaagcaaatggcctgaacctgtgggctggcgacagctgctgtgactaagcgcaaatttggctccgagcttcctggcagccagggaagaaaggaatacacggcaagaaggaagagcaacctttcctctctggtagcatagtgtttcctggctgcctttaaattctacaaaacaaaggtggggcctactgtggatgggcaaggctggggtcagcagggtaaccgtggttgcaagcaccctctcattcatcttgttcattacagaactcaacatcttccccaccgggcacggtggctcacgcctgtaatcccagcactttgggaggccaaggcgggtggatcacttgaggtcaggagttcgagaccagcctggcaaacatagtgaaacccccgtgcctactgaaaataaaaaaaattagctaggtgtggtgatacgtgcctgtaatcccagctacttgggaggctgaggcaggagaatcacttgaacccaggaggcagaggttgcagagagccgagatcacaccactacactccagcctgggtgacagactaagactttgcctgaaaaaaacaaaaaaagaactctggctgaacacaggggctcacacctgtaatcccagcactttgggaggccaaggcaggcagatcacttgaggtcaggagttcaagaccggactggacaacacagggaaacccagtctctactaaaaatacaaaaattagtcaggtgtggtggcaggcacctgtagtcccagctactcgggaggctgaggcaggagaatcgctggaacccaggaggcggaggttgcagtgagtcaagatcatgccactgcattccagcttgggcgacagagtgaaactctctctcaaaaaaaaaaaaaaaattagccggacgtggtggttcacaccagtagtcccagctacttgtgaggctgaggtgggagaagcacttgaacccaagaagtggaggttgcagtgagctgagaccgcaccactgcactctagcctgggtgacaaaaccagaccctgtctcaaaaaaaaaaaaaggagtccttgtgccaccacagcacctctgcctacctccctcaattctcccaccatctggacaccatcatccagttgtgtgtctctctccacctctggactgtaagctccttaaagtccaggattactgcttggttatatactgaattgtgtcccccaaaattcatacactgaagtcttgacccctaatgtcaaagaacgtaaccttatttggatttaggatctttgcagatgtaatgagttagcatgtgatcatagaggagtagggtggggcctaataaggtgataaccacgtgaagacacacacacacagggagaaggccacgtgaacacgagcagacggtgtcacacctgcaagccaaggtacgccaaagactgccccaaaactccagaagctggggggggtggcatggaacagactctcccacacatcctcaagagggaaccaaccctcccggcaccttcgccttggactgccagtctccagaacagctctcagacagtagatgtctgttgagtccccagtttgtgagatgtgtaaagcagccccgggaagctgatacaggtttctttatctttgtatgcctgtgcttagcacagtggctgccacacagaaggtgggttcacctctatggaactgaaccgcagaagcctgggtgttcaaggcacggcatcaggctggggggccatctacctcccagaatgggaggcaggtgcagagagacacccaagctccccgtttcaccatgtcaccaaggcccacagcaggcacagggtgccttgctacagcctggcggtacacaccagtcagggctatggaacatcgacaacagaaatcagctatgactattttatggaaaagaggattttgatgagaaaatatgagaaactcccagaatcaacaggcaaagtgcagagccatgctcagacaaaggaccacggatactgtgcagggggaaaatgtggccaaggccacgtcacaggacgtctgctgcagacactgccactcctactgggcctcaactctaaacaacctcttcctgcccctgcatctgtgcagtactcagcccagggtcagagcagagggtggcagtggtcatgtggccaagctgaggccacaggctgcgagaaagaatgtgtggtccacctcagcttccatactggcagaagaggctctgcctccctccaagacttacatactgagggttcccccaaccaggaaggtgggtggaatgttgagcaccccaaaatataaaaagtacccatgagacctaccaacccaccaagctgcagaattaagtaaaggtagatccctgagtgccatcacaccatgactgagtcctacagagacctacagaatggactcaggctcccagggtggcggaagtgagggagaggcctctgcatgtctacacagccccagagccaagtgtgaacaaaggaagtgtttcttcatctcttaccacagagaacaagtgtgaagcagaatttcaagcatctgctattgcaaaacatctaaagtagtagcaaaaggtcatttccagaaacatccctcttcccctaccctagaagccattcagcatcagttacattgtgaataacactatctgaagcttgttcattcattcagcaaactgtcctaagacccagatgtgcctggcctcgtgctgggcactggagttacaaagatgaatgagttgccatccctgaccacaagctcagtaagctggaggagaggagaacagagaaggcttcactggggatggcaactgtcatggagggttagaggttagtgatgtgaatttgcattccagatgttttttagcatttgctgggcatcacagatttctaaacacacacacatacacacacacatacttcctcccagtcagttacctccttaatcagccaccagcccgaggaccgtggtccagaggactaggcctggatatgcaaacctaggtccttttaggaagggctgcaggctaccaggtaggctaaagatgtcaacatggtagatggcaatctgcttccctgggtggaagacaagacacagaggctgaccccaacacgccagttggctgtgctcttgggcagaccttagctcttggtcagcagctggtcctcaggaaactgggaaatgaaccctgttttaggtgcccctgctctaccctccacaatcataataccagcgcttaccatttgcactgcacactccagtttgtaagacacttttacaggcatccactccttcattcattcattgaacaccaaggcactttgcttagagctaagaacctaaagagtaattaatcacagccgctagccgattggttgccacttcctatgggaagccctccttaacctctcaggctgggatcaatgtcccccaacccccacctcacaccccacaggccacggcagctcagacttccctacatcacaagctccctgtatcagcactgggtctccttctatctaaacttcctggtttagatgtgaaagggactcatccaccccatccaccactgcatcctctgagcctagtacagtgcctggcacacagtgaagcagaatggatgtcctgaggaagtgccagtgggaagacccaggaggacagaggggccgtggggaaacagaagccaagtgggaaagggcaggggagactcaaggtaagaatctggcattatcattccctactcatttgtggattaggacatttatctcagagagcttgagggacttgcccacaatattactgctagtaaactagctgggtctctgcactcactctcttcataccaatttccaaaccaactctctacatctcagacagctttgagccctccctcccccacagcccgcagaattccatctctcttcctgtgaccaacttactgtttgggatctaatgtattctgtaccctccctccggggtattttttttaagataccctgaagatagaagcctgtgattaaaagaaagaaaaggattcctaacgatggaatggcaggaactcacttattcattaaacaaatatttactgaacacctagagtatgttctattctaagtgcaaatataccagcgtgaacacaggcaaaaatcactgccctctaagataccatcatgaaatggtgttatgaaaacccagtatgcctttgtgaaggaaggaaggaaggagggagggagggagggagggagggagggagggaaggagggagggaaggaaggaaggaaggaaggaaggaggaggaggaggaggagggaggaaaggagggagagggaataccaagtgatctattcaagatgtcacttaagctgacccagggaacatggtctattgggggcgaggagacaccacacaatccttcaccccaagaccactctattatctactgcaggataccctgtcctcattcactgtcctttcaatatccacagtagaagagaaacagacagaatgagcctccttttttggccattgctggcttcctaattaaagtcaaggatttgtgtttattcagggtctataaacacagacccaaaaaagtgtttaagagaaagcagatgaaatgtgggtaaggactagctaataaaatcacgggaaaatgctgtgcgttttcagtcatgaatgtgattaaacaaaacttgcaggaggatgctctgagggccaaggcacataaatgtgtgcagggcctgagcttccaggggaaaatgtaaaccataacttcctgcagaattaattggtccctggtgggagatacgtgctaagttcctctggacagagccagagaatcacgatgcagctaatgtgggttcccctccccctcctgccactaggttgtcacatagcctgtcaagactgcattttaaaatcctgtggatttgcaggttccttggggacagcctttggaggaagaaactctgctcaaattacaagaggcacctaaagaagctcagaaacaggccaggcgcagtggctcacgcctgtaatcacagcactttgggaggccgaggcgggcggatcatgaggtcaagagatcgagaccatcctggccaacatggtgaaaccctgtttctaataaaaatacaaaaattagctgggcgtgatagtgcacgcctgtagtcccagctactcagggggctgaggcaagagaatcgtctgaactcgggaggcagaggttgcagtgagctgagatcgctccactgcactccagcctggtgacacagcgagactctgtctcaaaaaaaaaaaaaaaaaaacaaaaaaaacacctcagaaacggaggctgccccttccagagcactgtcagctcatcgcaggacctcagtgtccacatctggccactgcaccagatactggctaaggtccctcccaataacagcttctcacacactacgtccttccaagtcggtacctgggtacagaggaggaccctgttatgaaatatatgggggtctggtctgaatttgaacatgagtggcaaagatgttgaggaaccctgaggattccacaaggaagtggatgactttgcagagatcaaagagagcaaaggaggggtaacatccagggccagccttaatgaaaccctaatgcacaagtttccacaattaaggacaataatgggacaggaaccagtggggcccagaaaacaatcaatgcctttgattaagcactgctgacgaaatttcccattggtgctttaatatggctccccgggggggttgttggctttgcaatgtcttaaggaaactcatctcttttttttttttttagatgaattcttgctctgtcgtccagggtggagtgcagtggcatgatctcagctcactgcaacctctgcctcccagcttcaagtaattctcgtgcctcagcctcccaagtagctgggattacaggcatgtgccaccccacccggctaatttttggatttttagtagagacggggtttcaccatgttggccaaggtggtctcgaactcctgacctcaagtgaaatatataaacccctttctgacttttttcttctccttcttctttttttgaaaattcaagacatggtgctcgatcaatgctaagtagaacagagagccaggaagctcatctttaattcagcgccgacaatcctcagctcagctcaaacttggcaaaacgctttcttccctcgcatc

SEQ ID NO: 872 - DNA, 2376 bp, Homo sapiens
aggtgttcagtaaatgactggtatatacgtaatatgtataatatttcatgctgctgagcaaatgaataggtaaagaacaatacggtgtgtgtgtgtgtgcatgcatgtgtgtgtgtatgcgtgtgtgtgtgtgtgtgtgtgtgtgtatatattttttttcttccccaagacagggtttcactctgtcaggctagagtgtagtggcaggatcacagctccctgcagcctcaaactcccaggctcaagcgatcctcctgcctcagcctcccaagtagctgggactacaggtatgtgccactacacctagctaatttcctttttgtttttttagagacagcgtctcactatgttgcccaggcttgtcttgaactcatagcctcaagcagtcctcccacctcagcctcccaaggtgctaggattagagttgcaagccactgtgcccaaccaagacatggtttaaaggtacaacaaggccaggcacggtggctcacacctataatcctagcacttttgagggccaaggtgagcggatcacctgagatcaggatttcaagaccagcctggccaacatggcaaaagcccatctctactaaaaagacaaaaaattagccaggtgcagtggcaggcgcctgtaatcccagctactcgggaggctgaggcaggagaaacgcttgagcccaggaggtgagggttgcagtgagccgagatcgcaccactgcactccagcctgggcaacagagcgagactctgtctcagaaaaaaaaaaaaaaaaaaaaaaggtacaacaggcgaggagttgaaatgaaaactccaggagggcaaatactgtgtcttttgttctccattgtatctctaggccctaacacagtgcctgcctggcactaagtatgtgctcaataaatactggctgaatagaatggacatttgaaagtcttctccaaaactcatactgaaacgtaatccccaatgtggctgtattgagaggcagggcttttatgaggtgattggatcatgaggactctgccctcgtgaatggattaatccattcatggattatgggttggtgagttaatggattaatgggttatcatgggaggacaactggtggctgtataagaagaggaagagagacctgagctaccaatgtaagcaagcttagccccctcaccatgtgatgccctgcacagccttaggactctgcagagagtccccaccagcaaaaagactcaccagacgcagcccctccacctgggacttctcagcctccagaactgtaagaaataaatttctggccaggcacggtggctcatgcctgtaatcccagcactttgggaggccgaggcaggcagatcacttgaggccaggagttcgagaccaacctagccaacatggtgaaaccttgtctctaccaaaaaatacaaaaattagctgggtgtggtggcacgcacctttagtcccagctatttgggaggctaaggcaggagaatcgcttgaacctgggaggcggagactgcactgagctgagattgcgccactgcactccagcctgggcaacagcagagtcgcaaaaaaaaaaaaaaaaaaaaaaaaaaaaacaataggaagctattaagggttttaagcagaggtgtggtatgatccgagtaatactttttaggctgagcatggtggttcacgcccgtaatcccagcactttgggaggcctggctgaggcatgcagagtgcttaagccaaggagtttgagaccagcctgggcaacatagcgagactctgtatctacaaataatagaaaaattggataggtgtgatgatgcatgtctatggtcccagctattcggagggctgaggcaggaggattgcttgagctcaggcggtcaaggccctccagcctgggcaacagagtaagaccctgcctcaaaaaataaaaataaaaaataaaacaaaaacattttttaaaaatctgatacaatctgaaaatgaattggaagtggggaaaatgtcccctcaggaccctgcccacttgtcagagcaagaaatgaccctactgccaccccctcttggaacagcgctcacaaagataacagagtttcagccatcattattatgagttcactgtttttcgctgctctttaacgaacactgtgaggcactgtgataaatgctggagaccctgagatgaaggacgcacagaccttgttttccaagagcctaaaatccctaatctccaagatcagccagtctttccagagaagcatttaactcagaccaatacttttggaagagggcagagctgcagagccctgatcacccattgttcgtatctctacctttctttgtcatgtatgtgtttattataccttgcctctttccaagaga

SEQ ID NO: 873 - DNA, 37886 bp, Homo sapiens
caggaggaaactctgaaggttacagttagatgcttgaattttattctaatgcacttgagccctaggcaaattatctgatatatttttaaactagcactctatctgctactgataaaaggactatgggaaacgacggaccattagaagattgctacaagacccaacagactagacggcgggggttcacactgagatggtagcaataaaaagaaagagctggtttttagatacattttgaaagtagaagagaaagaacttactaattgagctcataagttttgggcatctactactgctgaagggtaatgccattattgaacatgagaaacactgcagaaagaagatttaaagcgatgaaaattgaacaatacatgaacaaacatgggatgtgaatcttttctttttttttttttttttttttgagatgaagtcttgctctgtcacccaggctggagtgcaatggcacgatctctgctcactgcaacctccgcctcctgggttcaagcaattctcctgcctcagcctcccgagtagctgggactacaggtgtgcaccaccacacgcggttaattattttgtatttttagtagagaccaggttttcttttcattacttctcagtatctccagaagaggagtcaccagccttcttcagtaacaatagtggtatttaatagtataatggttgtgaagaactcacgatatgctgggccctcttcctgatctgagccctaagatgtaagtgctattatcatgctcatttacttgatgatagatgtattagtccattctcatgctgctataaacaactgcctgagactggataatttagaaacgaaagtggtttaattgactcacagttctgccagcctggggaggcctcaggaaacttacaataatggtggaaggggaagcaaacacgtccttcttcacatggtggcagtaaggagaatgagatcggaatgaaggaggaagccctttaaaaaaccatcagatctcatgaaaacttactatcacaagactagcataggagaaactgctcccatgattcaattacctcccactgggtccctcccactacatgtggggattatgggaactacaattcaagatgagatatgggttgggacacagccaaaacatatcaatagaaaatgaagcaccaagttccttcagttgccccaggtctcatggctagtaagcggcagaagcagagtttgaatccaagcagtcttagctccatattccttctcttgaccacttgactgcccaatttcacagtttccttagcatgcctgtaatgtaattgacccttatggacaataaaaggtgaacggctcatagctcagcagacttaaagaggtgattaccaactcatactggtctcttaaattgtactttataaacatagcatcaaaatgtttacagttggaatttagaggtactctagtctaaaatctgtgggaaggtgagtagtccacagcatgccagtaaactctgccaccagaaaaaaaaaaaagttcctctagtaaactgagtcaaatctaaacattactatttactgcaggatatcttaagtctttaatggggtgtcactataaatatcagagcagaatataagatatattcgaccttgtttgatctggaaatctttaacgtttgtttttgctgcttgtttgttttgcttctcatcaggaagtataatccatacatctggttgggtcaatccaacatttccttattatgaagatcaataaactcatgcactgagatatttgtctaagctcaagggatgaatatggtcctgggcacagtaaaagctgattaaaatctgattccccaaattatcatggcacaaggaaggacattcaaaataatctggtcttttttttttttacatatatgaagatataaaaatttatggttttatacatttgttcagcagcagtatataatcaatatggtacttcactaatcccattaattataccatcatctactttttaaaaaaaatctgtttctcacaataataggaatttagagtccaaacagatgccccatcactgcttggccagggtccaagagcaaactgcaggtagcaacacaggagacaccttctaatgtcacctccacactctctctcaatctctctctagctcaaaacaggcctccttcagagtacttgcgtcactaggcaaatgtgctttcacctgcagaataaatctcagtatttttatgaaaccctcttttataaggaaaaagacaccaaatcaaaaactaacatgggaataagaaccagttcaacttatagctgacatcgtcctactttcctagataagagaatcaactctgtattttattcctctcatttccaggaaggtaatactagataaatctttgtctaaaataaaggataaaaaaagagactgctgaatttaattttttaatgttgaacctagaaaacattttttctactcaagatcagaactttctagtgcacaccttctgaacgatgaaaaccattgattgtgcttgcagagtacagtctaagatagatgccaagaggtctgactgcattctctttgcaactgactaggtgaaataccttaagtaaaccaaagaacattaggactctttagattattaaggctgtccaattctaagtctgcatgtgttttgattgagatgaacaaaatcatgtatttattttaatcacccaaaattgacctaagacttaactctgtgcccagtgttgtggtaaatgctagtgtgtgttaatctcttaattctaacaactctcctactatatctgtattaatattctcccaatcttacaaatgagggaattgaaactgagaaaggaaaaagaaaaaataggaagttaggaggaagaaggaaaataaaagagaaaaagatgaaggaagggaggaaggaagggagaaaaaagaaaaggaaggaaggagaggggagggagggaaggaaggagggaagagaaatgttaacgtaatggaaactattctaatttgttaactatgtaattgtgcaatggttagttatattctgaaatgtgtctctcagttctcataaaaatcaaagaactttccatgtaaaagttgttggattggcaaacaaactttgtatcttattttctgttggctaacaccatataccttcccttaaaatggccttgtgcacatttataaagaaactgaaaatttgtgggaaaaatgactattaaggatcaaactccagataagagggcaaaagttaactaagcttaaatagatatattataatgtaagggagagagaaaatgggatgaaaatccacaagatggcatatttatataggggacatttaatagtggaggtctttctaggaaagtctagtaaagttagctaggagctgtctcatctgctgccagatagcataacccatatgtaaagagtaaataggatttcgaattgacaattatctctgtgcttggagctgtaaagaaccaagatgtcactgacactgttccttatttcatggtccttaaagataaaaggatgtctataatggtgaaatagtattaatcataggataaccaaagaaacagtaaccttataaacattagaaacattaactttgtaaaaacttaaatataatctcgttggtggtcaaaacacactttcaaaatgcatgaatctgcaagctggttttaatgacactatcatggaagcccatgacagggatgctgctgattaatgggctaataaattatttaattggatttttccctccattcaattgtaaaatctatgcatttcttagcttatgtaaggtctgttagtgccttcctaagcattctattttgtcaaaatgtagactgaagaagtaaatagaagacttatacacttaaccacaacttttgacattaaacttttttttttaactcagtactgttaactcaaaacaatgtcatgaatggtgaatacagcaagccttccttgtgtatgtttgtttttaaagatgatgctggtttaactgtaattctaagtcaggaatttcctcacacttcccaatttagaaccttcagttaattaaaggtcagtctttatgatgtaaaagtttgctaataaaagccttgccagttctttttttcttacaactgtgtaagcaatccctagatgatctatttcaaatgtgattttaaattctgaaatgggaaaaatcttctaaagccaataatcagatgtataagatatatgggatttagcatttggagggatacgcactactactgactcatattctcaggaccaaattggatcctcaataaaatgccttaagtagcaccttgaaatttgattcagtgtgatttgtacatattcaatggctaatatgtgctagattccatgctattaaaccgaggcttcatttcaccacgctctcatttcatcaccatcaaatgaatatgtatagggtacttcctatgtctatgccatttaaaagcataagaagaaatacaagaaaacagaatacctgccctcagggaactgtctcagagcaacatgtaccaaaaatttttaattaggattgatgtctgattgggcaagagatctcacctcattcatctttgtcttctgagcaagtgacacagcaccctgtccaagagcacccaaagaatgtttggggacctgaatggtattatgagtaattttgtactgtatagatagaaagatttcccttctaaagtttgtcctagttctaaaataattcccaggagggaaaactgatgctttacacattgattactcctcttcttaattcccaagggtcactgagtatgtatcaccatgttgtgcttaattgttctcaaaatcacttatactcagtttcaaagccacatactgaagccatatatacaagactcagactaaatatatcatatggcaaaacgtaatattataaaaatatatttaacgaatcattttcttggttatctggttaacttttctctatgtatatcttttaaagatatcacatatcaccttattcaaacgtcaactgctgctcagatgataaggggaaagaatacatgaagatgatttttgtgtttggcaatagggtgccagggagaaacctagtttttaaattccagctgggctgtgagccagttgcttcattataaagtgctttattattattattataagaactgtctacctaataggtactaaatgaaacactatatacacataagctattaatgtagtacctagcatatagtagatgcttcataaatattaaattcctttctatttctgtggaaacatggatttaccctcaagaggttgtctccgtagttagaaaatctgattatcctccttcaaattttgctctgaatgaaacagcgtttgtgtttatgcccctctttactctgaaccattacaggtaatttccatagctttgggaataatatagcaaactccaaatgtctacataaaacaaaaaatcatgtataatttagtgtcgcaaatcaacacctacactgtaggtttttaaattactttctatgaaactgtagtttaaaaaatttacacatttgaaaaaaaatcaactgtagttattttaatcacacagaataaaagttattgcaaatactcttcaacatgtctgaaatcatagaaatttgctgataaatattagtaaatacttcatttatcctcatcacctactattttatgaccagattgaaaggccaacagactatttgagtaagaaggactacctaattgatatgaaagtctaaaagccaccaaaatattctacgagcaatactgaacaaaacaaatacgcaagatctgcaatgcatgagcttaaagtaatgagatcaaataattctaaaatgctgtttgatataatttcatttctccatttcttgacagtcattgtattccttgaagttgaggcatccattggttcaagcgaaaggtagaatgcagcaaatacaattatactctacttttaaatttcaaaatgagttcttaatggccatgtcagaaacaatacttgtaagagccagagcttttatttgtaagagctagtctttgttgagaggatggatttaggaggcccaatgagacaaagctgaaagactcagcatagagattattaatgtcaattgcagaatatggaataaatattctaaaaaaaaaaaggaaggaaggaagaaagaaggaaggaaggaggggagggaggctttgtaagttatagtatggactgaagagactacaaagggagaagtcaagaattaagaaaaaagcatagtgctatgtcactgagaaaggcctagggaagatatctcgtggccacagtaaagtgaaagcagatgtgtgcagagtttcggaacttgaagcctaaggccacttcagactctagggacactagcactgggcgctcaccaatgctcagagactaggcaaatctcgtttcttcacccacagtggcctgaaggaacccagaggacttcctggacaccccaccccatcccaccatcacggtgtgatgtaagcttctccatcttccctaagaaaaggaaagggacagggagatgggacaaaataaccctggactcattgccctataaaaaacctaaactgtgtaaaggaagagaacaaattactgtgaaaaggtaagacaaagtttattttcctccaccatcaacagaaatggaagctcaacaccaagtggagttaattatagaaaacaaagttaaatatctctttatctgcattctgcagtagacattttaacaggttacagtgattttttttagatgttgacttttgaacactggtaaatgaaggagaaatatgtaataaaaatctcaagatggagtattagagaaatggcaataagtcagagtgactaaggtaaaatacatgcgtgagcaatccccataccactagctatgatcccatgcatttcttggcactttactgtttttacatttttagctcattagtgagaagatataagctccctgagggacagaggagagaaatcctgtaaaacagagctcaagctttgcctagagttagtgaaaattaaatctaatagcctagcttttgtcactagcttattaaattacagagatacagaaaataaaactattatcaagacctcaggagaaaaggtagaacataaaggtgttacattattttaaataggtttttaatagaaatacttagggaaaataaaactatgctttatgtttattgtattgcaatgattgttcaagatttgtttctgtgaattacaaaaacaaaaaaaaaagattctaattcctatacaaaaacttgtggaacacacacttgaggctagccattctataaaatacatatattttaaaacaacatattgtacacaataaatatatagtttttgttaagtgaaattaatatgttagtaactcacacacgcttatgaacacagacacatacatattggagaccaatacacaaaattgttagcttgaagaaactgcacacataattgatgcaacaaattgaacttggtgtacataaattgtctacacagctatagagatagtaatattatatacttatactattttattgcagtcatgctgaattaacataccaagttaaggatagagttcttcaggtctggttttgatttgagttttgcttttcagctagactattttttccaaactagtgtcagctttgaaaagctgcaggagcctcttgtggatgcccacctcatccgacggaaggcagtgttccaaaaccctttgtgttagtgagatgagaagttggtaatgtaaggactggtttaagctgtaaataagcacactctcacaaggcatcaaccagatgtcaataagaattaaggtttacaaatatcaaagaaatccaacctagcatctattgtaagggtaatcctttacttaagtcaagttccgttttaaattaagcctaaatgaattattctcaaatctctgcatattgaatagtgcatcatagacatgccacatcaccacgcaaatggaaaataaagtactaaaaattaggtcagcaattgtatctgcaaaagttattttgcagagcagcgatctgacctacaacattctctcttgaggcgcatttaaatactacaggatacagtacaagagtaatggagacatcagtgaaaccatgtatagacggaacagattatgttttactggttagtttggttgggttctgtagctcgggtgaatctctcattttgatcatggtcttctctccttgcctaggattccaagagcttctgagacaccatcatcaccacaagaaaatagttcccactagttgaacattttttagtaggtactaagctcaagatttggccttccctgtcacattctattcttaaaatacccctgtgagacagagattacactcccattatacagataagaaactgagactgaaagagaccaagaattttcccaaacatacacagctggtaataggaatacagatgtgtctatgagggcaatgctcttctcattatacttgcaagaaaggcatggacatttagtgcagtgagaaaatgaatggacagaaatgttttaaaaggtttaattataatcaaaatacatttggaatgctgtaaaagcagaggaaagccaagaaccaagattcagaaacctctaggactgacagagatggaggctgatttttagacattctagcaaaaataaacctttccaggaatggtgagcctcataaaatgactgcattcatcatactaggggagtaaggcagaaaactgccacatagacctaatttgtgtcaagcttgctgatggcagctgctgttggtacttttctccagtgtaaaggtctggtaaataaaattacaagaaaatgtagtgaaaaatattagtaaagacagagttctgactagatggagttacaagtggctcaagtgacacattttgatacaaaatgttttgttttgcttatacaaaattaaattactagataatttaatgggctccagtgtaatgaaaagcacaattccccaaaagattttagtctgtaagcaaagattcacagtggatttgagggtcattattcagcatggtaggaaagcgctaacaggtgatgtttagaagttttggagtgctagtattgacttgctttctctttctttagatcacggtgcctgttctttaccgccatatctgctcgttactaggaattaccttatatttggatcagaattccttcttttaaaaaaaatctatcttataggatcagggttttttcctgatcaggacttttctttgcaattctaactgcaagacaaatatctgagaaagggtgctttgttgtacacactaaactttcccattctctatttcacattgacggatcaattctcctgtcaagtttgacaactgtcattaataaaaaggaaatttgactgtcatgcatatacaccttgttttacatgcacacactctcaagcagaaatgtagagagcacacggccttgctttgctacctgaactattatcacgaacttgtttggttatagtttagaagatgaaaaaagaaacattttggctattgagataaaatcaaaatcatgcagtctaaattctggactgaacaggagatccctgaagataggttcttgagagccacgcagcaaatgacttgaactgtcatacaaagtttccatttgtgactgggaaccccctgcagagaaatgtggcctgggttgaatgaggtgctttcctaggatctttgttttttcatttcctcctcttggtttaatatttctataactaatagacatattcaacatagaaacttttactctacttctcagtttgtcttttttatattaaaaaatccaaaaagtttggaaaatagattataaattcactattctgatatctataagccttctatgtatttattttcaaatatgatttttaaaaaccaggcatggtggctcacgcctgtaatcccagcactttgggaggctgaggcaggtggatcacaaggtcaagagatcgagacaatcctggccaacatgatgaaaccctgtctctactaaaaatacaaaaattagctgggtgtggtaatgcgtgcctgtagtcccagctactcaggagactgaggcaggagaatcgcttgaacctgggggtggagattgcagtgagccgagatcgcgccactgcactccagcctggtgacagagcgagactccgtctcaacaacaacaacaacaaaaacaccttatagtatctggttaaggataactccatattgttccttatgtatcactgttactatctgtaaaatatctttgacattactacaaaacttaacacttcatagattactcactagtttgcttccagttttttactgcagttgctcctctgaacattttatgcattttttaagactaattattttggctttacattcatttgaattccttcttaatctggaatgcctgagtgggattactgggtcaaaggccatgaacacttctgtgagtactgataatctccagttagttttatgtgacctgacgatacatatgattagtggcttcatggaaatctcatcatttctttttcttgtatttttatttcctttttctatgttctttgttttcctaatagatgctttgatctttatttccctgtttatttaccaatcctataattgcatttgaattttaagttgttgatttctaacagtattaaatttagaattttttcatctaagagctgataagtattcaattttcttttattttttcttatatgtttacatatttactgtaatttttagaaattattgtagtaaattatataaaacatgcatctaactgaatttgtaccccaaactgctaaccattcatttgaaataatttatttttgatagtctgcttctcctctctcctctgtttttagtgggggaagaggttatgtgtattataattagatttattcagtagctattcttttctaataacacatgcattttcttaggtaaaagcattatttcaaagttccatcttggatgtactaacatatgatatactttttcccactagaagtatgtctattcattcacattttcattatctcagcaaagttttacagaaaaatgctcaatctctttgcagattacttttcacatatttcatgcaatttgctactattataaattaaatatttgttgtaattcctaagtgactatttctagtaaggcatttattttgttttaaaaatttatttactttgaacttacctatattactggagccttttattagaagttattttttctttctttctttctttttttttttttgagatggagtttcactcttgtcgcccaggctggagttcagtagcacaatcttggctcactacaacctccatttcctgggttcaagtgattctcctgcctcagcctcccaagcagctgggattacaggcatgtgccaccacacctggctaattttgtatttttggtggtgagccaccacacctggcaatgttttactcaagtttcaatacattttaacatccctgccctccaaatcaataatttatatttatattcaatacaaaagtatttgatcattgagaaatatttgtttctttaaaaaaaacctattactctgcttgtctttatacattttgaaggtctaaatttagaggattatttgagatgttgtcagcatgaattcaggaaaattgaggggaagattaacagggttgtttatacatctaatttaaacatcaatttgtgattactacatttatccaggcttattagcaattcaggcagaatctagttgtcataactatttaatgatcagttaccatttcattaaaatacctattctaaagatagtatttaacactcttaaagaacctaatcattttctttttgtaggatcagttggaggttaggtaggacttggtctgactcagaaggaaaattattttacacctcagcaaacaaagtaatgggggttttttgacataaatagcactgctgtgctctgtaattgaagttcaaaaatggacgatgaaaccacagaagcagaaaaccaaagtaagcttgcaatgaaaagaaatacaggccacagttgcttctggctgagactgattgccaatctttgggaatgagattatgacaacaattctaatgcattgggtcttgcattgacattaaatcacactcctcccttaatgtcactctccaagcacaccaaagaatatgtcattctgtcatcaaaagacatgacatagattgatggagacttcaataggctatcagagttttccattgggtagaatcctgcccttgtctggtcaatatttagaggtgctgctacatatgctgctacatgttctaaagcatcgcaggagtggcctgaagaaacaggacatagtgggagatacaaacacatcaccaactgaaatttacttttaatcttttaatgtgcatcgagtagtgttgcttccagattacttataccttttcaaaaagactcacaacaaccaatcttttctgttgtccagctttttaatagctgtaacgtttaggacacctagatttctgaggtgagttacataaatatttcatttttgtttcgtattcatggcagaatttctatgtttcatggattttcttaatgcagatacactcaaactaacataatatagtagcatgtctaatattttttccagaaggataccaattcaatagcttgatatttaatgcaggcaaaatggacatatctcaatatagattgttaaaggtgaaatcattttagttacttagtaaacatattggaaggatccagggcattactaccatcacatattccctatccccaaaataaagtatgctctgcaaaatccatcacaattgcagtttctcattctagggtttttagctattttcttgctcttacaattttggtgtaattctgaaataatgggcacatgaataacactgtatttaataaataatggaaaaacaaaacttgaatattgatttcattatttccattttcttagaatgacataatttctgcaagcaatacgctgatatcttaatttacaactgaaatgcacacacattcatttcaactaaaatgccatgaaagtatcatggcagaattgacaaaaatcacagaataaaagattccctcagcatgctatttttaaaaatttctaagagtgatttgtgggataaaacattaaatatttctatcattattcttcatcccataaactgatgtatgaaagaattttatagtagagaacacatctttggaaagaactattttcataaatgaaacaggtgtaacatattaaggcagatagcaaaaatcctaaactatgaatatttgtaaactatctaaataaaatagaaaattaaaatgagatcttgggtagcctatcattcaatatgttaaaaggaaagaaacaagtcaaaagcacaggataagaattttaaatcaatgaaattaaatctctgaaattaaatgaggtaagaatcatcacacagtaactgaaattataatctattatgttgttattttcagatggtttattttttatatgtctctctagcagtcaggaaaaaaaaacccaaaataaaactaatctgaaatgtactataatcttgaaaaccgaaaccaacatttcatgaagggtgatttaattacagtgtgttatagtaaccttaaaaaatctagagaaagaagtgggtaaggtaaatttttaagaagagatctaggcaacatctgtggttattagaataggaaaatctctggaggggcaaagggtaaattatcaggctcttttggctggaaagtagtatctgttaacattcaattcccattgctctaatttcatagccaccaagcaagtttcctacctataatttggccaccagagcacatcttctcacccaaggggggtgtcttgtatgattaactaatccagttattttattatgtgtagctcctactgtaaattaatgagcagacattaagatttataaatcagtctcttgtgactttggctaatacaaatcagtctcagtatcacctcgacatgctctggcttcaagcataggacaataccctgagtaacacactttaccaaaatctaggcaccaaagaaagcttaacctaacatgtttcttaacctgatgataaaacagcctaatgtttttctttttactatggagagaaagatgacagttaactaagagatgaaaaaaatagaagagtttttaacctgatactgagttgtaaatttctcaatctgttccttaactttcagtcttaaatagaactcctactaaaaattattataaggattattccagaattgtagtaaatgaacattaagctttttttcttcatctcttctaccttatatacttttttggagggtgactttaaagaaaatataaaaaagaaaatatagtatcctaataatttatttcatgtttattcctgcagaaatcaatggtttaaaaaattgtgcacaaagtgaaaacaaattctcactaaggaatttttctgtaaattcatcttttctcctgtacttatgctgtgtataacatcagaactaattttaacatgagagcaacatgttcaagaatgcaattattttgcagaaaatgtgtgtcaaacccagacagaagaaactgtgagttttaaaagtaatatctcttcaagacagtgtagcattgacaaaatagaaaaataaattaatggaacagaacagagagccatatagttagacacacatcaatatagtcagctgatctttggctaaggagcaaaggcaatacaatgaagcaaagactgtcttttcaacaaatggtactggaacaactggatgtccacatgccaaaaaactgaatctagatacagacttttaatcttacaaaacaaaagtaactcaacatgagtcatagatctcaatgtaaggggtgaaactatgtaacttctagaggataacaaagaaaaaaaaatctagatcagaggtgtccaatcttttggtttccctgggccacattcaaagaagaattgtcttgggccacatatcaaatatgctaatgatagctgatgagcaaaaaaaaataataaaataaatataaaaataaaaaaacaaaccacacacacacacaagaaaatcttatcatgttttaagaaagtttactaatttttgttgggctgcattcaaagattcaaaaaatctcatgttttaagcaagtttatgaatttgcatcctgggccacatgaggcctgtgggcttccagttggatgagcttatctagacggtcttgggtatggtggtgaccttttagatttaacaccaaaagcactatccatgacagaagtaatctataggctgggattcattaaaatttaaaacttcttctctgtgaaagacatagtcaagagaatgagaagacaagacacagatttgaagaaaatatttgcaaaagatatatctgataaaggactgttacccaaaatatattaagatctcttaaaacagtgagaaaacaacccaattaaaaatgggcagaagacatgaacagacagctcaccaaagaaacagatgacaaacaagcgtaaagatgctccataataaaatgtcagcagagaaatgcaaattaaaacaggaatgagatattactgcatatctattaaaatggccaaaatccagaagaacaccaccaaatgctgacaaggatgtggtgcattataaattctcattcattgttgatgggaatgcaaaattggcacagccactttagaggacagtttggcagtttcctataaaactgaacatactcttaatatacaacccagcaattgtacccctacacatttaatcaaatgaattgcaaacttacatccacaagaaacaccctgcacatggatgtttgtaacagctttattcaaaattgccaaaactaggaagtaaacaagatgtccttcagtagataaatggctaaactgtggtacatctagataatggaatattattcagtgccaaaaagaactgagttaccaaaccataaaaacacatggagaaaacttaagtgcatattattgagagtaaccaatctgaaaaaggctacattattatatgattccagctgtatgacattctgaaaaaggcaaaactatggagacagtaaaacatcagtggtggtcagggattagagggaaggagagatgaataggcagagcacgaaggattttttgggcagtgaaattgctctgtatagtactacaatgggagagacatgtcattatacacatttgccaaaactcatagaatgtacaacaccaagagtgaaccctaatataaactatgtgataatgatgtgtcaatataaattcaccaattaacaaatgttaatgcacctgcacctcctctggcgcaggtggttgatagtcggggaggctgtgcatatgtggaggaaggtggcatatgggacaatggaaattctgtatgttctgtttaattttgcagtgaacctaatctgctgtttaaaaaggagtctattaagacaaaacactaaaaattttttaagtactatctttatgttcttatataaatcattgctcactgatacggatacccaaatctagtactttaaaagtttttaaaataatgaactgagacttcatacctgattcctaaatttctagatgacctgtctgttttataagataatcttacattaaaggaaattataaaaaggcaaaacatagcaaatgcattaagatgtcatttatgtttcattccaagattatctaacttatgtgtccaaaaataaatcacatcatattttaatgtctgaaagatgtaccttatatgactcctgatatccattttcttgacctatcacagttaagacatttctgttgcataccttttctaattactttttccttttactgagataacatagtctttaggtttactgttatttccttatttccattggctttaatctaaacagaaagatcacataatccatttaaattgcaacaatgagaaatcccatctgacctgaaggatattttatttcctcattggtcacttgaaaatactgaaactctttttctttttcatcatggaaccttatcatttttctggttgtaaatattgaaagagtataatgaagcagaagaaaacatcagcaataaaccagaactcctcgggcaagactgttaacattttagcagttttgtttagaatttttttgcattttcataattaagaaaagatcatattcctatcttgttttagaatattattgtaaaattcttttccatgtcattataaattcttcataaacaccactgttaaaggctgaggacctcacaatagagtcaataatttatttaactattctccatattctataatgttgctgggcattataatggtgtgatgaatatcttttcactgtaatgcctccctatatttcaaacactttttacaggagttttttcctcaataataccctactggccttaaagagaactcacttatacctgtgataaatacaccaagaacacagttatcatatgatttttttatcaaagaaaaatatcacataaattgatagcattttatcaaacttattttccacatagtcctgccttccttattcttcaacatttaagtttctttctctttcagtagcctgtgtgatcatttctttgttctctagtttcaactatagtcaacattattgaaaagtttcttttaaaattgggaaaattatttttggccccatacctaccctattaatcccaaaaagcatatggaaagaagcaatggagagggaaaccgaaatcctcagagaaatctgatgtgcgttgacaagacagggagaatttgagctgaagtataactatggcccccacctcattcagagagcatgacacattccatctgctcccagacgggaatcatcatttagcagtgaggccacaggttagaaaagtgaatgaatcccccaactagaacaagtaaagtcccataatttgaaggcttttctaatttgagggccctgggctgctttggggaatcctataaacatgtcagtgtcagatttggagggacttagcttcttttttctttgaggccagcaggaccttctgattgagaagaggaaattaaaaaaaaaaaaaaatgggcatcaacgttcagaggcagcgtggaagagataagaaaaacaaagctttggagtcaagcctatgagcatccaagccaggctaggctatagactatgtagaatgtttgatcttgtacaaggttcttggccacactaagtctcagtgttgtctcctgggtgataactaactaaaatgtgtggcaatgtgtagaaagtatgaaacagcatatctggtacatggtagggtttaataagcactgatacccttttctgcctccaaatttcctctacttcactgagtccttctcttttccatctagactcaaggaagactgaaatcaaaggcattctggacttttcctaggttgtccagcccactctacagggggtggggtaaaagaattacacaagtaaatatggtattgatttacattcacacatgaacttttagaaatacaccaagtgattctattgcataattcaggcattttttgcatataaaaccagttattgcttttataagcatcagtagtggggaggaagaggcatttttcaaacttcccatacatttgaaactgagaaatttcccatgacacgaacttatctttctactctgtctagatccctgctttactcagttgtcactgattttatagcttgagctctaaatttcaattaatttaaaatacaattaattttaagaccatcaaatccagctaagtttatagccatctactagattcacatgaatattcatttcctccagctcatttattaaaatcaatttaagaaaaatacagtttaaaaggattctgaagaaattaaggtatttaactaaaacaaagaggatattatccagcaatgttttaaaaagatttttaatagtagaatctgctttctcttattaataagtttttgtgacaactgggactttttattttgcaaatttaaaaactagagcaaaatcttgcccttgttttgatgtagatgtattatagttttatctatttaagtcaaaaacatttttctgagaagacaaaatttggtttatagtttggttgggctatagttattgtcattctcctgtggaccctaaatatactctaggcaagaaactctggatttagaaactgtctattaacctagttttattttaccttagtagttttcaactgtttgctatagaacttcaagtacctaaatgatggagttacatctgctacccagattgggaaacagatgacaggacaggcctaatagtgtcattagtttatttaaatattgaatgaacaaagaggattgctctatgtgcaaagtgtggcaactgctaactaaaaggtgttatcccaacgtctacttttctgttgataattttgtttttgctggttcttctcttgaagaccataccaacagacacgctctaaaacatgtccattaattcaatctgtctctgcccttggttactccctaactgttctagtattttacccaatgtggtaggcagaataatgacatctcaaagatgtccatgttttaatccttggaacatgtgaatatgttactttacattgcaaaggggattttgcagtgtgattaaggttaaggacctggagaaaggaagattatcttgaactatgcaggtgggcccatttgaatcacatgagttcttaaaagaacccttctgtctgagataaaagtgagagaggtcaccaagagacgtaacattgctgtctttgaagatggaaggaggaggccataagccaaggaatgaaggcgacctccagaagctgaaaaaggtagagaaatggatcctctcccagagcctgcagaagggaacatagcccaactgacaccttgatattagcccagtgagagtcacttaggcttctgacttacagaactctaaggtaatacatttttattgtttaaaccattaagattgtgggaattaattacaacagcaaaagaaaattgatatcactcataagaattaatctcatcgtaaagaaaaaaaatcctgtgggccacctgcctaccacttttcagatggataatggcattcataattctacagtatcactttgaattcttttctagtaagaaaatttgcacatattgaattcctaactttttgaggcatgaaagagtttgaggttatacataaaccatatcccctatgttacttctgggtttctgtcattctattttactctctccttcataagatgtcaaggatgtattacaaccagaatgtacttcttacctgtcttgctacattcacattgtggtgcacatgagaatgctgagattaaaggctcaaaaatgaacaccttaaaaagagagctgaatctatcatttctagcagaaatggaatcacaagtatttgggccagaagtatgaaatgttttgttaagtaaaaaaaggctcattgataaaacaacttctttgtattttctataaaatcaagaaaattgttcaaaatatagaacaaggcctggaacagtggctcattcctgtaatcccagcactttgggaggctgaggctgagacaggcagattgcttgcgcatgggagttcaagaccagcctgggcaacaatggtggaaccccgtctctataagaactacaaaaattatccaggtatgctggtgtatgcctatagtcccagctactcaggaggctgaggtgggaggattgtttgagtccaggaggcagaggttgcagtaagccgagattgggccactacactccaacctggatgacagagcaagaccctctctcaaaaaaaaaaaaaagaaaaagaaaaaatatatatatatacacacacacacacacgcgcacacgcgcgagagagaaggtgcaacaaaaaaccattgttttcattctacttacatttttaaactactatttttctcattccttcatctcacaaaatacttttgtatttataagaaagtacttcgaatttatctaaataagcattaatcatctttatcaaatttctggctaggaccaaatttttgaaataaaaacaaaaatataacttttaaatacatcctagaaaaagtacaggcaggaaattgggcttcaacatttaaaatagaatgggaggctgaatggtgtctcatgcctgtaatcccagcattttgaaaggccaaggcaagaggattgcttaaggccaggagtttgagagcagcctagacaacactggaagaccctgtctctacaaaaaacaaacaaaaaaatacagtggggaaaaaaataaagctttgtaagtaatatctattaatacagagtttgtgataatttagaagatatatttaatcatgattgaattctaaggttaaaaagcagccaaaatcaggggttttaaaataggagatgacattgtgtaatggaggcttaattccaaatataatcatgttccatgaatatgtcattatttttgacaactaaaatggcattttctttaaaaatccaaaattttgacttactacaaatttgtacaggattttcacaactctacattggggatgaacttttattgcacataattaaaaaacaacagaatggtgaaacaagtgttttatttttcagtagttgtgtctacaacatatgcatttctcctttaatctgcaagtatttttaaatttttaagaatcattctctcactagataagaggaaggagaccctctgttataaaagcagttgccgggaactaacaatctgtaaccataactatctcgctctaatggtaggtgcaaaagtaactcttataaggcattgtcttagcctgtagtccccttactgctaaaataaaagaatcacaggacgttgagagttaaagagaactttaaaattaattttttcttcttgagtcacttagtgtgttttttaaaaaaattattgaagtatagctgaaataagataaactttatgtatttacagtgtacagtttgattagttttgacatctgaaaccagcaccacaatcaagctaacgaacatttgcattgccccctaaactttcccttggtatctatcccagatccctctcccagccccctgccccagtccccagctccaagcaactacaggctgctttctgttactattgataaatttgcattttctaaaatattatgtaaattatatagtatgtacaaaattgtgagattcaccaattttgtcccatgtatcaaaagttttttatttttagtatttctgaagttaattattttattcatataaggtcccttagtgggcaaattgatgagctgaaattcatggttatgtccatagtcacatactttgtaagtgtattagtcagggttctccagagaaacagagccaatagtctacacatagagacctagaaagaggttaatgaccgctcggctgagatgtatcgtgtgggactaagaagttccatagtctgctgtctgctccctggaggcctaggaaagccagggttgtcattctaacacaggcccaaaggactgagaaccagtgaagccaagggtgtaagtcccaatcccaatatcaagacccaagagccaggagcatcagtgctgaagggcagaagaagatacacgttccagcttgagaatgaatctgcccttcctctaccgttctgttttatttgggccctaatggcttggatgatgcctgcccacattgctgagggtgagtctctttattcaatatactgattcaactgacattctctctggaaatgccctcatagacatacccagaaataatgtcttacccgcttacctggacatcccttagcccagtcaagctgacacataaaattaaccaagagtgtgctttacaagataacattattaaattaatataatattattcaaaaatgttacccttagcctcagaaatcccactactttggcaacaagcaaatgatcctcagggtcagctaggctatggccattactacatgaaatgggaaggaaattttgagagagaaggaacaaaaattactctgagccattcttgctggttcctgagatacctacaaaggaagaattacaaaattctaatataagaagactttatatctttgtgctttgttattttaaggattgagctactaaaattagactatatgggcaaggagcagttaaaaataccacttccaaaaaagcttttggaagaagatgggaatatgagtaagggttggggtagggagttgttggggtagggagtttcttctggaccacagccatcccagaatatattgtgttccctaaagtgtgaaaggtatattaaaaagaacagcaatagggagtttcttctggaccacagccatcccagaatatattgtgttccctaaagtgtgaaaggtatattaaaaagaacagcaatacagagtgaagccaattctagaattacctttcttgcaattctggtattgcaaacatatttgcaatgttaattaaaaaaaaaaaaacaaatgcttattacatggtctgaacactgagcaatctcatgaaacagagttctctgagaagagtctccaggaaaggactagaccaacataggttagtgtggcagtaagaaaataccaatgttggtcagagacaagagaagggaaaaatatccttttcttaatcagtattctgtacactgttcttcatttgttctttcattgctcctgaccagtaaaatccaaccctggacacctcattgttcatctcctttgcaggattaactcccttgacccagtgtataaatactgaagttcctctctgctcaacatgcagccctcttctttctctctggcaatctcattcagtcccaatgcctttaattgccacttatacatggtgactcacaattgtgtaactccaacccagatctcccctcatagctctagaggtacctatccactaacctacttgaaaaatcctcttgaatgtcccaaagtcatctgaaagtcaacatgccaacgagaaagtgttgatcttcctcctcaaaaggatcctcttccacaattcccctatctcagtgaatgatacatcccgctacccatgcatagggccatccttgacatcgctctctccctcatcctcctcccacatcgaaggcatcatcacttgttgttgtctttactctctaagcacagtctctttccatctggtccacttctaccaatttctgctgtttccatcctagattaagttaccatcatggacaatttaagcaactacctaacaaatcaacccatatgtcttctagtttttaagatgtattctctgagccagaaggatctttcaaaacacaaaccatcccttcctactcctcagaatatctgaaattcaatcatttttaaaattcttcctactaaatagcttttaaatctatccaccttttttcaatcctaatgccactaaactagaccctaacattgtcatcacctctttcctagattataccaaatgctttgaaatttttatcctcatctgtggtctttgcctttaaaatctgtgttacaagtgcaaccaaagtgattgtcctaaagcaaaagcttatgtccctcccttgcttagaccacttagttaaaatcaaacagaaaaatcagcaacatgaaactatgaatatacataaatatcactttcatctcatatgaggcattcatacatgagacttcctagtcctagaatataagatgtaagaaacaaaaaataaacagggttaaacactgtatgcatttgttaacaagatgtaaaatgtatcacaaatgtttcattgatgaaatgatggtcatttctgtgagatgaacttcctggtaagtataatcaaccagacacaggaggaaaaaaagtgcctatgatctgctaaaggggtctaagctggggctagcatctgtaaatagaaaagtccttattcattcagcaaatacttattgagcaattagtccatgtacattaatttggcgggcaatttttagcatatgcagaagtgtaagaagtggtccctaccctcaaagtccccacaatgtacttgaggagccaaaaataatatgagaaaagtttaaaagcccacaaccagaagatgtcacagaaggaaaaaatgaggtaggataaaagagattaagaggtgcataaaagctttgtagcaaatacacagaagtaagaaagctaaatgtttaattaaaagttgtagatgaactagcctatgagttaggacagaacttttgactcacagaagcttttatcaacatttttggttgtatagacaacttggattttgtgttacaatccaagtacagacaacttgaattttgagggatagtggtatgtcatgacatttaatatgatttgaggttccatcatatgtttagcagtggtcttaactccctaaagattttagatctccctaacggtatgttaactgaatgttagcctgtgaattttgcacagataattcacatatggacaaaccacacaaatgattcatccagacgatgataccataaaatatcgttatttaaaatatttctcataagattgcaagaaattcttttaaatgaaaggtcattaagcatctttatatctaactagcaatccaacttgatatattattccataaataacatctcatccagtcatactgcctcaggttacagcaaagttagactataccagcatgctctgggtgagtgaggtagttgcaaggaaaatgtcaaatactgtttcacggacaacattttaggagcaagaatgagtctgctggttttttccaactcatattttatggtgtcaatagagacaacaaaaaatccctatatgaggtagacattttgtccagaatttcatgaaaaaagcatcatataaactagttgatatttttggttgatctctaagttctcatgtattttcaaaataatgacttgcacatttatgcaatcctctccagatcccagcattgccaaagttaaaattgtgtttagtttttttaaaggcaaaccataaattaagtactttgacttgataaaaagaagtgcttagttcaactaataattagctgaagggtaatagttcagctattaagtgtatttgctgtcaaaagatcagccactttcatttacctttttgcaatatttctccatcttttttgccctttgttaaattttaaaaaagataatacattctaaatgtcaagactggatagtatattaaatatttcaacatttggaaacactaacaccccatctttttttccccttacagttcacactaatttgtcctgatttcataaccaagtaatttaaacagtgtagtctctgttcagtcttcagaaacaccattacagtagccttcatgtgttacagcacagttggggcaaaagtctttgaaatgagtgaaagtgaatttaaagggaataactaatttcaggaataccagctgccaaatgcttcaacttacctagtaaccactattctctaaagtagtctttttcttactgtagaactttttatactttatccaacaatctcatatacattattttattcatcttcacattatcctttgaaagaggtagtgttatctacattgtttcaaatgagaaaattgatctgaatgttaactgaactcaccaaactagtaagaattatactagatatgctttgttgtctgcaagctttccacccaaaactgctaaatggatcagaaatggatatttcaccccaaaccaatgaacacttcattagcttgtcctgagaatttgaactgagacaaaaagaggctattggcggatgtcggctttggaaatgaaaggtcacgctatggtttgagggaccaagaaatgactttgcaaagtcatatccaatatgggcaagcaaaagaaaccagtgaaggaaaaataaagttgacacgttaagatgagagggaagatgacatgaagggaaatgtgcagcctagaagagagaaagaaagggagctcgttactggatttctcttctgatccacacagggtctggctgtactttatttgctgatcttagatgacagtcaaattgactactgaaggcttacactgaatcctttggcttaagctagcctgagtgggcttctgtcacaaccagagcttccttaactgaagaacagtggtagagccctgacttgaatcattaagctctgggtttattcccaatgctctttgtcatgcacaaaattgtgaattttctcttccttatagagttcattcactagatactgtaaagtggcagaatgcattcacctggtatgagtttctaatcaatctatagatagattagatagatggagtatatgactttattaatatatgtaatagaaatattgttatatatggaataactaggaaaatgataagtaataattggaaattagaaaacaacatttaagaaaaatatataaatgaaagtcttagaaatcacaagtctcttaaataatccaaagctatcagtattttcaagtgaccagtaggtatatgaaaagatactcaacaccactaatcagagaaatacaaatcaaaaccacgatgagataccatattttcctagtcagaatggctgtttattaaaaagaccaaaaattaccaaattttgataaggatgcagagaaaagggaactcttatacactgttgatgggaatgtgatctagtatatccactatggaaaacagtatggagatttctcaaaaaaactaaaaataaaattaccaattgacccggcaatcccaatactgggtatctattcaaaggaaaagcaattaatatatcaaaaggatactgcactcacatgtttatagcaatactcttcacaatagcaaagatatggaaccaacctaagtgtcgactggcagataaacgcataaagaaagtgtggtatatatacacaatagtataccgctcggccattagaagaagaaaatcatgcctttaaagtaacatggatggaataggaggtcattatcttaagtgaaacaaatattgcagttctcacatgtgtaagctaaaaaatttgaatacatggaggtagagatttaaaaaatagataacagagactggaaagggtgagtgggggagaggagggaagatgaagagaagtggtttaaagagtacaaatatacggtaagaagaaataaactcaatgtttgaaaacagagtagagtggctatacttaacaaaaatctattgtactcaggtgatgggtacctaaaataccctgacttgatcattgcaaattatatatatatgtaaaaaaatttctcacatacctcacaagtttgtacaagtaacaaatacattattagtattttctgcaaccaaaacaaaaacaaacagacctctaacacaagatattaaaacaaagttttaccaaaatttagtgaaatcggacaaatatcaaccaaagtcaatttctatgttgcaggccaatgtgatgagcaaggaaacgtgctgatatgtcttcagcaccaacttatcatacatcacctttgaagactgctggtatacatgtgaccttttatcacacacatgcttattaaatcctaagcaacttcaagagaaaagtgttcccctatttcacaggtgaaaaaaaaattgaggctcagaaaagccaagtgtcaactctagagttacagagattataaatgataaaatccacttttactcagaggtgagagaggacacaacatggtttaaagacagccttgagcataacaggtaaataaatgtgtgagttaatgaaaaaattgcttaggcaggaagaaggaatgaaggcagtgatgcagcccactaacctacaaaacctacaaaggcataaactcccttctttcttctcaacgatcctgacaatattctccctctcattcacacccacccacccacacacacacacacacaaagtgacgaaggctctgccacatgcttcattaaatgggaacatttaattttatgattttttttctattggcactttttctactctgcttataacaatgtattttccattgcttatcataactggattcacctagagattttacaaatttctgggaagcttgggcagaatctaggactatcatttcagaagatgtttctgctacaacagaagtttctattaaagaatggattctagtgatgtgatatgaacattgcaatgtatttgatttatatatttcatccaaatttagtaatacttgcccatgtcagaaaatatttttacttcttagatttgaaagccttaaaatacgggcattaagcctatttaacctaagattgtggggaagaacatatgtagttattgaactgacagaatgatgctatcttgtagcaaacaaaatgtcctacatttctaagaaagatgatatttattaataatttagaagaaatcaagaaacatcagagctagagaaaagccaaaagactactgcatacatttccatgttacagatgaggaacctaaggccttcccaggtgtcagcaggtgagcaatacttatcaggtgctctttgtatcacaagtatgtatgtgtatatgcatgcatgtatgtttgtatgtatgtatgtatttaactcttggaaggcaaataattgtattaatctctgcattcataagcacccaataacttacctggctgagcatgagtgtgctgttaagtgatggttgaatgagtcatgaactcataaaatgcaactggtacttctcaagcacaagttctaataaagacaaggaagtagatgactggtcttttaatcatgcaatattcacccgcattgatactgccatttagtgttcctgatttgcttgcaaagaagctcagggatacccttttgtgtcagagaagataaacaggagacataggagccagctagaatttccctaggctcagaaatacctccttcatcctcagcaactctggggccctgataatgaaccttctcacaatctcctctaacacagcagaggagaagcagggctagtgtctctggtgcagttcccaggctccaatctgagagtgcacggaggagagaacaagcatcctacattcactcactgagctgtgtaatacactggttatgcactcacctgtcaagatgacatcaggaccgtgtctctagataaggctgcatggactgatcaaccatgtgtgctttgtgcagagcctctactcttacagaaaatcctcctcagtttccgtaactggacacagatccagattagttggtaggatctgctgtttggagttaggctgctcctccatcttccttggaccacggcatctgccttcttgtggtctgaggcagaattagattttattaaagatactttagatttgatttcaagttacaattttgttcaaatgttatggggagcaaaatgtcactgaaaagaggttagctgtgaaaagcaatgaacgactgccaatgccattgtgctagtgacttaatgtgctggtgtttctgggggatgtctaaccacctgtcatgctggaacaggctgactgatcagccatgccatgcactgtctccccaagaaatgtccccttcagaagagaggtggtggttttccagggatatagagaagaatgttatatgcacttatgagtcccattgagagcctttgagacacaatccaccaaggagatacaaaatatgagattaacctaggaacagggaaaacagtgcaatacaaatcacgtaatggttttcaacctaaaaaagtatacagtgaatgaactagtgtttcaaaatgtttaaataacatagtctggtttttaattctgcatatccgaaacaaaacacacactgttcaaaagaagtttccttccactcttttcctccaacagtctctgaagtccctacagaagtcaacttttcttctgaagcaatctgtgcctgctaacatcttcctgagaggttctatcaacgttttaaaaatgttttaatgtgtttatcaggatacattgactgcttccaaaaaggatgtaagaggaatagtttcctgagtgtcaactatgtgtggtacttggcattaaggagcacaagaatagcagtcctccaagcggtcagtttgcctgctccacaccattactggactgggttcatttgggagatgaactgttctctggatatcaaagagtgggaatgactacagatggcattagccagagaaatgataggtcatttttctgaattaaaaaaaaaaaacaaaaaaaaaaccccaagtgacaagagtgaagaagccaaagggtctccaaccccctgtttatattttctgacctctctgttttttgtttgtttgtttgttttgagatggagtctcgctctgtcacccaggctggagtgcagtggctgatctcagctcactgcaagctccgcctcccgggttcacgccattctcctgcctcagcctccggagaagctgggactacaggcgcctgccaccacgcccggctaattttttgtattttttttagtagagacggggtttcaccgtgttagccaggatggtctcaatctcctgacctcgtgatctgcccgcctcggcctcccaaagtgctgggattacaggcgtgagccaccgcacccggccgacttctcttttatcttccccacatatgtggaagctcaacctgtccagatttgccactaaacctacaaaaatgtctgttttttactttcccaattctgaaaaaatccttggtagaaagggacatagaagactgatttcgattcccagatctgtccctagccacatagcataagacaagtcatttagtgtcttttggtcaatttcctcatcctttctgatgggcatagcaatacctgtaacaaaacaatcgcttatttaaaaattcacaatttatatggaactggtttcaaaatacaaaagctccttcaactgctctgatatttttatatttttatgtctaatgtactgcattatagcacaagtcccattcgtattataactgctaccttcaatgctgtcacagaaagcaatgtatccctataaccattcccagaggctgacaccttttgtactcacatatggacaatgctgaatgcctgcaaagtgtaataatcaaaagtgtagacttcattggattcaaaattctattctggtgtttatgggcaaggaagttgaccttcctgagcctcggtttccttttctgtaaaagataggtgacaatagaactattacaaggatgaataagataaggtaagaaaaatgtctaacactactgaatgttacctgctgcttgttaacgtgggctttgcagcacacataacagtaacagtagcaacaatcccagaatagtgatgtagctatgcttaattatcaaccgccttgactgttcactcttatttcatgtgtgtttattttgtctctcaaattagcacctgcaaagaaatgagtaggttttataattttctgttttgtacagtatctaaaatgattccaagcatatattcgacagtctgaattaaataccattttaactatctgatgattcttcactatttccattggtcaataagagttgagtatggaatatcccaaagccttataggtgagctgaacctcaggaatacagcaaaaagttcaaaggggccataaagatgctgcagcaactaaaggagctctactttatgctttataaattggagatatgaattatattgcataagggagagggggttacaggttacaataagtgttgaaaaccactgtcatgagtactcaaaataatatgtagccatgaagacaaatcaatatgaatcttaaatatcttgcatcaagctatttattatctctaaattctagagttctcctcctctatattcttcctgcatcctttatcctgaagaaaagagatatatgcctggccctaggatttgggggtattgtctaacaatgtaaaaacatgtttttatgattctgaaattctattaaaggaggattcttgagcacctgctatgtgagagcatccaataactcaaacataagcactcatgaacccttgtacaaataaatacagaaaatttcttggaagcatcattttctaagatttaattcacaggagttgcgggatgtaagttggcagaccagaaaagatgagtgagaaaaaaagaacccaaatttagaagtacaatagaagaaagccaaaccactagaaatcacagtctggtagcagctgcagcatagtgcccagcatagcaccccaaaaatgtattccttaggcacagtcctgctgtatccttcctgcaggcggctcttgtgtttgtcggaccacacacaggaacatctccctaatcttggctaattagagcagaaattgcagtctgaatctgtgaaaaactagattgcagatttttgttaaggttacatagtttaattactttcagaaatacacagtaactcaattagggaaccaaaaagttttcagttctgtgtagggcctgctccaatgagagaaaaacacttttataatcattgtatagattcacacataaatggcactgttaaaattcagaatcctatactaattatttacactagaaaagagataatgagcatatttattgaatgccagctacttaccagctattatgatactaatgatcacaatatccctgaaatgttagaatttcctactgccaatatttttctaataataagaaatcaaattcttagtatgctatagcagaaaaagcacagattacatttctgatttctccatctcagaaaaggagggacggggtgctgggtatattaaaaacttagcatttaatatacccagtgtgaattagtgtttaacacttaatatacaccatagagagaagagataaggggaatctgagtacaaggcagcagcagggtaagatccaagtatgtcagatgaccatgagaaggattcacacagatacaggaggcagaacctactaaaactcctagagtcaaaagggaaccacagtctttcctggtggggtttccatagcctcaggaggggcagcagctgatagagtgctgatctggcctagatacgtctccatttgttttacaagacttgtctgggtctcaaaaaacagattttgtgtatctttaaatgaccatgagagcttgggcaagctgctaagattcttgggatctcaattttccattaataaaattaagaagacaaattagaactccagagtaggtaacataatttcatatagttgatcttaaagaatattagtaaattattgattacttagaaaataatcataaatgtgtgttaattataccacaataaaaataatcctaggcaaaattttggataaatatatacaacttcttgtgaaaacaagtattacataacagaaactcattttaaaagttagattgtgaaatctgaaaatatgtgtttaaaagcatatgaaaactttcactaatgttcaaataagataaactagccacacattaattttgcctcgtaataaatatccttcatgtttatctaagttataatgcaggctcataatagatggcacagtaatagttggtttcctgacatagttactggacatagttgcctcatttctcatctacattttatatgacttatattctatgtaaaacataattattctatattctacattatattataatcttgcaagaagaaccccaatatttactatttactaagcatgctttttacatttcttatcatttagtttatattctaaaaataaggagaagaaggaggagaagaaaaaggaggaggaagaagaggagagggaagaggaggaggaggaggagggagaggagaaggagaaaaaggaggagaaaaaggaggaggaaaaggaggagaaaaaggaggaggaggaaaagggggagaaaaaggagaaggggaagaggaggaagaagaggagagggaggagaaagacgaggagagaggagaaggaagaggagagggaggaggaggaagaagaggagacggaggaggaggaagaaagaggaggaagaaggggaggaagaagaggaggaagaagaggaggaagaggaagaaggtgaaggagaagaagagaaaggtggaggagggaggaggaggagaaggaggagggttaaactatttacacaggttattgtacagctatagtattcataaaataaactttctgtaaacacagtatggttaaggaatagaaaattctggttaattgaacacactggtcaaataacaaaatcaacgtatctatccactactaataaccccttcactaagaaaactactaagtatattcaaatcttggatgattttaaaatatactttagaattttgctgcactttcgagtttttaaatattatttgtagctattacagaaaaacaagcttttattccactattttatgattttgactagaaataatgctttttttggatacatctttggctaaagtctgtctaactgcccccaaaaacttagtctaggtcagtggttttcaatgttgggtgtgtgtgtgtgtgtgtgtgtgtgtgtgtgtgtgtttcagcacagaactctttgctccagtgaaatctaacacagtttgacaattgagctaagagagacgttttattaatttaaataaactcagttttaaaaatgtatttattacaaagccagtcataagaatgcagtagattctactctgatgaaccaaaaaaaaacaaaaatgtgaaatcaggagataaagagaaaagttacagtgtgacatcagtttccttaccaatttattcctatatttcattttagttgcacaatttcatgaagatgctacttcacaccattgagcattcatatacaattttataggatttcttaaaaagatcagtgcaatgccacaagcttctaattaacaacacatttagaaaaatttttaaatgtatgtgcaaagtggaagctttgcccagaaaaaaacacaaattaagctttgctggtttctaagtgtgacaacttttatgtaatatattctagtaggttttcttaaacagttttaaatcattgaaatatccatgtcaataaagttcaaatcaatattaggagaattcccacagaacttccaaaacatggtgtattataacaatatgcttatattcaatctggtctctttcaagtataatacttggactccacgtggttattttgtctccccagggtagagaagggaagaattttgaactgtgcaacaaatatttctataaaaaagatagtgacaatgacactcaacagagatcacaaactcaactgtgtatggaatcccagcagggaacatgaatccgttaaggggactgcaagaagtcggctctgaaccagagagttcatgacccacttctagggaactggtcagaactcagctctaacaagtgtctgtgctgtgaaaactcagcagtacgaaattgacttctcaaatagctcccaatagcattcatgcccttggataatcctctcctattgagtgtgggttgaacatagagatttacttccaatgggagagtaggaaccagcaaacatgacaagatggtatttccaagataagctcacaaaagacggccatttctatgcagctagcacactatctggctcttctcaattttgctttgataaggcaaactgccatgtgataagttgccctgtggggaggcccctgtgagaaagaactgaggaagacctttgatcaacatcctctaaggaacggaattcctccaacaaccacgggagtcagctgaaatagtcctcttccagcagactcttgtgatgacttcaaccctacaagataacttgagggcagttttgtgggagacttagagccagaggtccagttatgctacacctggattccttatgcacagaaatagagataataaatactgttgtttgaaacagtagatacctaatacagaatgtgaaccgattttctaaattttcaggagcagttggaaatccagattccagtgtgtgaaatctcctgtttctatttaagttgaaaaccaattcgtttaatagctcaatatgtcacacagaggaaaataacacatctgaaggttaaagggaattgcaaagctccaattttccattggtatgctaataagggaaatgccagagatgatgaccgaaagtgagcattcattgataaatctgtggaatgagaaagtcttctaaaatacaatgaaacaacaaactaatttttcttctaaagtataacatgccaacagagatggtatcttgaaaggtaagaagctctggtacaagtaggcacaaccaccagtaataaaattagagaaaaaaattataactaagtaattcaccagaaagagaccttgaaccactcaaagctctaatattaaatctgcctaatattttgctcatgtgtttctacagaatactaataagcaagcagcagaggaaaacctaagggattatttttccatttttaaatgtgaaagactatactgtggttaacatacatgagttgcaaaccgctaggaaaaagagaccaatttctaatacaaaaatgtactcctggatataagtcatactaaaacattttaagacaaaatatttctataa

SEQ ID NO: 874 - DNA, 4199 bp, Homo sapiens
ctttcagaaatacacagtaactcaattagggaaccaaaaagttttcagttctgtgtagggcctgctccaatgagagaaaaacacttttataatcattgtatagattcacacataaatggcactgttaaaattcagaatcctatactaattatttacactagaaaagagataatgagcatatttattgaatgccagctacttaccagctattatgatactaatgatcacaatatccctgaaatgttagaatttcctactgccaatatttttctaataataagaaatcaaattcttagtatgctatagcagaaaaagcacagattacatttctgatttctccatctcagaaaaggagggacggggtgctgggtatattaaaaacttagcatttaatatacccagtgtgaattagtgtttaacacttaatatacaccatagagagaagagataaggggaatctgagtacaaggcagcagcagggtaagatccaagtatgtcagatgaccatgagaaggattcacacagatacaggaggcagaacctactaaaactcctagagtcaaaagggaaccacagtctttcctggtggggtttccatagcctcaggaggggcagcagctgatagagtgctgatctggcctagatacgtctccatttgttttacaagacttgtctgggtctcaaaaaacagattttgtgtatctttaaatgaccatgagagcttgggcaagctgctaagattcttgggatctcaattttccattaataaaattaagaagacaaattagaactccagagtaggtaacataatttcatatagttgatcttaaagaatattagtaaattattgattacttagaaaataatcataaatgtgtgttaattataccacaataaaaataatcctaggcaaaattttggataaatatatacaacttcttgtgaaaacaagtattacataacagaaactcattttaaaagttagattgtgaaatctgaaaatatgtgtttaaaagcatatgaaaactttcactaatgttcaaataagataaactagccacacattaattttgcctcgtaataaatatccttcatgtttatctaagttataatgcaggctcataatagatggcacagtaatagttggtttcctgacatagttactggacatagttgcctcatttctcatctacattttatatgacttatattctatgtaaaacataattattctatattctacattatattataatcttgcaagaagaaccccaatatttactatttactaagcatgctttttacatttcttatcatttagtttatattctaaaaataaggagaagaaggaggagaagaaaaaggaggaggaagaagaggagagggaagaggaggaggaggaggagggagaggagaaggagaaaaaggaggagaaaaaggaggaggaaaaggaggagaaaaaggaggaggaggaaaagggggagaaaaaggagaaggggaagaggaggaagaagaggagagggaggagaaagacgaggagagaggagaaggaagaggagagggaggaggaggaagaagaggagacggaggaggaggaagaaagaggaggaagaaggggaggaagaagaggaggaagaagaggaggaagaggaagaaggtgaaggagaagaagagaaaggtggaggagggaggaggaggagaaggaggagggttaaactatttacacaggttattgtacagctatagtattcataaaataaactttctgtaaacacagtatggttaaggaatagaaaattctggttaattgaacacactggtcaaataacaaaatcaacgtatctatccactactaataaccccttcactaagaaaactactaagtatattcaaatcttggatgattttaaaatatactttagaattttgctgcactttcgagtttttaaatattatttgtagctattacagaaaaacaagcttttattccactattttatgattttgactagaaataatgctttttttggatacatctttggctaaagtctgtctaactgcccccaaaaacttagtctaggtcagtggttttcaatgttgggtgtgtgtgtgtgtgtgtgtgtgtgtgtgtgtgtgtttcagcacagaactctttgctccagtgaaatctaacacagtttgacaattgagctaagagagacgttttattaatttaaataaactcagttttaaaaatgtatttattacaaagccagtcataagaatgcagtagattctactctgatgaaccaaaaaaaaacaaaaatgtgaaatcaggagataaagagaaaagttacagtgtgacatcagtttccttaccaatttattcctatatttcattttagttgcacaatttcatgaagatgctacttcacaccattgagcattcatatacaattttataggatttcttaaaaagatcagtgcaatgccacaagcttctaattaacaacacatttagaaaaatttttaaatgtatgtgcaaagtggaagctttgcccagaaaaaaacacaaattaagctttgctggtttctaagtgtgacaacttttatgtaatatattctagtaggttttcttaaacagttttaaatcattgaaatatccatgtcaataaagttcaaatcaatattaggagaattcccacagaacttccaaaacatggtgtattataacaatatgcttatattcaatctggtctctttcaagtataatacttggactccacgtggttattttgtctccccagggtagagaagggaagaattttgaactgtgcaacaaatatttctataaaaaagatagtgacaatgacactcaacagagatcacaaactcaactgtgtatggaatcccagcagggaacatgaatccgttaaggggactgcaagaagtcggctctgaaccagagagttcatgacccacttctagggaactggtcagaactcagctctaacaagtgtctgtgctgtgaaaactcagcagtacgaaattgacttctcaaatagctcccaatagcattcatgcccttggataatcctctcctattgagtgtgggttgaacatagagatttacttccaatgggagagtaggaaccagcaaacatgacaagatggtatttccaagataagctcacaaaagacggccatttctatgcagctagcacactatctggctcttctcaattttgctttgataaggcaaactgccatgtgataagttgccctgtggggaggcccctgtgagaaagaactgaggaagacctttgatcaacatcctctaaggaacggaattcctccaacaaccacgggagtcagctgaaatagtcctcttccagcagactcttgtgatgacttcaaccctacaagataacttgagggcagttttgtgggagacttagagccagaggtccagttatgctacacctggattccttatgcacagaaatagagataataaatactgttgtttgaaacagtagatacctaatacagaatgtgaaccgattttctaaattttcaggagcagttggaaatccagattccagtgtgtgaaatctcctgtttctatttaagttgaaaaccaattcgtttaatagctcaatatgtcacacagaggaaaataacacatctgaaggttaaagggaattgcaaagctccaattttccattggtatgctaataagggaaatgccagagatgatgaccgaaagtgagcattcattgataaatctgtggaatgagaaagtcttctaaaatacaatgaaacaacaaactaatttttcttctaaagtataacatgccaacagagatggtatcttgaaaggtaagaagctctggtacaagtaggcacaaccaccagtaataaaattagagaaaaaaattataactaagtaattcaccagaaagagaccttgaaccactcaaagctctaatattaaatctgcctaatattttgctcatgtgtttctacagaatactaataagcaagcagcagaggaaaacctaagggattatttttccatttttaaatgtgaaagactatactgtggttaacatacatgagttgcaaaccgctaggaaaaagagaccaatttctaatacaaaaatgtactcctggatataagtcatactaaaacattttaagacaaaatatttctataa

SEQ ID NO: 875 - DNA, 6460 bp, Homo sapiens
taaagtgatctgttttagaatgaacactgtagaagacgcaaatggattagaaagccttttgggagacacctgagtgtacaggactgaagaaatgagaagaaaaccaaacatgtctggtctgagaaagtcaggactggattgacttctttttcttttattccttggtttaatttataacttcaagaaaacatactttccccaagtgctttcagatcatttaaacctttcagataactggactggtcacattctcatgactttttgtttgaataattcattgattcacagaatgtttgaaattttgcctagctttttttttttttttttaaaaaaccagcttttcaggtttaatctctagtaagggaaagaacatctctttgataaccagggggataaggaaggataagaagagcctttcccacatccttttcttcctactgcagacaccaccatgggctcatttgcctctgcagagaaaatctgcatggaggcagccaggttttctctgaggccagatctaggccttttccccttgtccagatctaggcgagatcaactgagagtttaacacctttaaatgtctgaatggaatatttaccacctattatctctgagggctgctacctgtgaggtttcatctgtataacaagacctcctttggtagccaggcctcttcttttccccctctcataatctgttttggcaccacgatctcttcagccaagcgccaagcccccattatttctgtaagctcaagatggtataaaagtggccgggcacagtggctcacacctgtaatcccagcactttgagaggccaaggcaggcagatcacctgaggtcaggagttcgagaccagcctggccaacatggtgaaaccctgtctctactaaagatacaaaaattagctgggtgtggtggcgagtgcctgtaatcccagctactcaggaggctgaggcaggagaatcacttgaacccgggaaatagaggctgtgttgagctgagatcgcaccattgcattccagcctgggcaacaaagggagacttggtctcaaaaaataataataataaaataaaaaaataaataaaagcatcaaccacctgattatttctctgagtttttaaattttgtaatattcctgtgcacacttatacatttgtatgcctttttctcttactaatctgctgtcagttgatttttttagtgaactaccagaggtcgaaggtgaggttttcccctcacatacaatggtatctatctgttagataaaaatcagaggaggccattgttttgggctaagttcctacactaggccccagctgaccaaattaaaaataaaaatggaagaggtgtggtggctcatgcctgtaatcccagcactttgggagggttaggtgggacgattgctggagcacaggagtttaagaccagtctgggcaacatagcaagaccccatctcttcaaaaaaaaaaaaacaacaacaacaactaaaaataaaaacagagtaattcatgctaaagttgcacatcacccaacctaaattaatttatctgagctttcataaaatcagtacagataacaatttcccaaatgggccagtttaaaacttcagttgcgtaacaatgaagctccctctgcctaacccttacatggaaaaggttgtttagagtgacctgatgtaagctaattagttctttttctattgttctgtttctctctcctgccttataagaaaagtagctttgaaacaacaaatacactctctgttttttgcttctgcttttttcagcccttctctgtctttaaagcaaatctcttccactcaggtcatctgaacacttactctattttatggaatgaaatgttgcctgattctaggatcacaataaagccattagccagccttggtggcgtacaccggtagccccagctactgggggagctgaggcaggagaataaataaataaataaaacacaagccagttgagatctttaaaagtaaattggttgtaatgttgtcctttgacacacctttaagtcttgtccctaataagggtacatctataaatttaaggctctgtaaatctggaatgagaaaacatttcacatttccaggacaaaatcacataacttgtaagtaattttgactaagtctttttttttttttttttttttttttttgagatggagtctcactctgtcatccaggctggagtgtagtggtacgatctcagctcactgcaacctctgcctcctgggttcaagcaattcttctgccgcagcctccaaagaagctgggattacaggcatgcgccaccacgcctggctaatttttgtatttttaatagagacagggttttgcatgttgtccaggctggtcttgaactcctgacctcaagtgatctgcccacctcagcctccaaagtgctgggattacaggcatgagccactgtgactggcctaagctttatgagggttattattattattatgttttcagacaaggtctcactctgttgcacaggctggagtgcagtggtgtgatctcagcttactgaggcctccacatctgaggttcaaacaatcttcccgcttcagcctcctgagtagctgggagtactggcatgcatcaccacgtccggctaatttttttgtatttttagtagagatgtggttttgccacgttgcccagctagtcttgaactcctgagcttgagcaatcagcccgctgcaaactcccaaatgctgagattaatgcccagctgaggattatctttcaagctgttttttttttgttttgttttgttttcatataatcttgctccttctaaatctttcaagaggttgacttaatcactacaaggccactattattttagtagaattatttggtagaagtgttatcttagtaggaggtcttcttgttttctacagagcactattttattttatttacttttagagacaagttcgcactctgtgctcaggctggagtgtagtggtgagattatagctcactgtaacctcaacctccggagcccaagtgatcctcttgccttagcctaggagttgctggaactacaggtgtgcaccaccatgcccagctaatttttaaaatttttgtagagacagagtattgctatgttgcccaggctggtctagaactcctgacctcaagcaattctccagccttggccccccagagtgctgggattacaggtgtgagcccttgcgcccagcctgtacagtatgttttgttatggaactggaattatctcccatagagaagttgtcacttacagagagagtccaagggagcacgtgtatagaagctggcacttggagaggatagatgcccctttatcaactaagatggaccctaagtttatggaaacaaagttacctattgctcaagggcacggggcctggctggcatggcaaatttctaaattcctacagctctaaactccctaacaacaggagctttcagatccctcctaactctgatttacaattgagaccactacagttctgattggacgaagaacaggccttacaaatattttctgataagctactgcagaccttaagccagtttcagccagtgtctagaggccatgcacaaatagtctttgtgtcctatagttcttttgatataaagagtcaaaccccacctcattttaaagctaaagccctggcccaaagtgaacatgggatgtacgttacatatgtttccccatcgtgcttgtgctcagcctccctcataaatatgtacagcgtcccccacctcacccccagcaaacctgctgaatacgtatgactctgttgtgtgacatggaccctgtgaggcataaaacgcaagatgtccttcccttctttgaagagagagcaactttgtccatgctggagacatccccttcctagttttcaaactggcattgccaataaacctctcctttttactatttagtcatcctggtggtcttttagatggcagtaaggagcatagcattacattgaaatgaacaatttatagttagcaaaatgcattattaagaaaagattgtcaaggtattctgacctgaaatgccaaaagaaaaaaaagagaaaaagtctaagtcaggatgagtgggagtgagagtggtgcattggtggagttacagtctaattactgtcagcccttagcatcagtgcgttccacatccatgggtctaaccaacctcagacagaaaatactttaaaaacaaaacaaaaatactaatacaacaataaagataatacaaataaacaatacagtataacaactatttatatagcatttacatgatatcaggtataaataatctagagatgattgaaagtatataggaggatgttcttaggttatatgcaaatactaggccattttatatcagggaactgagcattcttggattttggttttgaggggatcctggaaccgatcctccacagatattgagggacaactgtactgtatgagaaagcgtgaccttcacacctaaacacctaaacatctttctcccagtttttgcatcccacaacagccttatgagaaaaaaagtaacttccctaaagtgaaatgggtagtagggtagaacttaaaatccccccttgggccttggagaacacatagatcttgaatgaggtgtgaaaaaatattagctatgacaatgggttgtggcccttcaaggggccacaggagataagtggttatgatagtacatctgttgtattaaaatttcaggggaaggagggtggttggggaagaagtctaaaagcgctctttcaagggtgcaataatactaaaaatggttgaaaaacactgccaatcacatttcttgggcagcgctttttcatccatggacacataatttcaaacatctatatgaaaggataaccccgcaaggcattgaccttgcctgctgcctagatggagccgattcatcaagacaggggaattgcaatagagaaggagtaattcacgcggcgctggctgtgtgggagaccagagttttattattacacaaatcagtctcccagactgattcggggagcagagtttttaagaacaacttggtgggtggggggaagccagtgagccgggagtgctgattagtcagggatgaaatcgcagggagtcagagctgtcttctggcattgagtcagttcctgggtgggggccacaagatcagatgagccagtttatccatctgggtggtgccagctgatccattaagtgcagagtctgcaaaatatctcaagcactgatcttatgagcagtttagggagggtcagaatcttgttgcctccaggtgtgtgactcctaaaccataagttcttttctttctttcttttttttttttttttaggagttttcacacttgttgtgcaggctggagggcagtggtgttatcttggctcactgcaacctctgcctcccgggttcaagcgattctcctgcctcagccttcccagtaactgggattacaggtccatgggaccacgcctggaaatctttttttttgtatttttagtagagacagggtttcaccatgttggctaggctcgtctagaactcctgacctcaggtcatccacctgccttggtctcccaaagtgctgggattacagtcatgagccattgcgcctggtcataaaccataatttctaatcttgtatctaatcttagtcctacaaagacaatctagtccctgggcaagaaggaggtctgctttgggaaaggactgttatcgtctttgttttaaactataaactgtaaactaagtttctcccaaagttagttcagcctacccccaggaacgaacaaggacagcttggaggttagaagcaaggtggaattgattaagttagatctcttttactgtctcagtcataaatttgcaaaggtggtttcaaaatcacaaacctcctggtgcacatttagctactagcattcgaagttcttgacagggctccctctggagtgttggaaacatagttctcccacagacagatagtaaccaggcatcaaggtttgatttaattctttaatgagggaaccagcagggaaacaaaagcactgattcagagagcattggaaggagagggatttgtgtagtccgtgggaaataggtgttccatccgattgtcaggttagatgtacgactttaacttgctaaggtgcagggaagccaccatggctttgaggtttgcttttccaccatgtcacaaagtcaaaacaatgtgtcagtttctgcaggttaacttctaaccttacagggctaaaaactactactggcaattttctcctgaattgttagtgacagcctttgggggagccctatgaggatagggggggcttctcgggagtgctccagcacaccacagaacaaggggagatcaccactctaacttcctcaagcctggtgcacaggaattct

SEQ ID NO: 876 - DNA, 3651 bp, Homo sapiens
catataatcttgctccttctaaatctttcaagaggttgacttaatcactacaaggccactattattttagtagaattatttggtagaagtgttatcttagtaggaggtcttcttgttttctacagagcactattttattttatttacttttagagacaagttcgcactctgtgctcaggctggagtgtagtggtgagattatagctcactgtaacctcaacctccggagcccaagtgatcctcttgccttagcctaggagttgctggaactacaggtgtgcaccaccatgcccagctaatttttaaaatttttgtagagacagagtattgctatgttgcccaggctggtctagaactcctgacctcaagcaattctccagccttggccccccagagtgctgggattacaggtgtgagcccttgcgcccagcctgtacagtatgttttgttatggaactggaattatctcccatagagaagttgtcacttacagagagagtccaagggagcacgtgtatagaagctggcacttggagaggatagatgcccctttatcaactaagatggaccctaagtttatggaaacaaagttacctattgctcaagggcacggggcctggctggcatggcaaatttctaaattcctacagctctaaactccctaacaacaggagctttcagatccctcctaactctgatttacaattgagaccactacagttctgattggacgaagaacaggccttacaaatattttctgataagctactgcagaccttaagccagtttcagccagtgtctagaggccatgcacaaatagtctttgtgtcctatagttcttttgatataaagagtcaaaccccacctcattttaaagctaaagccctggcccaaagtgaacatgggatgtacgttacatatgtttccccatcgtgcttgtgctcagcctccctcataaatatgtacagcgtcccccacctcacccccagcaaacctgctgaatacgtatgactctgttgtgtgacatggaccctgtgaggcataaaacgcaagatgtccttcccttctttgaagagagagcaactttgtccatgctggagacatccccttcctagttttcaaactggcattgccaataaacctctcctttttactatttagtcatcctggtggtcttttagatggcagtaaggagcatagcattacattgaaatgaacaatttatagttagcaaaatgcattattaagaaaagattgtcaaggtattctgacctgaaatgccaaaagaaaaaaaagagaaaaagtctaagtcaggatgagtgggagtgagagtggtgcattggtggagttacagtctaattactgtcagcccttagcatcagtgcgttccacatccatgggtctaaccaacctcagacagaaaatactttaaaaacaaaacaaaaatactaatacaacaataaagataatacaaataaacaatacagtataacaactatttatatagcatttacatgatatcaggtataaataatctagagatgattgaaagtatataggaggatgttcttaggttatatgcaaatactaggccattttatatcagggaactgagcattcttggattttggttttgaggggatcctggaaccgatcctccacagatattgagggacaactgtactgtatgagaaagcgtgaccttcacacctaaacacctaaacatctttctcccagtttttgcatcccacaacagccttatgagaaaaaaagtaacttccctaaagtgaaatgggtagtagggtagaacttaaaatccccccttgggccttggagaacacatagatcttgaatgaggtgtgaaaaaatattagctatgacaatgggttgtggcccttcaaggggccacaggagataagtggttatgatagtacatctgttgtattaaaatttcaggggaaggagggtggttggggaagaagtctaaaagcgctctttcaagggtgcaataatactaaaaatggttgaaaaacactgccaatcacatttcttgggcagcgctttttcatccatggacacataatttcaaacatctatatgaaaggataaccccgcaaggcattgaccttgcctgctgcctagatggagccgattcatcaagacaggggaattgcaatagagaaggagtaattcacgcggcgctggctgtgtgggagaccagagttttattattacacaaatcagtctcccagactgattcggggagcagagtttttaagaacaacttggtgggtggggggaagccagtgagccgggagtgctgattagtcagggatgaaatcgcagggagtcagagctgtcttctggcattgagtcagttcctgggtgggggccacaagatcagatgagccagtttatccatctgggtggtgccagctgatccattaagtgcagagtctgcaaaatatctcaagcactgatcttatgagcagtttagggagggtcagaatcttgttgcctccaggtgtgtgactcctaaaccataagttcttttctttctttcttttttttttttttttaggagttttcacacttgttgtgcaggctggagggcagtggtgttatcttggctcactgcaacctctgcctcccgggttcaagcgattctcctgcctcagccttcccagtaactgggattacaggtccatgggaccacgcctggaaatctttttttttgtatttttagtagagacagggtttcaccatgttggctaggctcgtctagaactcctgacctcaggtcatccacctgccttggtctcccaaagtgctgggattacagtcatgagccattgcgcctggtcataaaccataatttctaatcttgtatctaatcttagtcctacaaagacaatctagtccctgggcaagaaggaggtctgctttgggaaaggactgttatcgtctttgttttaaactataaactgtaaactaagtttctcccaaagttagttcagcctacccccaggaacgaacaaggacagcttggaggttagaagcaaggtggaattgattaagttagatctcttttactgtctcagtcataaatttgcaaaggtggtttcaaaatcacaaacctcctggtgcacatttagctactagcattcgaagttcttgacagggctccctctggagtgttggaaacatagttctcccacagacagatagtaaccaggcatcaaggtttgatttaattctttaatgagggaaccagcagggaaacaaaagcactgattcagagagcattggaaggagagggatttgtgtagtccgtgggaaataggtgttccatccgattgtcaggttagatgtacgactttaacttgctaaggtgcagggaagccaccatggctttgaggtttgcttttccaccatgtcacaaagtcaaaacaatgtgtcagtttctgcaggttaacttctaaccttacagggctaaaaactactactggcaattttctcctgaattgttagtgacagcctttgggggagccctatgaggatagggggggcttctcgggagtgctccagcacaccacagaacaaggggagatcaccactctaacttcctcaagcctggtgcacaggaattct

SEQ ID NO: 877 - DNA, 3470 bp, Homo sapiens
ctcagtctcttatcaaaccccccatatcactgtggaatcagaacttcatttcaataagagtgggcagaatggggacaaggacacagcagatgctggccactgagaaggacaaagagtgggacgacctttcacccaggtgccagcctcccaggtgctcaggtgcgagagggctcaggtgaggaagtgtgaatagctcagtgcaaatcaatgcctctggtttaagaaaatcaaaagatgttcattcattcattcaacaaatatttacccagtgcttcctagatgctagttgctggctgccctaggaactacagatctagtggtgaatgagccaggcacattcctggcctcccacagcttttaccacgtgtgtttagatacacacagacaccatctgcccgtggtacttggggttgatctcgatattaaaagatgcaaatatgtactatgaaaagaccagtttgcaatcggcaaagggatgagatccacaagttgtttgctaaatatggtttggacaaggagggtgaagtacacactaatttcttggatggataatttttctgatgaagtggctaagttgtgtttgtttgtttgtttgttttgagactaagtctcactcttgaccccaggctggagtgcaatggcgcgatctcggctcactgcaacctccgcctcccgggttcaagcgattctcttgcctcagcctcctgagtagctgggattacaggtacctgccaccaagcccggctaatttttgtatttttagtagagacgggtttcaccatgttggccaggctggtctcgaactcctgacctcaggtgatctgcccatcttggcctcccaaagtgctgggattaccggcgtgagccactgcgcccagtaaatatttacaatgtttttcacgaactaagcatgctacataacataatttcacgcaatcttctctttgtaggagttaggcacaaccaccatcccctatttgataggtgtgggaactgggtctcagggaagttatgcagcttctcaaggtcccatccctagtaaaggcaggctctgggttcaggtgctggacgctctggcctgccataaccactgggcactaccgcctccctggatgctcttgtgcgaggcccctcgtaaggtgtgctggctcttcaggtgccccgtgcccggcactctgtgaggatgcacaggatacctctcactgcgtcttcatggcaagcccgggacgtaggtgtaactgtcacccccatcttatggatgaggcagcttgccccgatatcggctggtgagtgacccagaagaactcgcgactcacagctgctggactctaacatccagggtgggagccactgggctgtgttgctgtttcccaaatgcaggaagtctcttaagtgcttcatttactctgttttttttttttcttgagacagatttgttcatcgataatttttattttttaaatcgatatgaaaatcctcttgcaggggtggactggagctgagggcacttgaaggggtgagtgggaaagcccacagccaggagccaccagaaccggcgcagagaacagacgctgctgcaggaggccatggggctggtgttggggtgggcgtgcacttgccatccttttatttcttccccaacctccttcctctgtcttccttacctcgagatactgacagcacactcctagagatactgacagcacactcttggagatactgacagcacacttatattgagtttctgccatgtgtacgcatcttggggaggcctgggaggccctgatgcatcaggcttcttggcctctctgtgcccacccctgaaccagcctctcttccttcacctcttctcatgggctctgtcatgcaggctggagtgcaatggtgcgatctcggctcactgcaacctccgcctcctgggttcaagcgattctcctgcctcagcctcccgagtagctgggattacaggcatgtgccaccacacccggctaatttttgtacttttagtagagatggggtttcaccatgttggccaggctggtgtccaaatcctgacctcaagtgagccacccgccttggcctctcaaactgctgggattacaggtgtgagccaccgcgcccggctcctcttcatttcttctacacatctttctgtccggcatcggggcagcagtggccaacagaagacatacctctgtggccttcccagcacaattccaaggacttccctgaatattccaactctgggacatcccctctgagctttcattccaggaaaaccacgctttcttctcaaatttctaaataggattggaagctcttacttgtggactagcaaagataagggttcagattctagcgcttcaaaggactccatccggtgaatcccaccagggcgcgagctcccccatgagagcaacttcagagagaagctcccttaggctccctcccctcccaaatctgcacctaacgtcaggctgcatccagagataccaatggaaattaggtacaaattgtaccctggacttgactttgcaatcggaagaaacctcgatttgtgggggtaaaggtcaccgcctggaaggcctaacccagaggccagccctgtggcttggccaggccaagagaagcctcccctaactgcctatggaaaagaacccagggttaaactgtttatctgggttatgctcccaggttaaacttcttaagtgaaccgacccaaggaggtgaaacctgaatttctagataaagcttttccacgtctttggccaggtacacagaactgcaatttaaaacttctgggttttatgccgggtgccgtggctcacgcctgtaatcccagcactttgagaggccaaggcaggccgatcatttgaggtcaggagttcaagaccagcccggccaacatggtgaaaccccatgtctactaaaaatacaaaaattagccgggcgtggtggtgcacgcctgtaatcccagctactcaggaggctgaggcaggagaatcgcttgaacccgggaggcagaggttgcagtgagccgagatcatgtcactgccctccagccaggatgacagagtgagactccaaaaaaaaaaaaaaaaaacaaaaaaaaccaacttctgggttttgctagttgtctgcgaattaagtctatgattccagctgagaagcctgcaacatcctggtggttgcagtgagccgagatcatgccactgcactctagccacgatgacagagtgagactccaaaaaaaaaaaaaacaacttctgggttttgttagttgtctgtgaattaagtctatgattccagccgagaagcctgtgacatcctggtggcatctcccccaagggccatcaacttgtgataatcctggtccttgtgtgacggctgacgagcacaaatgctctcaaagaagtactgtgcagccactgacggtgaggctggggacagtgtttgtgaacacgggttca

SEQ ID NO: 878 - DNA, 149890 bp, Homo sapiens
tatgttttgtagagtgcataaagttatctatcactacagatgagatcctgatgcttgcccagcttcaggtacaacctccccatgaatctaaggcagcgggctcagtgaatagacatctcctacctgggcccatagagaggtccacagtttttgttcttcctctccatctggagatcagtggagtatcttgctgtttttgagaataaccaactggtgccccagtggtcatatgtaaattagatgtcactgtcctcattctggctgcagggaccaagagcaattggaaaagattctcaaaggaaataagagcttggcctgtaatcccagcactttgggaggccgaggcggctggatcacgaggtcaggagatcaagaccatcttggctaacacagtgaaaccccgtctctactaaaaaaaaaaaatatatatatatatatatatataaaattagccaggcatggtggcgggcgcctgtagtcccagctactcgggagaggctgaggcaggagaatggcatgaacctgggaggtggagcttgcagtgagccgagatcgcgccactgcactccagcctgggagacagagtgagactctgtctcaaaaaaaaaaaaaaaaaaaagaaatatgagcttgataggaaaaactggagtttaccgtttggacatcactaaaatacaaaagtgatggctatgaaacttgacctcagccctctcatgccagggaaggaatgaccaggctggtaggtctgtagcttgttcgatgctcctgagctgttgataaaaaataaaaattaaaaataggctgggcgcggtggctcacacctgtaatcccagcactttgggaggctgaggcgggcggatcatctgaggtcaggagttcaagaccagcctggccaacatggcaaaaccccatctctactaaaaacacaaaaattagcctggcatgtgcctataaccccaggtactcaggaggctgaggcaggagaattgcttgaatctgggaggcagaggttgcagtgagccgagatggtgccactgccctccagcctgggtgacagagcaagactgtgtctcaaaataataataataataataataataataataatgatgaaattgttttgctaaagggcaaactttgttgttaggtcctagagcctgggccctggcccttctgcccttcttggtatctggagctgacccttggaacctctgtgcgtggatacaagtgtaaaattggtccagtgcacagtgcagggctttgtctgtcttatcacctgctataggcccagaagaatgggtgcttcgggcagaatgggtttgtttaatatttgtggaatgcatgaacctaagaactgaaaaattcattaactcaactttttttctactttacttgatggagacagctttaataatgaccttggtctcctccggttagaagtggacaagggaccctttattattattattattattattattattttatttttatttatttatttttctttttggagatggagtctcactgtgtccccaggctggagtgcggtggcgcaatcttggctcactgcaacctctgcctcccaggtgcaagcgattctcctgcctcagcctcctgagtagtgggaattacaggcatccaccaccatgccgggctaatttgttgtatttttagtagagacatgggtctcactatgttggctaggctagtctccaactcctgacctcaagtgatctgcccacctcagcctcctaaagtggtgggctcacaggcgtgagccacctcacccagccaagggaccctttttaaatgctcaaggctctggccacagaatcctcagtctccccacctgtagaatgggtatcacagaagggacaagtccaggggaggaagaagccttggccctggaggcaggagacgttgattccttcctgctcggggcctctgtttctccctctgtgggaggaatgagttggggggatcttgttggttgcctttctacaacctcagtgtttgtttgtttgtttgttttcccaaccaagtcctcttttggttgagatattcactcgtccggcacatggctaaggctccagggcagactgagcgtttcctaattagtctaagatgatcagcacagggcaccccctggtgaaggctgtggacccaggcctgggcttggaactgagacagaagtgaagcgctcacagcccaggtttgggagagtggtccccatgtgcccctcgcgctcacagcccaggtttgggagagtggtccccacgtgcccctcgcgctcacagcccaggtttgggagagtggtccccacgtgcccctcgcgctcacagcccaggtttgggagagtggtccccacgtgcccctcgcgctcacagcccaggtttgggagagtggtccccacgtgcccctcgcgctcacagcccaggtttgggagagtggtccccacgtgcccctcgcgctcacagcccaggtttgggagagtggtccccatgtgcccctcgcttcccttccctccctctttttcggtgaggagaacaatggctttcctgaaagttctcattggccagaactttgttccatggtcatcctagttgcaggaaaatcagtagttttaggtggttaccttagtagcctgaacaaactgtgcgttcgatggcatggaggaagggaatcctcaaaggaaggcatccatccgtgtctgcctcaccagtaaagaacatttaggggctgggcatggtgactcatgcctgtaatcccagtactttgggaggctgaggcaggaggatcacttgagcccaggacttcaagaccagtctgggcaatgtagacagaaccccgtctctaccaaaaataaaattacctgggcacggtgctctgcatggctgtggttccagctacttgggaggctgaggtgggaggatcacttgagcctgggaggtcaaggctgcagggagctatgattgtgtcactgcactccaggctgggactggaccatgtaccaagaaaaaagaaaaaaaaagaaagaacacttaggttctgtctcttcttcctctatcattctgttatgaagtgtggcagtaaacatccttgaacgtgtctacttgtgcacgtatgagttcaagggtaggagctgagaagtgtcattgtcccatgttgaatgggtggagtacgttatgtgcatttcacattttagtagatgctgtcacggtgccctacaaggtgactgaaccaactcatatttctcctgcagtgggacagaatctgtctccccactttcatcagtcagtgctgtctctctagggctggatggtgcggctaccttgttcacgaaacgtgggggagtcagtgacaggcaggacagcacagtggggtcacgtgctctaggtcggccgccagctgcctgtgtgagctgaggaaacccctgccctctctgagccacagttttctcgtctggacaatggagatcataagttttgtactttgccaggctcttgtgtggatgaaatgagcccgtgtgtgccaagacctcatcatggggctggcccaggaccgatgcacagcacgtggactcccgcctatttgctgtctgcagagccctcagatgccttcttttccagatcaggccaaggagcggtgaggactaagctctgatttttttaatcttgcccaaattcctttctaaggggtctgggaagtcatgccctacaaaccataaattctcatcagataggttttatttaacgctgtatatcgtgacttactttccaatctgactctggcataacaagggaaaaagtcaacatcttttactccaaaatatatttccttgccatgaaattccttccttgaaatgccttggaatcgccctgcaaagtctcttgtgggaaaaatccacattctatagagaatccccttcccctttgttttccttccttcctttccagatccaggagaaaatcagctaagagccaggcacccttttaagtccgataagaaacattttacaacctgctctctctgaagtctgctgtctgagagcttcctctgcacaataaaacttgatctccacaatcttttatcttaacctcaacatttcctttctattaatcccaggtcttcagataaactcaaccaatggttgacgagaaaatgtttaaatttacctatagcctggaggccccccaccctttgagttgtcacgcctttctgaaccaaaccaatgtatttcttaaatgtatttgattgatgtctcatgtctcccgaaaatatataaaaccaagctttatcccaaccacctggagcacatgttctcaggacctcctgaggtttgtgtcacgggccatggttactcatatttggctcagaatgaatctcttggctgggtgcagtggctcacacttgtaatcccagcactttgggaggctgaggtgggcggatcatgaggttaggagattgagaccatactggccaacatggtgaaaataaaaatacaaaaattagctgggcgtggtggcgggcgcctgtggtcccagctatgcgggaggctgaggcatgagaatcacttgaacctgggaggcagaggttgcagtgaactgagatcgcaccactgcactccagcctggcgacagagagagactccattttaaaacaaacaaacaaacaaacaaacaaaaaactcttaaaatattttacagagtttgactcttttgtcaacagggagtagcacagttcctccccttttaacttctgtcaaccacaatgattaacatggcaatcagaccagagctttcaccacgggatcactgcctgaagaaacaaggctaaatggaagcaagcatatggattaaaactgaaaatgggccgggcatggtggctcatgccgataatcccagcactttgggaggctgaggcgagaggttcacttgagcccaggagttaccagcctgggcaacacggcaaaaccctgtttcttcaaaaactacagaaagtagccaagcatgatggcgcatgcctgtagtcccagctacttgggaggctgaggtgggaggatggattgaactggggaggtcgagagaggaagcagtaagccgagatcacaccactgcactgcagcctgggtgacagagcaagaccctgtctcaaagaaaaaaaaaaaactgaaaatggggcacttctatacatatgtattttttttagtttttttttttttttgagatggagtctcgctctgtcgaccaggctgcagtgcagtggcgcgatctcagctcactgcaacctccgcctcccgggttcaagcgattctcctgcctctgcctcccaagtagctgggactacaggtatctgccaccatgcctggctaattttttgtatttttagtagagatggggtttcaccatgttggccaagctggtctcgaactcatgacctcaggtgattcacccaacttggcctcccaaagtgctggaattacaggcgttagccaccatgcccagccacttctatacatattgaaattaaaagttgactacattacactacatggttgaataacaaggcaagttatctgtgagagttgaaatcaggatctcaaagagacttctgcacgccgatgtctcttgcagcattattcacaagagccagaatatggaaacaacctaaatgtccatttatcaatgagcagatgaagaaattgcagtctatgcatacaatgaattgttagcctgaaaaaaggaaggaaatcctgccatatgctacaatatggatgaacctggaggacattatgctaaatgaaataagtcagacaaaggaggacaaatacagcatgattccacatataggaggtttctaaaaatagtcaaactcacagaagcagagagaagaatggtggttgccaggacctgggagtggggtggggaggaggagctggaggggagctgttcaaggagtataaagtttcaagttgtgcaaatgaatagttttaggggtttgctgtgcaacattgtgcttctgggtagcaatacgggatcgtacacttaatttgttaagggtatatatcttatgttaagtgttctgtattaggcctttcttgcgctgctataaagaaatatctgaggccaggtgcggtggctcatgcctgtaatcccagcactttgggaggccgaggcaggcggatcacctgaggtcaggagttcaagagcagcctggccaacatggtgaaaccccgtctctactaaaaatacaaaaattagctgggtgtggtggcggacgcctgtagtcccagctactcgggaggctgaggcaggagaattgattgaacccaggaggcggaggttgcagtgagccgagatcaagccactgcactccagcctgagcgacagagtgagtctccatcttgaaaaagaaaaaaaaagtgcatttaaaatgatacttttaaatgaccagatctagaaagaactcactcagtatcatgaggacagtaccaaggagatggtactaaacccttcatgagaaatactgcccccaccatgatccagtcacctcccaccaggccccaccaccaacactggggattacaattgaatatgagatttgggtgtggacacagatccaaaccatagcatgttcttacctcttataaagtaaattacagaggcgtctacacaatccactcccatcagtgtttatgggattgtattgaacatccgtcctcccatccacagcaactgacacacaaaacttttgactgtgatcatctctagtgagtgacacttaagggtttattggagtggggatgcgatgtttccttcctaggtgaggtgcatatgctgtcttgtttggatttttgtgtaagaaaagtttttctttctgagatgaagtctcgctctgtcagccaggctggagtgcagtggtgtgatctcggctcactgcaacctctgcctcctgggttccagcgattctcctgcctcagcttcccgagtagctgggattacaggtgcccgccaccatgcctggctgatttctgtatttttggtagagacggggtttcgccatgttggccaggctggtctcaaactcctcaggtgatccacctgccttggcctcccaaagtgctcgaattagaggcgtgagcccccatgcctggccaggaatatattttaacattaaaaaagtattataataatatagttatgtttctattttttaaatggaagcatattccatagtccagtcatatgtcatgttttctttttgtcacaggatccttggggtgttacttcaccagtcgaaaacctctatggctggcggcatcttctgcctgagtgttgcttgcgcccactgggcttgttctgcctactctgcttgcactaccagcctgccaagggcaagccaggtgcagagcagcgagggatgtgtgagcgagcaagtgtggcgtctggccactgcacatagccaagcatgctggctgtggtggggtgagcagctccaggggcctgtgccggctccgtgtgaggctgcggtgggaccaggtgtaccacacgcagcttctgctgtgggcacccgcgtctggatgaggggaatgtggtggctccaggaagcttggagactccaggaaccacagagccccagagaaggtgtcatagccttggcttggggagccccttggtcagggctccctgaggggccgcagctcttctctccttcttgttgcctgcaatgtgatgagtggggggctgcggggtgggggggacatgtttcagccctgtttgtgttacagctctttcagtcccgccattcggcaggtcctgagttcttgtcctgcatccaggaagaatgaggtacagggacaacgggagggtgagcaaggtggagagaagtttcattgagcgacaggacagctctcaggagacccgaagtgggtacctcctttctgcaggcaggtcgtcccaactcaggagacctgaactgggtagctccttcccacagctggtcatcccaatgtcttggtgagtgtgactgagtcccaggttttatgggcttgggcttcagaagggaagaagtagatgctgactgatccatgggcagccatgggtgggtctggaaaaagcaccctaagttctcactccaggccatggactctaccagaactgagcctggcccaccacgcttcaggccgtccctggcttgaaggtggggcctcaccagggacctgcccctttccacccaggagcctgtctgcctcttgctgccattgatcatgtgctccatggcacccaggctcttcccgctgaggggtgcctacaggccagtgcccagctgccctcagctcccctccaacctccctctctgtgtttctaggcaaagtccgaagcagcagggggttggagtgtcattgtgcccagagcacacacccggccctgggtcgtgacagcgcccaggcttggcctcaactttgccagcttccgagcctgcggtggtggtgatgtggcttcccaggccccaggcagggatgcctggtccgcggcagttgcctccgtggaaggaggcagggctcccactgctccttggagcccacagcctcagccacacctcccccaccgccgccaatgtcttcgaagctgcagctccagatgggccaccgcggccatcattttcatgcctctgaaccctcaagtgtgccttaaaactcagctcccaagtgacctgcaactccttaggggggctcccgtgagtcctgatctcattttaaattccctctcacctctcacctgctttcctgggtgagtcctaacctctctctacgttagtcctaattgtaccactgtgttcttaaaactcatctgacccatctctaggttagtcctaactgtaccactgtactcttaaaactcatctgacccccaggctaaagaggtgagcatgttgggagaatagaggaatgtttaatggaacccaagggcagggatggatctcaggaatgatcagaaatcagatgttctgtctgctctgtgaactgtaagcctctggggtttgtttttttgtttgttttgttttgttttgagatggagtctcgctctgtcacccaggctggagttggagtgcagaggcgggatctcggctcactgcaagctccgcatcccgggttcacgccattctcccacttcagcctcctgagtagctgggactaaagcatttattatcactgaataaatgatgtaatcactaaggatttacatccaaatggcgtttcatttgagatcccttccagggaccaggaatgccaggcagaaggggagagccacagagggaagtgaccagagccaggcctgtgctggccagctttgaggtccgctgtctcctccagcctgggggctggtccaaggggcagagcttcatcacccagcatggggcatttacaacctggatgtgcagactgtaacgggggcctcctgaggctggatggaggcttcctggtcaggggcacattgtcagagaaagttcagggtacacaccctcttccccccaggggtctttgggaagaactgagccctgggcaggggaggcccctgatggaatttcaggaggtggtatccagtggctgagcagggcagggaggcagtgtggagactgagccgccaggcacagggaagatgcaggaggcaggacctctggagaaggcccctcagagagggcctgggctggcctggcgttcagcctgcctgcaaccagggcagaagcaaaggaggtgggcccaggaagcttggctcagctcatgggagctgctggctggcctggtccttggctaccatggttggtgcgagggttagatctttgctggaagggctctaggctaccctagattagaaggggctttagccatcaggcccagactcccaagcttcccacagccccagaggctagaacccaggctggcctgggctgctgaggccaggtaggcagagcacaggtgttgcccagagcactgggttcaggtctagccttggatccaggtgacctcaggcatggcacttaccctctgtggtctcagtgtcctcgtgtcgctgggggaacccccaagcacctacctaatgaagaccatttggaaggtcaaaggaaataatgggagaagaggatcgattgctccatcagcctaagatgtcactgtcgctctggcgtctgctcctgggccctgtgtgctctgcagaccctagagagaccatttcttttcacttcgtgggacctgaagaagcaagtctaaagaaacagctacatctgtcaagaactgtgctatatccatcaaacactgcattacatctctctagaggcagacagctacgcctgttatctggagccgcaagttggctatttaaatttgtgaaaattaaatacaatgttgaaaccatcccctcggttgcactcgtcactttcaagtgcccaatagccacccatggctagtggctgccacattggacaggcagatggagatcatgctcttcattaccgagagctgtgctggatggcgccgcccaagagatgggtgtttcttggtttttttgttttgttttgttttttgagatggagtctcgctctgccacccaggctggagtgcagtggcgtaatcttggctcactgcaacctccgcctcccgggttcaagcgattctcctgcctcaacctcctgagtaactgggactacaggcttgagccaccacgcccaactaatttttgtatttttagtagagacggggtttcaccatattggccaggctggtctcgaactcctgactttgtgatccacacgcctcggcctcctaaagtgctgggattataggcatgagccactgcacccggccaaggtgggtgttttaaaagctgtgtttgttgagtgcttccagagcccggcactgcgctgagatcttcatcggcatcaccactctttatcccacagccaccctgcgaggcggctacggtttttagcctcaagttggttgtgagaagagaggctctgtgggttgggactccaaggacacaccatgcgttggtgctggagccaccatttgtcccaggtccgactccagagacccggcctgcactccactttatcatcactgtggtcttcacctgtcctgtgtccccagacccctacacgaggccaacttccggccacctcaccttcaggacgtacgagactgtatccagcaggctttattggctttttaggggagctgtgccgaggctggggggctgggggcaggggattaactctttccctggggcagcgctcctggctctgaacccatcaggggattttcttgggcaggggattaatgatcccactctcgatgtattcgaagactgtgtatgggtcctggtccccattgagggtgatggccgacccatacaactgctccaagtcagctgagttcctgtagaacaggtccattttcagcttgacctgctcttcagcatcctttgggttctgcaggaggcgagcctggatctccatggtgggaggtggcttgtacatgaggtggtacctgcaagggaggaaggaaagcaggtgacccatggcctggcctggaagcaggggagaaagggaccctctactctactgtggaccaatttggggtgtcctggccaccaccaccatcaccagccatttactactgtgtactgctgtgtgcacacctttgactgatgggccctggagctacagagagatccaagatgtgctccccgctcaagggagagggagagagatcagtgataggaggacagaatacaatcatatatgggcaaattctttccttcctccctccctccttccctccttccttccttccctccttccttcctatctcccctccctcccctatcctccctctcttctctccctccctccctcccttcctttctcttcttcttcctttttcttttcttttttgagacagggtctcactctcttgcccaggctggagtgcagtggcgcgatcttcgctcaccacaacctctgcctcccaggcgtgcaccattactgcccagctaatttttgtatttttagtagagaaggggtttcaccatgttggccaagctggtctcaaactcctgacctcaggtgatccacctgccttggcctcccaaagtgctgggattacaggcgtgagccaccatgcccggcctcttgttcctttttcctcccttccattcaatgtttatctgcactgagtcctgtgttaaatctgccactgacagtgccatggtaagcaggacaggcgctggctctgtgcctatggagctcacagtcagatgagggagtgggacattacagcaactgtggagatggaaggaagtactacagccgttcactgttgggagagaccgcagggacagggtgacatgaaggccacagcacttgagatgggaaagctaaaaactcccatgacaaatcaggtctacattttagaaaaatccctgcacttccttcctgcccgccccccaccccactcctgcgtccctaccaagaaatgtgaccctgactgtcaggagagatgacaacacccgcctcttagtgattgtggggtttccattgcatttcaacatgaatgcagtgattgtatttggtcagactgcagaatcaaactcggaatctacctcctgtaactatgggaagcctcaaaggcaacttgtgcccatggggatgtgtttgtacagcaaccaccactgggatgcatcgtggctcaaggaaaggccagtgaggaaacaggtgacgcccacccaaggctgctgtttcacatgctgggattaagctgttgatcccaggatagagtgggtgaacatttcaccattgtgttgctttagacataaatttcctggttattcttccaggcaaagacggtcaacagatattgcacagaacagccagttggataaagtccattttgataatcgtccttcagtggtcaccagtgttatccctgcagtgtttccaccatggcattggtcagtcagttgggtctggcccctggcagtccccagactgccaaccaccaggaacacagcacaaacctttccccagtgactggatcaattcttctcagagtcagccgctccatgatggaatcaaatggcacattcaggaaaaacaccctataaggaaataaaccatattaataatggtttttatttcctgtattttatgatgctgtgacatcctggggtcttgagaatcctggagagactgctcctcccagggctggccgattcctagagccagcaagcaatgtgcctgcaaacctgcctttcatgtacaacccaaccactccagagcctgtgtccccccaaccgcctccttcatctgactctcacaccccaaaccaatattcttcctgccctaaatcacctcagggccgggtgccaggcaactagagaccatccctgtagaccgagcttggcagaattattcaaactgcccagtcctatgctcactgtgacttgtctgcattctgggacacgctctcccctcactcctgctgccacctgaccaaccctggtgcctccccaggtcctgcagggcatggtgtgccccccttttcctgggagctgtgagtaacaaactcttctttcagtgggattgacctctctgtatcatcacctggttacctctatacattagattttgggtgcaattaagacaagaacaagcagatggtcatggggagcaaacccaggctgactctcgtcaccccagacgagggtgggcatcattttccacatgtgggtggagccactggagccactgctcagggctctgggataccacacttggaggtcaccagggacagatgcgggacagcagggctccctgcaaggacgcactaggctcccctggttcagggatagctctcagcccccatcactcctggggttgggactcccggggatgggggtcattgtttgggtgagctttgggggaacatcttgttctctagagtcacacagacttgggctagactctcacctccactatggacttgctgtgtgagcttgggccactgacccagcctctgtcagactcagttaccccaactacaaaatggggctaattatagttccctggtgttgaagatttaacaagataaagtgtgtgacaaactcagtgtgaggtctgcacagactcggtaccccagcgtggcagctgttataatttaatcaccattcctagatacccttcctgggagttcaggctccctgacttcccctgtcctccttggagaggtggaggttggttgttctcagctttctcacttcctctttctcaaaggagccctggacccaaaggagcaggacactcctgctaataagcccaaatcagaacccagcagaagagatgaagggctcacttctcatgattctcagactgggagcaccagggaattcatctctcaaactcctagttccaatggtttcatccccacccccctttttagggcaatggaacacttactttatatgaaaccttttttttttttcttttagaggcagggtctcacattgttgctcaggctggagtgcagtggagtgacctcccaggctcagtcaatctgcccatctcagcatcctgagtagctgggactacaggtgtgcaccaccccacccagataagttttgttatctatttttcagagatggggtctcactatgttgcccagctgttctggaactcctgggctcaagaaatctgcccccttcagcctctcaaagcgctgggattacaggcatgagccaccatatgtggcctatataagaccttaggagagtggttctccaccaggggtgattttgttccccagaaaccatctggcaaaatgtctggagacatgttttattttcccagctggacagtgatgctggaaagcaccttataatgtacaggacagcacccacctcaaataatgatctggccccaaatgtcaagtgcatggctgaggagccctgcctgggacagtgtgtgaacaaacagaatgagaagaggtgtggctgctctggctgggagaggtggggctggggatgagccaagacctaggagctcccacccacagagctaagccaggtcttctagcactaaatcatctggttcatttttaaaaaataacttctagaacattccattgctcactatttgctcatttgtcctttaattcatttatacatatatttatcaagtgctggctgtgtctcggacacagcaggaagttccagtgtttgccagctcaccagatggaatttaggcactaaatttaagagtctcctccttgacgacattgacaggtcctatgactggcatgtgcagtttccactggggccaaagttggtgacaacatcaacgacaacaacaagaaaacatcagtgacaacaaacactccctgtgcacccaaagccttgtattcatttcactttcaagaaagtaaactcaggccagaagcacctctacgtgcggagaaaacacacacaaatgagacctccctccttccctcctagcatgatcaaaagactaaatcaaaagattgatcgaaagattaaaatcccaaatgtggagatcctgaaagccgaattctgagagtcgtgtgttttcagcggtgcccaggctagctgcgtcatgttaggcgggactatgaccttgttattgtcttggaaactaaatatggtttcaggaggggcctatgggtgccaagctgacaacacggtgggaggcttttctgttcgtttcagactgcctcctccaagtcagtgaacaaaagcagcctctcactgacatccttggaattctccagatgtgttgagcgggctgccaagaggccgcgctttggtaggtccaatgggacactggttcccatggggcccagaccagcctttggggcacaggtgtcacctgctctgtccagagcaataacagcacgtgcccaggaaatgcgtgtgaaggaatgaagaaatgaaccaacccatggtatccaggcctagaattctttttaaagtctctgcccactgcctgttttttttttttttttccatccttgccaaaaaaactcatctaactggtagaacagagagtgatctaaaaccctagggttgggcgggatcttagacatgtaattcccaggggccagttgcatcagaatcccgtcaggagcctttgatggtggatgcctatgccccttgcccagaactgctcagtcaggggcattggagggagcccagtgtggccctggtcactggaatccactgccttggaaaacacctgggtcagggattctgagccaggcaccccaaaggtcctgtgagccccggaaattagatacaaactgctgactacatggagaatgtgtgccctactgggtgttgggtgggctcatcagattctcagaggggtgctggtccttaaacatcattatgaatctgagccaaaacctcatgttttacagtgagatgaggaacctggcctcgggaaagccggggctgcccccgatcctgcatgctgtcctcacactcactgttctccttggcttgtagacgccttttcattctcctgattccctctgggagccaccttggccccctcgcctccctgtggcttggctggaactaccgggtatggatcataatcctgaaagacggatcccaaatgtcacaatcccaaacgccgaaatcctgaaagctcaaaatccctaaagtctaaattctaatgtctaaaatcctgaaaatcacaatttcaaaagattaaaatcctaaatgtggaaatcctgaaagccgaattccgagtgatttgtgtgttttcagcagtgcccaggctagctgcatcatcttggaaactaagtatggtgtcaggaggtggctatgggtgccaagttgacaataggtggacttgtggacttaattttatgtgtcaccttgactggatgaaggagctcctagcaacgtggtaaaggattcttttgggcgtgtctgtgcaggtgtctccagaggagagggctgtgagtctgagagggtgggtggggaagccctgccctgccctcagtgttggcacaccctgtgtaatcagccagggttctggagagaaccaatacagaaggcgaactggtctctctctgagggctggacaggctgtgcttctgctgctgtggacatcagaaatttgatttcatgaaagggcttatcacaaggctgagtgtgtgtgagcactgcatatggacatggaaagtttaaaacttcctcagtaaatgacgagatgtcctatttatgcaactgcatttgagaaggataaagtttcttgagagctcagctctctggatgactacatacgtggtgctgacccatctgggtttttggtcaatcctgtcaaaagactcaggttgtgctgaggtgggaggatcccttgagcccaggagttcaaggccagcctgggcaacattgcgagaccccgtctctgaaaaacaaaacaaaaaacaaaggtaggtggtctgtcatggtatttcagatgaccacagttataaagctgggttcccacaatgaccaaccatagtaatatgcatttatatatttcatttttaacctatttctttatgaagatggttcatctgctcaaaactgtaatacccgtgtgatagttattagtgtacctgagtgtttatgctcagtgtacctgagttattatggccaattttattgtgtaaattggcctacaaagtgctctgtggtgtttttaatatctcaaaaaaaatccccttttctatatgtaaataaacatcatttaaataattaaacaatgtttttttccacaattatatttttgggattttgatctttcagcattgtgattttcagaattttagacattagggatttctgacctttcagggttttaacatttgggattatggcattcaggattgtatcttctatggcattcaggattatatcttctatggcattcaggattatatcttctatggcattcaggattatatctttcaggattatgaccggttcctgaactagtttgccccagggctgcagggctgggcctgagggaggcccagaggtcaccagtctgagtgctggctcctccaggccacaggaatttgtttagaatgcaaggctgatccaagccgggtctatgagaagccaccccagggcttgccggagagaaatgagcctcatttctgatgaagctgaaaaggcaatgaagtggaagcccggggttccctggggcctgcacccaaagagagcgtaactgagaatgaagttcacgccacgagagcagaaagatggtgagagacattgtttggggccctggttcaagctgtgcctgtagccagcctcaggcacatgaatatgtatatattcatgtatgtatgaatatatacacctcttctcttgcctaggctgggtttcctgcaactgttacccaaaggacacatcatatatccagtttttccagtgccacttgcttctagaaaatgtgtgaacttaaaacaactatgagtccctgagccacaatctctttctccttcgaggccagcttctcccgtggccttgcttctctctctctcactttgcccatgctgttcgctgagctttgcttctgcccagtcgccaggaagctcctcactggtgcctgatgaaaactgcagctgcccctccaggaagcgagcccaactgtttccccagcagcctggagcggctgggagccatgaaaagcccatgaaaagccacgtcctccttgcacatgtgcttgataatgacttccattcacaacgtgctgcaaaataacagccactaaaaaaaaaaaacatgcgagatcggggagtgtgtaaacacagggagtgcaggtgtcgcagcggctttcatccctgacgctgtgaacacgcggccccccttgcacccccggtactgcaaggcccaacggcaacaccaaaacacggctgtcacggcggctggcggctctggatgccgacgccagtagaaaggaagccggtttggaaatccctgataattgaagctgcttcataaacaagccccatttgaaagacttttaacccagcgtaccaagactgcttgtcgtcattcaagggaatggcttgtgaaaggctggcaagatgtgacgcacaaggacaccaaatgggtgcttggagcacgctgctggggacagcctcgctgcggagggccctgctccatgctggaagcttctgattatcctggctcattgcgcccaatgtgagggccaggtggcagggtgcaggggcagcccaggccacgctgctgagagctactgctctgtgcatgccaccagccactggttttttgttttctgctgtttattacagagccaggaaagggagaaaggtgaaagcaaagaatactcaaaacagggtgtgctgggcagaccctcctggtgtgggtgagggtagtgggtgcctggactggccaggggcgggcactctacctgcccctgggattgcagaacttcaggctggtggatgcttccggaagggaggtggaaggtgttttgggaggcctctaatccctgctccaggtgggcaccctggatcagctgcctcagcacctccccagagcttattaacgacacagatctcaagccccactgcccacccactggagtccatgttttaacaagatcctcagtgatttgtaggcacattaaggttggagaagggccactctgacccgtgcttccaagatttgtctggtgttgagaattatctggaaggcttgcgtaaaatacagattgcaggcaccccttcccccaagagctactgaaccaaaacctccaggtgaggggctgggagacctgcattcgtaagtcagaagctcgggtgatgttcatgcccaggcaggtatgggagccatggctctaatccatggtctcatccttggccgcaccctgaagccaacaagagctttgagcgtactgaggcctgggcaccactcccggagattctggtatacttggtccagggtgaggcctgaaaatgggatttttacaagctcctcactgggtatggtactcacgcctgtaaccccagcactgtggaaggctgacacaggagcatcgcttgagctcaggagttcaagaccaacctgggcaacacagtgagaccccatctctacaaaaagtttttaaaaattagcccagtgtggtggcgcaccgatagttctggctacttgggaggctgaggtgggagtgtcgcttgagcccaggagtttgaggctgcagtgagctacaatcacaccactgtactccggcctgggtgacagagaaagaccctgtctaaatacataaataggttgggcacggtggctcacacctgtaatcccaatagtttggcaggctgagatggacggatcacctgaggtcaagagtttgagaccagactggccagcatggtgaaaccccatctctactaaaaaatacaaaaattagctaggcatggtggcatgcgcctgtagtcccagctactcaggagactgaagcacgagaatcgcttgaacccgagaggtggaggttgcagtgagtggagatcgcgccactgcactccagcctgggcgacaaagcaagactccatctctaaataactaactaaatgaaagctccttgggtggctgcaatgtgcagccagggttgagcaccactgccctgattcaatctacttagtctactgggtcccagagagctgaggggttcatactctgtcactctgagcattggtgtcaggtatccaatgacaactgggatcccctgacccaccctggtaacgcccactctagccacactgcctgagattctgtttgaagaacacaggaagcctccttcctcaatgaccttgaagctcatcccctgctttcatcactagaaactgagggtgaaatttactctggatccatggacggattgggtaagttgagagatacgatgtacaataactgactgcaaatatgatgcccggttctgcccagaggcaggggcctgactgtgttggcttcttgatcttaaccaataagcctccatgattgcaaaaccctacacaaagcaatatgacataaccacagggagatactacttcacactcagtagaatgactattacacatttaaaaaaaaaacccataaagtaagtgttggctagactgtagagagattggagctcttgcacattgctgctggaaatatagcatggtgcacctcctgtggaaaatgctatgctggctcctcgaaaaattaaacatagacccagcagtaccacttcggaggatataaccaaaagaaccgaaagcagggacttgaacagatatttgtacaccagtgttcttagcagcatgattcgcaacagccaaaaggtgaaaacaacccaactgttcatcaatagatgaatggataaacaaaatgtggtctatacagtcatgcgttgcttaataacagggacacgttctgagaaatgtgttgttttgtgaacaccatggagtgcacttactcatacctagttggtatagcctaccacacaactaggctgcagtcctgtacagcatgttaccgcactgaatactgtaggcaattataatgcaatggtaagtacttgtgtatccacacatacctaaacatagaaaaggcacagtaaaaatagggtatcagaatcttatgggaccaccattgtatgtgtggtctgtcattgaccaaaatgtcgttatgcagtgcatgactgtacatacgatgaaatactattcagtctttttttttttttttttgagacgaagtctcgctcttgtcccctagtctggagtggaatggcgcaatcttggctcactgcaacctccgcctcccggattcaagcaattctcctgcctcagcctcccgagtagctgggattacaggtgtgtaccaccatgcccagctaattttttgtatttttagtagagacggggatccaccatgttggccaggctggtctcaaactcctgacctcaggtgatccgcccacctcggcctcccaaagtgttggggttacaggcgtgagccactgtgcctggccaatcagtcttaaaaaggaataaaatttgggctgggcgcggtggctcacacctgtaatcccagcactttgggaggccgaggtgggcggatcacaagctcaggagatcgagaccacagtgaaaccccgtctctactaaaaatacaaaacattagccaggcatggtggtgggcgcccgtagtcccagctactccggaggctgaagcaggagaatggcgtgaacccgggaggcgaagcttgaagtgagcagaggttgcgccactgcactccagcctgggtgacagagtgagaatccatctcaaaaaaaaaaaaaaaaaaggcataaaattttgacacatgctaaaacctggatgaaccttgaagacattatgctaagtaaaataagacagatacaaaaggacaaacattgtatgactccactttttgaggtccctagggtagtcaaattcatacagacagaaagtagaatggggcttccaggggcagggggaaggggaaattgggaattagtgttttaatgagtctagagtttcagtttgggatgacaaaaaagttctggagatgagcggtggtgatgtttgtacaacaatgtgaaggtacttaatgctactaaacttacacttaaagatggtcaaaatagtaaactttatgttatatatatttaacacacacacacacacaaacacaagtagttagtagacattacaatgaaggcaactgggggagagaagttctctgaccttgaataaacttacaatttaatgaggttctgaatacatgcatgtatacatataaacagatggacaaaacaatgaaccatatgacagtattaattctacacaaactataatgcaaatactacataaactctttcagaaaatagaggaaggaatactgattttattcgtcagcttttccttgataccaaaaaccagacaaagacattaaaactacagaccaacatccctcataaacacaaatgcaaaaatcctcagcagaatattaggaaatttaattaatctagcattacataaaaagaataatacatcacaaccaagtgggattcagcctgtgaatggaaagctaacattcaaaagtcaatcaataagtaattgactgtatcattagaagaaaaagtttataatcatctcaacagatgtggaaaaagatctgacaaaattttacaccaattcctaacaaaaactctcagcaaactagaaatagaagggaaagtcctcaacccaataaagggcatttacttaaaaactatagttaagatcatacttaatgcccaaagactaaacactttctccctaaaattgagaacaaggcaagaatgtccactctcacttctactagtcatcatcaaactgtgagtcctggattgtacaataagaccagaaaaggatacaacaagcaaataaattgaaaacactccacctctgagtaccctgggtgtgggcggtctgagcacaggtgctgggacagccttgtgggcgctgagtccttcattcctggcatgtgctaagtgctaaataaatatttagcacaagatttcccattgctgaattacttttttttttttttgagacagagtctcactctgtcgcccaggctgcagtgcagtggcacaatctcggctcactgcaacctccgcctcccgggttcaagtgattctcctgcctcagcctcccgagtagctgtgactacaggcgtgtgccaccacgcccggctaattttttgtatttttagtagagatgaggttttactgtgttagccaggatgatctcgatttcctgacctcgtgatctgcccgcctcagcctcccaaagtgctgggattacagacgtgagccaccgcacctggcctaagtatcttaacatgggcagttttcacatcttcaagtttattcccaatgactgttcaactcttctttttttttaatttaaaaaagttttaaaaccaagtgcctccttttctgttgatcggtacaatttgatcacaataaatatgtcctttatagctcagggtaaattcaaacattcataagaatgcaaataatactttgttcagaccacagtttgctgctctaatgaaactattgtccatttctagctagactgggatgggaggggaagttcagggatgtttcccttgggcaacatctcgtttgaggcaaggatagtttccaaaggaagtaatccaggagatacacttggtcattggtggacactattacaacaaacaacgcagaaatatgttcatgactttttttttttttttttttgagacagggtctcactctgcccccccaggctggagtgcagtggagccatcatgactggctgcagcctctatctcccgggctcaagtgatccttccatttcagtcccccaagtagctgggaccacaggtttgtgtaccacacccagctaattttttaatttttaattttgtagagacttttcttatgttgcccaggctggtcttgaattcctgggctgaagtgaccctccaacctcagcctcccaaagtgctgggattataggcatgagccaccatgcctggcctgacatattgttaatttaaaaaatcaggttatatatcaggtaatactgtttgatcccactaaaaaaatgtatagaaaagaaaaagactgcaacattaagaatgattatttctgggctgggcgtggtggctcatacctataatcccagcactttgggaggccgaggcaggtggattacctgagattaggagtttgagaccagcctggccaagacggtgagaccccgtctctactaaagataagccaggtgtgatggcagatgcctgtaatcccagctacttgggagactgaggcaggagaatcgcttgaacctgggaagcagaggttgcggtgagctgagatcatgtcactgcattccagcctgggcaacagagagtgactctgtctcaaaaaaaaaaaaaaaaaaaaaaaaaaaaaaaaaaaaaaaagattgttcctgcttatctttctctttttagctccatatatttaaaaaactttttacaacatatatgatttttgtaaagagaaataagccagagttgtttttgttttgttttgttttttaagtcaacttcaagccaggcacagtggctcatgcctataatcccagctacttgggaggctgaggcaggagggcttcttgaggccagaagtttgaggccagcctgagcaacacagtgagaccctctcactaaaaacaattaaaataaaataaaaagtcaacttctactaacatggaagtcaggaagaaaagagaaatgctctgtgtaccaacagcaacagccctgccttctataaactaggtccaggccccaagggggaggaaggcaggttgattgggggcgggggtgttataaagtagtggcagaacaaggcccttaccttgtggggcaaagtacgcattcttgttctgttcccacacagtggcatgctggtaaaccagcttttagcagtgaggagggacgacccctgatttgtagcatttgccaatatccccatctagtaaatttcaagctgccaacatggcgtccttaaatgcggaagagaagtgcacattcagacctcagcagctggtgcagcccagttctagcacgcccctgccacagcagccccctaaggcggagcacggattactgttcccattttaccaacacgggtactggtcagacagccactttttatcaggcactgtgtttaaagccaggtgatgtaaatgtctggttttatgtaatcctcacaacacccaaatgaggtctgggtactggattatgcttacttttcacatcagcaaacaaatgaggcctagaaagatcacatgcctgcacaaggttatttggctaaaaagaggcagagacttgaacccaggactgtctgctcccaagttcgtgcccataaccacatgggggtaccagttctctccatcacggagctcatcttgcacttagtggccgtgtgtggtgggctgagttacttgctttgagccttctccagaggtgtgagacatggaatagacatttctagggaggtgagagggaagaagtaaggttcccgactacgcagtggaatgagcagctggaatgggtgggacttggctctggtcggctccccgtttggatttggggatgatgaacagagacctgtgcacctctggcctcctccagtcttagagctgagcacccccccgccccactctggggctgcatccctcacctgcacggtgggcccaggcgaggaacccacccaggccttggaaagtacagttgatgaacggtcatcttcatctccagggctgcactcctcatcagatgcatttggctccttcgctgatggatggggatgcagaagagttgaccaatcctagtgtccagaagacttctttgaggtggcatctggtgtgtttgtcctactctcagaagatggtgggcctgggggtcctatccccagtcaggaccctcgctatcatctgcctgttcccaagtggcacctggccacccagccttcctgccacatggtgggagtgccttttccccccatttcctgggggcaccctgggcaagctgaatcacccacggcaagcccagccagtctgtgccaggtcacggcaccatctgcaccagcagctctcaggtgcaggtatggggcacaggagcacactttaaaaactctggccgagtctttttcctggttccaggcagggcctgtgtccgaatccccccgacactgctccttcatgcctgtgcacacttggaagttagcagtcagtgcagacaaagttcccgcatgctcctggaaacccaccatcttcactgggcactgcaccacgccttctacctggtactccgagctctaacaagcacttagcttgacagtgggaacactgatcaacactgaagtcgctctgtttggacgccagtcaagatccattggtcagcaacagccccccaaaaacagctgggttggtgaacatttcctccgtgtcctgaggtgtggccgatgccaagaggccccactcagatcccccttccagaaagagctcagctgtaaggggtgggtcaccgcagcctccaactgaagcatcgtgagggtcttgagccctagttttcgtttttgtttttgttttgacatctttactgagctataattcacccctgtaatgagtctaattcaatggatttagtatattcagagttgtgccatcatcaacacaatctaagtatggaacattttcatcactccaaaaggcaaccctgtacccatgaacagtcacttccccttccccagctcccagccctaagcaagcactgatggactttctgtctctacggattttcctattctgcacatttcacaagacatggctctccaagtctccacctaggataaaaagaaagaggacttcacaagattgtcttaaggattaaatgagatgacccatagaaagcacttaacacataattacatagaatatccacgagggccaatgtgccaggctgctttcactcagcctgatgttttcaaggttcatccagactgtcgcatggatcagaacttcattcctcgtgcagccaaacagtgctccattctttggatctatcacattttgtttatgcatccacgagttgatggacttggactttttttttttttttttttgagagagatagagtctcattctgttgctcaggctggagtgtaatgacacaatcacagctcactgcagcttcgaccttccgggctcaagcgatcctcccacttcagcctccctaacagctaggactacagcacatgccactactcccagctaatttttaaaaacattttttgtagagacagggtctcaccatattgcccaggttggtcttttgggctcaagtaatccacccaccgtggcctcccaaagtactgggattacaggcgtgagccacggtgctagccaaccaatggatttttaacccaagcttttgaaccaaggtcacactctggggtgacctttggccaaaaactaagcatgacaggggtaccagcacctggcatttctgcccctcgcagccctctgaggggctgtgccaggtctgcgtcatgatccatggctcctcacccaccttactttgggctcttttcctggtacaggtgtgccttccccattaactcctcttcactcctgaccctgtctcagcatctgcttcccgagattgcatcctgacaagacacttaatatgtaataacaacacagaacccacgtgggcccacacaccagcactcttctattagcctccgtgaggccacttcatcctcatcacaagcttgagaggcgggggtgtcattagaacagatgagggaaccgagggacagaggagttcagcaaccaatccaagttcccccgccagaagcgatggagccacgactcaacccaggtgaattctccagtgtcggtgcccttggtcacagcactccattgtgattccgctgaaggaacaaggggaggaggggggcctggcctcccactgctcagctcaagccacaagccctggctgcgtgtgtagctttagctccccggggctgtgctgtgaggcccaggttcagagccagctgcagtcaatgtcatctttctccacctgcaacagatcagctggaagagattcgaggcaggaaacacagcagatgctctgccatgggggcccacccacgtgcctctgctcgcgacctgacctgccgtcgggcggccccacaggcacgggtctgagagcagggtgtgcagatccaggatccctgggtcacctgggggacaagtgcatctcctcgtcactggtcactggaaacagggcagtggagacacgggtaggtgtgctaattttgaggtttcctttctcagagtcagtctccatcagtgacaactgctgctttaaaatctgtctctggtgaaaagttacataagcacattccagtgttcctctgccacagcactgtcgctacccaccgccagattccccagccttgacttctctgctatgtatgtacctatctatataaacgtgctgcagagaaacctgtcttttaaccttttctgcagctggagcttttccatgaatccctctgtctacaagtgttttacttcttggttttaattttaatcctttgccttccattaatcagcaccaaaactgttttattgatatttcctacctgccgggcactggtagtaagcacgttacatgcacgtgctatcttatttaatcctcgtgagaagtacacgaccccggtactgtgatcgtgcccatttcgagggtgcaaagactcgggctctgagaggtgaagtgttgcctccaggctggactccagggccatctgaatctaggacactccgttgctgctccgctaagttctcagatgtaaaataatcgtgctttgttccctgaagttggcggagccttcctgaaatctccagtgaggatcaggagagggacagtgaacctgccggaactcaagccagctagcgggagggacgggggttgaccctgcttatgtgcccccactctcccggtgtgctagaccccacctcagactcctctgtgtcccccgttacgtagggggtgtgccggctcacaccctccagtgtgcctcactaaggacacagggcacagctgcctctcaggactaaagataaattccacagattccaaaagacccttcgtccccaatcacagctgccttgcctaaagaatccaccaccgtggttgttaaacccacactttaattactccaaaattatgttaaatccttgcataaatattgcagtggcatcttctgaagaatttcattacagtaagttgggttgctgccagagctctccactaaaaagtaacaggagaatagacacgtgccaaaaaaaaaaaaaaaaggatagatgctgttttcaaaataaaaaggcaaggaggtcatcctcggtcagatcacgcaggtgtcaaagagaaacggtctcatgatagcagaaatctcccattttacagaccgaaggggaaaaacataccctttagccctctaatctaataggattcacttctggaaaaacctaaatctgattaaatattaataaccagtggtattaattaagggggaaaagtccatcaagagaaccccaatatgtttacagtgtccccaggaaactgggaaaattcacaatcaagtgtgtaaatgttctaagaaagggtcctgaatattttatgaatatttgtcataaaacagaaataataaccactgtgcagagctattagaattaatatttatgctgcccgccatgaaatattcatggggacagagaaaggggggccgtaagacaagaattaatttacactgggctcggtttacccgctggcttgatgtttaaagacggttgacaagcctccatatgaatccgccagtcacttcccgcagtctgcggagtggagggggtggagacgggtccgggctgctgacagctcacagattgagtttctgacagcccttaaaaaacctaaacggcccccacctatttccccttcttccattgcccaaagcgctctgttctgccaccgttcatccgatctccccttccatctgctgaaattaacgaattaatgagcgagatacgctttacggtggggccttatgaatgtttacaggcgattaaattataatgcggggcggctgtataattcatgaaccaattaaaggaagtgttagttgatttgatgggatgaggacgtacaaaatgcatttaactaatggggaaccgcgggctgcccagggccggctccctctctcggattacgcggctaattgctcgactttacggggctgtcacagatagccatgcatatttcattgttctcaaatacttcaattgtgtgcgtccgtgtcgcggctgtaatgtggagaaggcgggccaaacttgggtgtagttacagtacccgagctgggccccggcagaaacctgagctccagagtcgggtgtctgggccattaggtgattaaaaaggctcagcatgcgatcgccttttgttttactatgttctcttcgggacactaattccggatgctgacttcatgaccgtggtgacactggggccctgatccctttctttccgggtagtggaggggaggtccacagccccctgtattgttcacaccctgtgtgccctcgaagcccaatgtccccagtgcaagggtccctcaagacagtccacctgagacaatccccaagctaagggtttccctcaggcctgactttgtccatccgtacaaggtggccaccaggagcttctttaaatgcggtctaaacttggacccaaacttgaagctgtcatcagctccttgaagtatgtttggaaggaaatcagcagagaagagcaaatgcaccctccccaaggagtaaaatgatcctggtgctcaggaagagagaggatgcttccagaattctgtgagccgaaggacagaggagacaaaggtggctgacttcccagctggagcaacggggatgtcgagtttagggagacgctgccttcatccagcaatcctagtgcactctgtggggagcagggtgagaccatcggagccgcgcagccaaccagtcagtcctctgagatggttctattctctcctctcgcttccaagccagtctggcattcacctgagccaagcacatgcatgcacacacacacatagacacacacacgaaacaaattagaagccctgtggttaccaccttcagtcctcctgtggatacctatgaaagaatgtattttactcccacttttgcgagtagggcctgggcagcagccagagctggggctctggggtctgcactctcaggatcaaggctcatacccttctgcagacaccaggaatgcatggccaagggcagccccaggttccccatctaaggggacagggatggcaacaggtgaggaggattaaaggcactaacccgtggccttagcatcgaggctgatatgtgataatcacccaatttagttagccaatactattatcacatgctaatagagattccgacttgcgcaacagggaggctctatccatcactttcctcttccacaaacgcacatgacagtcggggttggcttccaccccttaattgcgcagtggacagtgtgctgtcaaatggagcaaccagtgaggtctacaagaatgccttacggaggcagcaaaatagatccaggtggaaaagttgcaggaacccccgggccacacgtgaggcgagcactcagtctctgcctcgaggatgaaagaagggccaactgcacattaaaagaaagtaagttcacttggtctaaaatatttaattggggcctaattgaaaatgaagtatcaattagtagtcaagctgggtttaatgcattctggtttaaaataaaaccaaactatcattcatcaaatacaactgccttaaatattttacagttgttactttatatcatcttgcaaagtaaacagtattctcaatgcatatatgcggcaactgaggctcagggtagccaagtatcttggttcagaaatttattttaagcaaatatttgtgcaagtgtaaagatatatggacaagatttctcattgctgaattacttctttgagacagagtctcgctctgttgccaggctggagtgcagtggtgcaatctcggctcactgcaacctccatctcctgggttcaagcgattctcctgcctcagcctcctgagtagctgggactacaggcgtgtgccaccacacccagctaatttttgtatttttagtagagatggggtttcaccatgttggtttcaccatgttggccacgatggtctcaatctcttgacctcatgatctccccaccttggcctcccaaagtgctgggattacaggcataaggcactgcacccagcatttttttttttctgagatggagtctggttctgtcacacaggctggagtgcagtggtgcaatcttggctcactgcaacctccgcatcccaggttcaagcgattctcatgcctcaacctgtagctgggattacaccatgcctggctaattttttgtattttgtagagagggggtttcatcatgttggcctggctggtcttgaactcctgacctctagtgatctgtctgcctcggcctcccaaagtgctgggattacaggtgtgagccaccatgcctggccttactttatatgtctggttttaattttttaattttaatttttttttttacaatgagactgtactatttctacaattaagaaaaacactaattataaaatcacaggctgggcgtggtggctcacacctgtaatcccagcactttgggaggccgaggcaggggagttcgagaccagcctggccaacataatgaaatcccatctctactaaaaatacaaaaattagccgagcatggtgatgggcgcctgtagtctcagctacttgggaggctgaggcaggagaatcgcttgaacccaagaggtggaggttgcagtgagctgagacggtgccattgcactccagcctgggcaacaagagtgaaactctgtctcagaaataaataaataaataaataaacaaaatcacaagaacaggtttattgttaaagacggaaaagtgtgcattttcagctacaggaccaacataatggtgataacacgtagataaccgtaagactggaccggaagttcttatgcgcagatcataaaacacacagatttaaagcttcatgtgtctgagcagtgctctcagtctcttatcaaaccccccatatcactgtggaatcagaacttcatttcaataagagtgggcagaatggggacaaggacacagcagatgctggccactgagaaggacaaagagtgggacgacctttcacccaggtgccagcctcccaggtgctcaggtgcgagagggctcaggtgaggaagtgtgaatagctcagtgcaaatcaatgcctctggtttaagaaaatcaaaagatgttcattcattcattcaacaaatatttacccagtgcttcctagatgctagttgctggctgccctaggaactacagatctagtggtgaatgagccaggcacattcctggcctcccacagcttttaccacgtgtgtttagatacacacagacaccatctgcccgtggtacttggggttgatctcgatattaaaagatgcaaatatgtactatgaaaagaccagtttgcaatcggcaaagggatgagatccacaagttgtttgctaaatatggtttggacaaggagggtgaagtacacactaatttcttggatggataatttttctgatgaagtggctaagttgtgtttgtttgtttgtttgttttgagactaagtctcactcttgaccccaggctggagtgcaatggcgcgatctcggctcactgcaacctccgcctcccgggttcaagcgattctcttgcctcagcctcctgagtagctgggattacaggtacctgccaccaagcccggctaatttttgtatttttagtagagacgggtttcaccatgttggccaggctggtctcgaactcctgacctcaggtgatctgcccatcttggcctcccaaagtgctgggattaccggcgtgagccactgcgcccagtaaatatttacaatgtttttcacgaactaagcatgctacataacataatttcacgcaatcttctctttgtaggagttaggcacaaccaccatcccctatttgataggtgtgggaactgggtctcagggaagttatgcagcttctcaaggtcccatccctagtaaaggcaggctctgggttcaggtgctggacgctctggcctgccataaccactgggcactaccgcctccctggatgctcttgtgcgaggcccctcgtaaggtgtgctggctcttcaggtgccccgtgcccggcactctgtgaggatgcacaggatacctctcactgcgtcttcatggcaagcccgggacgtaggtgtaactgtcacccccatcttatggatgaggcagcttgccccgatatcggctggtgagtgacccagaagaactcgcgactcacagctgctggactctaacatccagggtgggagccactgggctgtgttgctgtttcccaaatgcaggaagtctcttaagtgcttcatttactctgttttttttttttcttgagacagatttgttcatcgataatttttattttttaaatcgatatgaaaatcctcttgcaggggtggactggagctgagggcacttgaaggggtgagtgggaaagcccacagccaggagccaccagaaccggcgcagagaacagacgctgctgcaggaggccatggggctggtgttggggtgggcgtgcacttgccatccttttatttcttccccaacctccttcctctgtcttccttacctcgagatactgacagcacactcctagagatactgacagcacactcttggagatactgacagcacacttatattgagtttctgccatgtgtacgcatcttggggaggcctgggaggccctgatgcatcaggcttcttggcctctctgtgcccacccctgaaccagcctctcttccttcacctcttctcatgggctctgtcatgcaggctggagtgcaatggtgcgatctcggctcactgcaacctccgcctcctgggttcaagcgattctcctgcctcagcctcccgagtagctgggattacaggcatgtgccaccacacccggctaatttttgtacttttagtagagatggggtttcaccatgttggccaggctggtgtccaaatcctgacctcaagtgagccacccgccttggcctctcaaactgctgggattacaggtgtgagccaccgcgcccggctcctcttcatttcttctacacatctttctgtccggcatcggggcagcagtggccaacagaagacatacctctgtggccttcccagcacaattccaaggacttccctgaatattccaactctgggacatcccctctgagctttcattccaggaaaaccacgctttcttctcaaatttctaaataggattggaagctcttacttgtggactagcaaagataagggttcagattctagcgcttcaaaggactccatccggtgaatcccaccagggcgcgagctcccccatgagagcaacttcagagagaagctcccttaggctccctcccctcccaaatctgcacctaacgtcaggctgcatccagagataccaatggaaattaggtacaaattgtaccctggacttgactttgcaatcggaagaaacctcgatttgtgggggtaaaggtcaccgcctggaaggcctaacccagaggccagccctgtggcttggccaggccaagagaagcctcccctaactgcctatggaaaagaacccagggttaaactgtttatctgggttatgctcccaggttaaacttcttaagtgaaccgacccaaggaggtgaaacctgaatttctagataaagcttttccacgtctttggccaggtacacagaactgcaatttaaaacttctgggttttatgccgggtgccgtggctcacgcctgtaatcccagcactttgagaggccaaggcaggccgatcatttgaggtcaggagttcaagaccagcccggccaacatggtgaaaccccatgtctactaaaaatacaaaaattagccgggcgtggtggtgcacgcctgtaatcccagctactcaggaggctgaggcaggagaatcgcttgaacccgggaggcagaggttgcagtgagccgagatcatgtcactgccctccagccaggatgacagagtgagactccaaaaaaaaaaaaaaaaaacaaaaaaaaccaacttctgggttttgctagttgtctgcgaattaagtctatgattccagctgagaagcctgcaacatcctggtggttgcagtgagccgagatcatgccactgcactctagccacgatgacagagtgagactccaaaaaaaaaaaaaacaacttctgggttttgttagttgtctgtgaattaagtctatgattccagccgagaagcctgtgacatcctggtggcatctcccccaagggccatcaacttgtgataatcctggtccttgtgtgacggctgacgagcacaaatgctctcaaagaagtactgtgcagccactgacggtgaggctggggacagtgtttgtgaacacgggttcatggtatattccatagaggaaagggctgtgatataatgtgtgcaattaagaccctgttttcatttttattatttattttcttatttttttatttttgagaaggagtctcgctctgtcgcccaggctggagtgcagtggcgcgatctgggctctgcaacatctgcctcctgggttcaagtgattttcctgcctcagcctcctgagtagctgggactataggcatgcagcaccacacctgactaattttttttgtatttttagtagagatggggtttcatcatgttggtcaggctggtctcgaactcctgacctcaaatgatccacgcgcctcgacctcccaaagcactgagattataggtgcgagccaccgtgcccagccaagacctgtttagagtagtttttaaaatattggaatagacatacacccaaatgtcaacattagttatctttggatattggaaatatttttacttagctacattttctaacttttttttttttttttttgagacggagtctcgctgtcgcccaggctggagtgcagtggcgtgatctctgctcactgcaggctccaccagctgggttcacgccattctcctgcctctgcctcccgagcagctgggactataggcgcccgccaccacgcctggctaattttttgtatttttagtagagatggggttttaccatgttagccaggatggtctcgatctcctgacctcgtgatctgcccgcctcagcctcccaaagtgctgggattacaggcgtgagccactgcacccggcctacattttctaacttttctacaataagtagatgccctgtgtaatcaaatgtttgaaataaccaccttcgccacaccctgcccccaccttgttcctccagtggcttcccttcccccagctctcctggaatgggcctggctgtccctggcccaggacatggacgctggctgccccccacccaccccacctgcagaactcttcctcccctcctcctgcagctggctccttccttccattcaagtctgagcttaaaccagccctcctcagaggcaccttcccccaccagcgcatccaaaccagtcagcttgcccctactccatcatgccatggcattttaatcccacataaagcacttggtcctagcaggtatttctgctctgtttatttgtctaacgtcgcctcctcccatgggaatgttttgcttgtttctgtggccccagcgtctggaacggtgcctggcaaagagaagcctacaataaatacttctggagcgaacaaattgaagtgtaagtccttcccttactactaggaatagcagctgccacaactgggctccgagctgatcattctacactggggaatcacgccgcattcccaggaggaaggagccaggccactgttgacctccttttgtcctggggaatctgaggatcagagacataaagtaacctccctgtcacccccctagtaagccagctggttctgggctctctcatcttgccgctccactgccaagaacaacctccatcctatgctaggggctgggcctggccctgcaggatgtgggcctggctggcaggcagccctgaccctctgcctggccccagtggcagggtccccacaactcctatctgggaagggcttaggggcagcagcccagttagaactgctcattggacatgttcacaaagctgcacacactgtttactgagacgatggctttatttggggtggctggggcagagagagctcatgagtgtgggggctgaagccatccctggactaatccccaggtactcacatcctggtagggaagggcccctggcacaggctcaggctggtggctttaagccagtttccttgctggagggtatgggtcatccccagggtggcccagctggggcggaagggcaccctcgcagtgaggggatccccgctgtggagagcatgaagcccctccatgttctctagggaaggagacaagtgggcaggagacaagtgctctcacgccccatccctgcagcctcctggagtggcacgcaggtgacaatggggactgcagggagcatgcacgaaggtctcctcttcgtatttactcatccagtctttccactgccgtctgaattaggtcccatcattgcctccattttatgatgcagaaggagccctccaggtgggataagtcattcagacagcgcaactcacagagggcactggagcccggagtgcggttccagaaggcagctctttgccgtcacaccacactgtctgtctctaaaggacccactgcagggtgacttggttaacagctgagaacccactgaggtcagcagaaactccaggggaagaagaagagggcacatggccgcctaggatctctgcaacaacatgctaccaggagacggcacaacacgcaaggtcgggaaaggggaagcagatgatactctttgatgtttctgaagtacctccgccacaagcaagcacagagatgtatttcagtttgggatagaaatggctatttgcatttcatcatctttgagcaggactgcagacataaatgggacccatgatggagccaaatcagcatattgcagtgtgagcccgaggtgatatccagcaggcctttgagaggtgtgggcacccagcgtgtaacactggcattaatcaccagtgactctgaatgttcgtggaagatcagtaagcatgcaaatgagagaacaggatcggccccatccccatctgattggaaacatatcaggccgccccctttcatatcaagtttccattgtaaagagtaaaactttcaatggccattcctcttgccgctgccctctctgtgatgctggtgcttcctcctgctgctgttcccgggaggacagttgagccaagggcagcttctcctcctctccctcccctagccatgcctatcacacataaggaaccaacagtttccaatttgattccatttttctccaactacttaaagaaaaaggccttacagccaaaacattaccactgatttttgttttttggttttttttttttttttgagacagagttttgctcttgttgccgaggctggagtacaatggtgcaatcttggctcattgcaacctccacctcctggattcaagcacttttcctgcctcagcctcccaagtacctgggattacaggcatgtgccaccacgccaggctaattttgtatttttagtagagatggggtttcaccatgttggccaggctggtctcgaactcctgacctcaggtaatctgcccgcctcggcctcctaaagtgatgggattacaggcatgagccaccgtgccccaccttgctaatatttttatcagcatcttcccttcttttagctgacaggagcaagcacttgctgtcatgccagaatatttggattacaacttggttatctaaaagatttggcaggttttcatattttccatgtgtcagagacctggaacactactgtgtcctggcaccccctcagccgctttcttgcctatggtatctcccaggtgccaggtgccccctaccctgcacaccaagagccacgctgggagagagtgctgccagccgagcacccgagcgcctcgacccgtcccacctgattgcaccggctctaaggcaaacctcaaagaatgcgctcactgtgaaggacagtagttagctgtgtccaaatctgtctgttctgctagagggaagctcctgggagagggaccatggagggcaggactgcgcctcactcccacctttgcatcttcagagcctgcaccgtgtgcacatagcccctcatcacagggcttaatcggtttgctgaatgaatacatgatcttcctatttgctgagagccataaatcaccagctatagaagtggtggccccagtagccgttgcattatagcatcccagggccaaagagaacaccagaagacccttaattttacaggcagagttgcctcaggccaatgactggctccaactctcagattttttttttttttttgagacggagtttcgctcttgtttcccaggctggagtgtaatggtgcgatctctgctcactgcaaccttcgccctctgggttcaagtgattctcctgcctcagcctccccagtagctgggatcacaggcatgcgccaccatgcctggctaattttgtatttttagtagagacggggtttcaccatgttggccaggctggtctcaaactcctgacctcaagtgatccacctgccttggcctctcaaagtgctgggattacaggcatgagccaccacacctagactcaaagacttttttaaaatgaggtgtattcctcagctgcccttagctttcctcccattgccacctttacagacactaaagaattttgtccagactcttcctggtgtacataaattccacttccctttgttttcctctcacaggaagtacaaaaacagcagctcattcttgcatagaaaagaattctcctcccaaaaaagaagctcccaggttctagagagaaagctttgaggccctcagtttaagccattctgccttctgcagtgtctggggaaagctgctgtcgggcccaactctctcctagaggcaccttgaggtgtggagcttggctccgaagccaggcggggagccagagggagggcgcctgcaacctgcgaagcagtttcttaagtgatcatttgcatacctaaaaattcactgttcatggtaacaaattccttttaaaccaccttctgcactgataacaaatctatgttttgccaaggtgaggggagaggcgatcagctgccgggggccacactccgaagtgcgaacagaatctgaagcaccctctcacgggaaatgccggcatctcactgacctgattctgagcaagcaagagggcgctggattgtcccactctttgaagctcaaaatgggcttctgtaagcaccgaacgcacgtcacctaatttatctctcatcacaccctgtgagcaggtgccattgtcatcatcccccctttagagacaggcgaattccgcacccccataaaacgactcactcaaggtcattatcagccctacatctataactcacggactcgtgtctagagagttctgcctggctgattttctctgttcttctaactactccacaactaaatgtttcacaaagccatttcccccccaaatatttatgttctcaaatgtttattgcctctctatcatgatcaagattttatgagcactctatatcagttgtgaattaaatacataatttcggaatcatcgcattccagtttggtgctacatttgtctctattacaccgcagcagttgccgtgggcacccgacagatgacaacggaatgcgtgtgtccaggggcagccagagtgactgacatttcaatccagaagctgccacggggacctggtgattcccaccgttagcgggagagaagcttccacagctcaccgggatggtcagagggttccggagcaggacaaggctaggatgggctccccccgtcaccctcactgcaccaacgaggccgtgtccaacccgctggcctctggggaaggagggcccgccatctcacggcaggtgaagaagacaaggagaaaaagaggccatttttttcctctgatgagcagtacccactctcttatagaacaatccgggctatgcctgggggcctactggttaatcccatcctgtatgggaaatacagaaagaatatcgagcctggaacaaaactgctacaatttattactccctcacatttacctgtatgcactacctgactgaccctcacagcaacttcacacaatgtggactgctaattccactttgcaagtgaagaaactgaggctccgaaaggcggcaaccgcagaggtggatctggttcctgtttccaggcctttgccccttctgttccctcttgtggccagccccccgaaacactaaaaatggaaataactgtcattactgaaatactctatctgtctatcaaaatagaactgccgtgggtaatatagccattcctgaaagaaaacatttagggatattttaaatccatcattgatcctaagggagggaaaaaaaaggtccctaaaccttaagtttcatgatgataaacacttccacagcttgagcacgaggagggcaattccactgaactgggccactaacttgggcagggctgcagttttgatggctctgggggctgtccctcacatcgctgtcctgatgtcctcatggtctgccatgtggcatcacccagcttagatgaagcctttgtttcttggacgtttccgtcatttccaaagcatccatcactttcagtcatccaattctttattgccaccagtagaattatgagctcttgggcactttggtggcacccattgaaaacagaagtgcaactacagttcccttccaggcttttaatctggagaaacagtcacacgaatacgcggagccacacatacggcatgtttattacagaaccatttgcaaagggaaagaaagaaaaaagtctaaatgctcttcagcagggcttcctactcatccatatcctcatcagtacttggtttggacagacttaatgtttgacaagctggcaggaacaaaacaatgtaccattatgatttaaattcgtattttccattttctttttttttgtttgtttgtttatgttttttgagacagggtctggctctgtcacccaggctggagtgcaatggtgcgatctcggctcactgcaacctctgcttccctggttcaaatgattctcttgcctcagcttcccaggtagctgggattacaggcctgtgccaccaggcctggctaattttttttttttctgcatttttagtagagatggtttttcgccatgttgcctagtctggtctctaactcctgagctcaagtgatccgcctgcctcagcttcccaaagtgtggggattacaggcatgagccaccgcattttccattttctaatgaggtttagcaactttttctgttttttggcccttgtgttttttcttttgtgaaatccatgttcacgtcttaaaaaaataaaacaaaacagccttactgagatataattcacacaccataaaattcacttatttacagtgtacagttccagccgggcatgacagcgcatgcctgtaatcccaggactttgggaggctgaggtgggaggatcgcttgagccccagagttcaagaccaggcttggcaaaacggcaaaaccctgtctctacaaaaaaatacaaaaattagcctggtgtggtggtgtgttgtagtcccagctattacggaggccaaggtgggaggactgcttgaacctgggaggtcgaggctgcaatgagctgtgatcacgccactgcactccagcctgagggacacagtgagacctggtctcaaaaaaaaaaaaaaaaaaaaatagaaatgtacaattccacaggttttagcacactcccagaattctatgatctgttcctgatttttctgcccatttttatattaagcatactttatctcattcatttataggagctctttataaattctggatactaactctgttttggttgcaactagcctatcccagattgagtcttttcattcttcagatgaatgcctttggctgaataaaagttctcaattttaatgtagtcaaatttatttattttcttttgttgtttacgctctttgggtcttattttaggaagacttctgtatcccaagatcataagatagtttcgtatatgttcttctacaaggttttacagttttgtctttcacatttaagcttttaaactacctggaattgattgttacatatatggggcaagtagctgtcgaaggtaattttttcccacatgggtacccagttgcgcagcatcatttattggaaagtccatctcttccccctgatccgtggtgccacccctgtcattatcaagtgtgagtgtttccgggctctgtgttctgtgtcactggttagtagatctaatttagtgctaacacctcaatgtcctaatggttttaaaataaatagatatttgagagggcaagtcctcccactttgtctttcttcgggaataacttgataaatttttaactctttgctcttctatgtaaatgcagaatgagcacagcaagttgcatcaaaaagaaccactaccaacaatttggaattttaattctgattccactggatctatgatcaatttgggaaggggtgacatctttataatattagcgtccctaaccatgaacgagacattgcctccctcttagggattcttacatgccttttaataaacttacacagtttttccaataaagggcttatacatctttcattgtgtttatttcagtgtacacttttcttctgctatacgttgttaatttttttttttttggagatggggtcttgctgtgttgcccaggctgcagtgcagtggaatgattatagctcactgcagccctgactcctgggtttaagtgatcctcccacctcagtctcccagtagctgagattacaggctcaagctgctgtgcctggccattgttgttgattattatcttagttttacattttccaactctctgttgccaaagaaagtgtaaataatctttggatctttaattattgatcttttagttggtaaccttgctaaactctcactaaaactattatgtactccataaattctttggggctttcttaatgtagataatcataacacctgccaataatgacttttggtccttccatcccaagtcctagaggttttatttacttttcttgtctttactgcactgtttaataatgtttcatagaaatgatgatgggggaatccttgtcttatgcttgattttaaagggcatgcttctaacatttcaccactaagacctatggttgctatagtttgggaaggtatcttttatcaggttaaggaaattcccttcagtttatagctaagaattttaaaatcatgaatagatatttaattttatccaatgctttgtcttcatctattgaaatagctatatctctttttctttaatttcttattattgtgaattcaagtaatagcttttctaaagttgaatcatccttgaataccctaatacacaattggattggatttgctaatattttgtttaggattgtggcaactatatttacgaataacattggcctgtaatttttcttatttatattatctttgggtttcacattaagactttattaatcttatgaaatgtattgtgatgtgttccctctttttctttttctgttttctgaaaagagtttgttcacaatgggaataatcaattccttgaatactgtggtagatttcacctgtaaaaggcatctgggcctagtgtttaagggaggggaacaattcatttttattattcaatttatttaatagttatgggactttggattttctatttcttttttcttttcttttcttttctttttttttttttttgagacagggtctcactcagtcacccaggctggagtgcagtggcacaatcttggctgccacctctgcctcccgggttcaagcaattctcatgcctcagccactcgagtagctgggattagaggcatgtgccaccatgctcggctaattttggtatttttagtagagacagggtttcgccatgttggcaagtctggtctcaaactcctggcttcacgtatctgcccacctcagcttcccaaagtgctgggattacaagcatgagccgctgcacctggcctctatttcttcttatgtcactattcataagattttttttcctatgaatgtatctgttttatctatgtttccaaatgtattgccataaagttgtttgtaatatttttcctatccttgtaatctgttatatttatgttactatatttattatcaaaatgtgtttcatcctctttttcatttcaaatatgtcaatctgttctttctttcctttctttcttcctccctttttctcttcttccctccctccctccttctctctctctccctctctctctctttctttcttcttttcttttcttcctctctctctctcttttgttttctttagagacagagtcttgttctgtagctcaggctggagtgcagtggtgcaatctcagctcactgcaaccttcacctccccagttcaagcaattcttgtgtctcagcctcccgagtagctgagactacagctgcatgccaccatacctggctaatttttgtatttttagtagaaatggggttttaccatgttggccaggctggtctcgaactcctggccataagtgatctgcccaccttggcctcccaaagtgctaggattacaggaatgagccactgcgcctggccattctttcttttttaattgatcaatattgctagagatttgtcggtttattaattttgccaaggaatccacttttgctctacccaagctctgttaactattccattggtttctgttctctctccagctactctttgagtttagtaattttttaacctaggtcagcggcttagatcattaattttcaactgttcttcttttgagatttatttttcactgaataccatttatgttccttcaatgtgtgactcctttcaattaaaaaatcaaagtagatgatgttggagtgaccccaggaagatgactagctagaggcctctagtcagctctcccttccacaaagacggccaaacagtgaataaacaactatatttaaatgaaaataaatacaggagtgagtcctggagttcatcaaaggagtaacagaaaccctggtgagcaaagaaactctggatagccacatagaaaacggaaggaaacaatcccagcactttgggaggctgaggcgggcggatcacctgaggtcaggagttccagaccagcctggccaatatggagaaaccctgtctctactaaaaatacaaaaattagtcaggggtggtggtgcatgtctgtaattccagctacttgcacccaggaggcgaagtttgcatgagctgagattgtgccactgcactccagcctgggtgacagagcgagactctatctcaaaagaaaaagaaaaagaaaagaaaaaggaaggaaacaacaggactccactgcccatcctccagccagagtcagccaggaaccaggaggaacgtcttcctacagcgaaaaggtagaaaagaggattccagcagctcccaccaccctttggacacctgctcaccactggggtcctcacaggccctatgcccatgcagagagctgtctagtatctacacagctgtgctcccctagagaaggaggtgacacagtaccctgccactgtggccagccggctgctgtatgacaccatcttgaagctggagctaccgctggagtgtgccttgcttttgggggaaagtcacaacaaattttaaagaattgatatcatatcaagtaccttttgtgaccacaatggcataaaactagaaatcaataacaagaggaacttttgaaactgtacaaatacatgcagattaaacaacatgctcctgaatgaccaatgggtcaatgaagaaattaaggaggaaattaaaaaatttcttgaaacaaaggaaaatagaaacacacactcttcaattaagtttagcctaaggctgccatcttacatattttaagtttggcctaaaggttgctttatacacagtaagctgtaatctaactagatgcgtaaacagactgtaacttatttttgtacctatcaccaagttttggccaactaaggcagccaactgttcaaaccgtattcaaataaggcaaatgccaagctataatcaatccagttgtttttgtacctcgtttccatcttctgtatgtcacatcattttcctttttctgtctacaaatccactccacccacttggcagcgctggtgtcattctgagcctgttctggtttggggggctgcccaattcatgaattgttctttgcttaattaaagtctgctgaatttaatttgtctaaagtttttcttttaacaatcccaaagcctacagggtacagcaaatgcagtattaaaagggaagtttatagtgataaacaccaacatcaaaaaaagtaggaagatttcaaataacctaatgatgcatttcaaggaactagaaaagcaaaaactaacccaaccccacatgagtacaagaaaataaataataaagatcagagcaggctaggagcaatggctcatgcctgcaatcctgtcctagcattttgggaggccaaggtgggtgggttgcttgagtccaaaagtttaagaccagcctaggcaacatggtgaaaccctgtctctactaaaaaataatttaaaaaattatctgggtgtgttggtgtgcacctatagtcctagctactcaggaggctgtggtgggacaatcacttgagcctgggaggtagacgttgcagtgagctgagatcacaccactgcactccagcctggacaacagagcaagactctgtctcaaaaacacaaaaacaaaaacaaaaaacaaaaaaacaagatcagggcagaaataaaactaaaagaaaaatacaaagatcaacaaaattaagtcagtttttaacaaaatcaattagcttgattaacaagaaaaaaacagaaaagacccaaataaatcagcaacaaaaaaggacacattacaactggtaccacagatatacaaaggctcattagagactattatgaacaactatgcaccaacaaactggaaaatctaacagaaatgaataaattcctggacacatacaacctaccaagatagaatcagaagaaatagtaaaactgaacaaaccaattatgagtgacaagattgaatcagtaataaaaagtctcccatcacagaaaagcccaggacttgatggcttcactgctgaattctaccagacatttaaagaagagctaactgatagtaatggccaaaaccacaattccttttgcaccaacctaataccatttcttctcaaacttttctacaaaatagaagaggaggtaattcatccaaatgcattctatgaggccagcattactctaataccaaggccagacaaagatacagcaaaaaaagaaaactataggccaacatccttgatggacacagaagcaaaaatcctcgacaaaatactaacaaactgaatccagcagcacattaaaaagatcattcaccagctgggcgtggtggctcacgtctgtaatcccagcactttgggaggccaaggcgggcagattgcctgagttcaggagtttgagaccagcctgggcaacacggtgaaaccgcatctctactaaaatgcaaaaaattagctgggcgtggtggcacgcacttgtagtcccagctactcgggaggctgaggcgggagagttgcttgagcccagggggcggaggttgtagtgagccaagatcatgccactgcattccagcctgggcaacagagcgagactccatttcaaaaaaaaaaaaaaaaaaaaaagagaattcaccataatcatgtggtgcatctcagggatgcaaagatggttcgatatatgcaaatcaataaatgcaatagatcacaccaacagaatgaaagacagaaaccacacgatcatcttaatagatgcagaaaaatcatttgataaaattcaacatcccttcttgataaaaacccttaacaagctggggacagtggtgcacacctgtagccccagctactcgggaggctgaggtgggaggatcacttgagccctggagttcaagaccagcatggccaacatagcaagatgagaccctgtctctaaaataaacaagcaaaacaacaacaacaaaaccctcaacgaacaatgtatagaaggagtatataccttaacacaataaagctcatatatatggcaaaccgatatctaactttatactgaataggaaaaagttgaaagcttttcctctaataactggaataaaacaagtatgcccactctcatcgctcttattcaatacattactgtaagtccttgccagagcaattagacacaaaaaagaaataaaggtcatccaaattggaaaggaggaagtcaaattatccctgtttgcagatagcatgattttgcatataggaaaccctaaaatgctctaccaaaaaactctttgaactgataaacacatttaataaagttgcaaaagacaaaattaacatacaaaaaattagtagcatttctatacaccaagaataaactggtggaaaaagaaatcaagaaagcaatcccaattaccattgttacaaaacaatacctaagaataaattttctttttgagacaggatcttgctctgttgctgaagctggagtgcagtggtgtgatcatggcaaactgcagtcttaacctcccaggttcaagcaatcctcccacctcagcctcctgagtagctggaacaacaaatgtgctccaacatgcctggctgatttatttttatttttagtggagatgaggtctctctgtgttgcccagactggtctcaaactcctgggctcaagcaatcctcctgccttggcctcccaaaatgttggaattacaggtgtgatccactgtgcctgacctcctaagaataaatttaaccaaggaagtaaaaggtctctacaaggaaagctataaaacactggtgaaagaaattaaagaggtcatacacacaaaaattggaaagacattccatgttcatggattggaagaattaatattgtgaaagtgaccatactaccaaaagcaatctacagattcaacataatccctatcaaaataccaatgaaattcttcacagaaatagaaaaaaaaaacttaaaatttatatgaactatggaacattccaaatagccaaaacaattttgagcaaaaagaacaaagctggaggcatcaaatatactacaaagctatagtaaccaaaatagtatggtactgtcataaaaacagacacatagaccagtggaacagaatagaaatccataaataagtccatgtatttatagccactgacttttgacaaaggtgctaagaacattcagtggagaaggggcagtctcttcaataaatggagctgggaaaactggatatatctgcatgcagaaaaatgaaactagatctctatctctcctcatagacaaaaatcaaatcaaaatagattgaagacttaaacaaaaggcccaaacctataaaactactaaaagaaaacatgaggaaacacttcaggacattggtctgggcaaatatttttttggtaagagcttaaaggacaggcaacaaaaacaaaaatagacaaatggggcttacatcaagctaaaaagcttctgcatagcgaaggaaacaacagagtgaagagacaacctatggaatcaaaggaagtatttgtaaactatccatccagacagagattagcagtcagaatacacaggaactcaatagcaaagccaattaaaaaatgggcaaatgatctgaataaacatttctcaaaagaagatatacgaatggccaacaggcatatgaaaataaatgttcaacatcacaaatatcatggaaatgcaaattaaaaccacaattagatatcatctcaccccagttaaaatagctattagcaaaaattgaaaaaaaaaagatgctggtgaagatgtggagaaagtggaatgctagtactttgttagcggggctgtaaattagtgcagctacttcggaaaacagtatggaggttctgcaaaaactaaaaatagatctgtcatgtgatcccacaattccactgtgggatgtgtatcaaaaagaaagaaacttagtatatctaagagatatctgcatgcccatgtttactgcagcactactcacaatagccaagatatggaatcaacctaagtgtccatccacgaattaatggataaagaaaatgtggtatatatacacaatgaagtactattcagccataaaaagaatgaaattctgtcatttacagtaacacagatgaaaccagaggtcattatggtaagtgaaataagccaggcacagaaagaaaaatatggcatgttctcactcatatgtgggagctaaaaaagttgatctcatggaggtagagagtggaatgatggttaccagaggctgggaggggccaggggaggtgaagagaggttggttactgggcaagaaaatacagttagatagaaggaataagttccagtgtttgatagcacagtagggggactatggttaacaataatttattgcatatttcaaaatagccagaagagatttgaaatgttcccaaaataaagaaatgatagatgtttaaggtgacggacatcttaaatatcctaacatgatcatcgcacgttatatgcatgtaccgaaatatcacatgtaccctcatgaatatgtaccattattatctaccaataaaaaatcaaaatcattaactttttaatttttttttttttttgagacggagtttcgctcttgttgcccaggctgaagtgcaatggcgccatctcagctcattgcaacctccgcctcctgggttcaagtgatgctcctgcctcagtctcccaagtagctgggattacaggcatgcgccaccatgcccagctaattttgtatttttagtagagacggggtttctccatgtttgtcaggctgatctcaaactactgacctcaggtgatctgcccacctcagcctccccaagtgctgggattacaggcgtgagccaccgtgccggccaactttttaattgtttatgccttttggatcagcaattccatttctatgaattttccccaaggaaatgatcaaaacatatgcaaaaacaaatacaaatgcatatgtgtgtgtatatatatgaatgctagttgttgcattgtaatagaaaaaacaggaaacacatgtctgctaacagagggtatttaaatacattataatacatctggacagtctcatgctatgcaaacacctagtgagctgtatctttatgcagtgatagggaaagatgtccataatattttattaagtgaaaaagcaagttacagaaggatatatgcaagattttatttgtcgttaaaaatctccatgttttaaaacccactggaagatgagtcccagccacaccactgcaaggcttccttaattggtccaatcatctatttattagagtgagtgcaatacagttcctgcccgcatggggggaaacaggctgggaggagggccaggggcaagtaagtgctaggaggggaaatgggagggggctgggcgggcactgtggggaggggcaggggttcccaaggcaacgtcgaaatctccaaatacagtgggcctgacggggatgacagagaggctgaagagacagagccgtcctgcacagtccaggcaccaccctgccctgccactgcctggcgggcatcttgagctccagacccttagcctctccgggccccccagttttttccgggtaagagactcgaactgatgctctctaaggattcttcaagctctgaaattctctgctgacatttgccagcagcaaggttgactcgaatctgaaacctctggggaaagtgggggcctctcccagaatggaaccctctctgaacactttcccgggagggaccttagactgtgctgcctgttgccagcgtcgcaggcaggaggagcgcagtcactatgggtggggtgagtgcatgggggagggagtgaaagagcaaatgtccaaggaagggcataagagaagggctccagcaagaatgcaaaggaagatttgtctaaaatggcttttcaaggcggtcatgagcttgcctctaacccagcaaagcgtgtggaagaaacatcggcagtgagggctcccatctctcatttctcaaagagccgagactttcagcgaggccacttgccattcctggtaggtaatcagatcgctgttaattaataaagctgtcaggtggctcgtcctctctggtcattagtatcctttcagaaagagaatcctgccatcaccgccttgtccgcccctccgcttgccagcaattaacttaatgctatgcaaatgagaggctcttctcatcattagcttatagccacgaatgttaatcgcataattgggtcttcaacagggtaattagacacgatttcctccattagtcttacaaggctaattattgttgagcggagagggggactgctcccagggctccaggcgaagaggggcatctggttaaagcgaattcgggcgcatcgtccgccaggtaaaaacagcagtcgcgatccattgtcacagcccactgtccccacccatcgtggggaccgggctagggagggaaacggaaccaggggaaggcctgggggggtcacactcgtgccccttgcctgggtcctgggatgcagacaacgtggcatttaaaagtgaaagcggaaacaaacagcagccccgccagcccgggcccggaggcccagccccgcgccaagggccacccctcggcgcgctcagcttccctgggcctctgctgcttcctcagtgccatgaggaccgcgctcgatggcgtccaggggcctctgggtttgactttcatggctatgaatctcggaatgaataaagagcccagaacgctggctggggtagggggtggggcaggggcgaggggacaccctgtggaggagcgggctgggagcgcgggggatgcccctcgccctgcacgcgcgccctgcccctggctgtaacctgagcagcccgcgtgagggtcagtggtgacttccgggattgaattggctgggaagccggtcccatttcaacagagacctggggcagcgcggtgggcagcgggctgggccgagatcgagaccgggacaaggcagggaagagcgggatgggtcggccccttcaaggggagccctggggcgcagtgtggggcggtcttgctccctgttgacccccattccccctcccctggatccaggaacccagtgggctctggaagcagctgctgagtgcacggcagaccccctggcatggggttacaccttctctcaggcccagcggtgtgggcctccccagtcagggagatgcttcccccatctcatctcagtggggagggagcagctggtggcctcggcaaacgcagcacaggagatgggagggtctggctgagcagggggcctcaggaggcctctgggaagccagcagggcaggtgtggacttagtgccagggtgacctgaagactctgcgctcagcggctcagagcacaggagtccagggactccgtctcagtccgagtccgtctccactgccatgatgtgctgtgtgatgagggcaagacactcagcctcttggagcctcagtttcctcagctgaaaggttcgggtgatgcaccctttcctggtcttgctggaaggactaggagggaagaggtaggccaggtgcacagcccagggcctggccctcctgcccacaggagacaagagactatggaggaaagtgctatggcagatggtggtcaggcttacactgtgagaattatgtccctgtcaacagaacgggccaggaatcatgcacatggcagccctctctggatgtttttacgagattctgtttatgaaaatgtgtcgccttccctggatcgtacaatcctccatctttatatgcttaagcccctaccacaggctctcaataaggccattaaggggtccttcatggactgaaagggcgcctcttgtaaagaaacaaaccccaaggtgtcacttgattgaaatgtgaaggcagaatgaaggtaagctggagagtactgggtctccatccatctagcatgttctgactgcaattcccttcaaaaggctcaaggctcccaccttgttatggcggtgtggctccattatgaatggccagggccattgacaagcagcgtcgtgtggtgtgaggtcaccagaggggaaaggctaggacggagcttcctttcagagcctgtgtatcagtctgttttcacgctgctaataaaaacacacctgagactgggtaatttatacaggaaagaggattaatggactgacagttccacatggctggggaggcctcacaatcatggcgtaaggcaaggaggagcaagtcacatcttatatggatggcagcaggcaaagcgagagaacttgtgcaggggaactcccccttaaaaaaaccatcagatctcatgagacttattcactatcacaacaacagcatgggaaggacctgcccccatgattcaattacctcccaccaggtccctcccacaacacgtgggaattcaagatgagatttgggtggggacacagccaaaccatatcaccccagaatgctcctgccaccaccatcaatgagaggagttgctctttgagagctcactgggtgttagactctggtgattcccaaatttttcttcctgaactaccagactcatagcccgctgcagatgttgttagggttgaattgtgttccacaaaattcacctgtgaagccctcacccccagaacctcagaaggtgactgtatttgaacacagggcctttaaagaggtggttaagttaaaagggccctaaaaggtgggccccaatccaatctgactggagtccttctaagaggaggaaatgtggacacgcagagaggcacccagggcacacgtgccatgtgaggatgcagtgagaggcctcagaagaaaccaaacctgctggcaccttgatcttgggcttccagcctccaggactctgaagaaataaacttctgttaagatacctcatctatggtacattgctgtggcagccccagcaaaccagtagatttctaagaggcatctcaagcttatcatgcccaaaactgagctagtggtccctcctcaaccccattcctccagcctcctcctctggtcatcacaaggccagtccattcttcctgctgccccagcaagcacctgagctctctgcaacgcctctctctctcacatgtcctacatccagtgtgatagcaaatcaatggtaccaattctaccttcaaaagacttctcaccacctccacagctaccaccctggtccaggcctctggcacctctcacctggattactgccaacagccctatacctggcctcccagctgctaccttgtccccctgcctacagccctttctccacccactaggtatctttttacaacatcagcgggatcccatctgtcatttgctcaagccccacacagtggctcccacatcactccaaggaaaagccgaattccttcaaggtctatggtctcctgtgacctctgacacctcacctgcgagtctctccctgatctatggccaatggcctccttgatgttgctcagagttgccaggcacattcctaactcagggcctttgcactgtagttccaggcctggaccactcttccctacatctgtccatggctcattccctcactccatataagcctctgctcaagcatcatcagaaaggccttccctgatggccctctataaacataccaccctgtcctctccagccttcctggatggccctctataaacacaccaccctgtcctctcccttccagctgcccgtcttccctattcccctttatcctgttttattctccatagcacacaacatattatgcatctggtgtttatagactttctcactccaaccagaatgtaagacacctgaagcgtcttaggttttgtttccttttgagtcccaagaactcaagtagtgcctgcatgcaatcgatgttccacaaatatttgttgcctaactgaataaagtcattgccatgttacatgggaggaaaccatagttcagagtgacaaataccctgaccagcatcacacagcccatagatggcaaagccaggattccaacccagttgctgacttcagaacctctttcttaaccactgtcctattatgctgcttcccatcacgagaaaaatatgtaaagtcttatggaggtgcagggcaagaagaggcatcaggggaggcttcctggagcaggtggcatttgagctaagacttgtaaaaagataagatttgtatgaaatcccatggtgttctgaaagaagaaacaccatgagtaaaaactccgtgtttaggaaacaggaagtgggtaggtgtgctaaggtgtaggggggagacgggagtggtagataggaaagagaggaagcatggggcccccctcttcccttggcttctggatgctccccatttctccttctccccactccaccttctactctgggaggggctcctggcctggcagaccttattgggatgcatgaagccttgccctatgacctagaatccacgctcctgagacaggcccaggagagaaaaggaggcacaatgccagcgcccctggatggacactgtctcgtggccagaatggggtgggggtggctctgaccctcctgctcatgggggggttgggggtggtctggaatctgcagaaatctcaaagccaacaaggaggcgatgcctggagtcttacaatctcataaaaagtaaggctgcacttctatttgtggaagacttttcttaaaagtttttttatatattaaataatttctgtgatatttaggaagaagagcttcaagcttttagacatctgccacctgaatctggcagaggctcaagcttttaaagcacagtgccgggttcagcagttcagcactttagttatgcctgtaaggaagatggaaaattgaagtacactctgatgtctcccgaagtcccctatgggtaaagaaaaacaaatatgatttctccaagtcatcttggtgtctctgtcctcttgcctttctctgggaaataaatttaagtgaacggtcgagcatcgcgcctgccaaaaatgggggcgtctccatcagagctcgattcaaatgccaactaccccgggctctgttctgttaaaggtcacctgtcattgtccacccgaggcatggagattgctttggagctctgatttccatggcggggaaggcatgtttatcttctccaatgtcttattcaccgctggcttaggccgaactgttaccggttgagtacaacccactgggcccctaataagagcttggaatccacaggagggaaagaaattgagatgcgctttgccaatgaagagttgtaaaccttaaaggtaggcaaagagaagtcttttcaggaggggaaatttcctgcctgtgaaggttctcagacactacagcaggaaatggagaacagtcatccctttgtctccaaaggacatgtttacccagaatgctgtgctgagagcaggggatggcaaagggaccctggaaacctctccctgacctccaagagtcagcaggaaagttgaaccagcaatgcaggctggactggggggctcttagaaagctcttaggaaaaaatgttaagtggtaaataaactgagtttcagtatactgcagtgagactgtttgtgtctgtttattttatttttatttccttttttatttttttgagacggagtctcactatcacccatgctggagtgcagtggcgcaaccttggctcactgcaatttccacctcctggattcaagcgattctcctgcctcagcctcccaagtagctggaattacaggcgtgcaccaccatgcccggctaatttttgtatttttagtacagatggggttttgccatgttggccagtctggtctcgaaccactgacctcaagtgatctgcccgcctcagcctccgcctcccaaagtgctgggattacaggcatgagccactgtgcctggcctcatgtctgttttaaactagcaaaattactcaccaagaaaagaccacacagagcccttgctatatggcatgaccccatctcttcctcaagattaagctccctgatagaacaggccatctctccatggctccctggaagcttcttcccacctaccccaggtaccatgcaatgctccctcccaatcctcggctgcctcttggggacagcacagccatgcctgcggttgcctaggcactctctctgcagaaattcactgtatttttatactcagaaaaatccatgaggctgcaggcagagttcacaggttatgtacattttttgatgtcactgcttcaaaagtaattgctcttatgctctcaaacacagacaacacacctagcaacaggctgtcataaactaagttttaacccgagaaagcagcagcaccggcctctcctgcatttgcccacatcatcctcactggactgcctcttacacaaacattggaaataagtggtaaaatgtcaatggtccccaggcaggaaaataatgggagaactttcctttttccactccagttctgagtttatttactgagagattaaaatgctacaactctaggggtggtgggctgctggcctatcaccaccattactggccacaaccttgggctcgagcccaggggtgcacctccttcttaactgcaggccggatgacccagccaccgcctcccttctgacctcaaaggaggctcagggagcaccctgcaggcctgggccaaattccgcccacagggtagcactcgcttttgctacaacaaagcacgaggcctgctctgagagtcccgagagtcctgttggtcagagtgtgctgatgctgagtgcaagtggctgtgagaagggtggtggtgaccaagctggtggcacaggaaggcagcctgctgtgggggcggtggatccaaaagcatggatgaggccgtccctcaaacagctgtgccagcagagctctgagagtgctgcggggccgccacgctgcaggatggaagggctggaggatggaggacctttgcttgagctttaatctcttcaaggccacctccatgagtgtgcctcgatcccaaaagatgaagagctcagagttaggacaggccagtgccttctcatcccaccccaagacaggagaagacgattcacagggctctcttcccccagctttgaagtcatggctaaaaactcttgattccccttcacgggcaatttactaagcccccaccaaccacttccttatccggcttccacaggccatacttggggccaagttctagacaacctgggacagcctctgtgctctggagcctccaaaattatttaaattagccacattagacccctggttccatgggggtctcagatatgagtctgatttcatccttgtctccttgcaagatcatcctcctgccccgcgtgtcacctggtggataaggaactgcctttctccaactctaccccgcaaagccagcccaggggaagcaggctgctcagaggggccagccacagccacaaaatcttgcgactggtattttggtgaggaattgggttgaacgtacttctcagaagctctgatctccacagaaaggcacagagccctcaaaatattaggaataaatatggtcacacgggtggagcccctattggtgccagttgtgcccagtgcctccccgcatcatcccattgaatcctctcacctgatgccccaaatcccactgtccctgatttttagtcaaggaaacggaggtgcagagaagctaagaacttgcccaagtagaagtagatcagagacgagctgcttggactccacaccggtgttccttgcccctgctgcctccctggctacagactgagcctggctctctagcaaactcagatttcaactttgaatctgttgacaacattatctcagttgtacagagtattttccaattcatcattcccacccatacatattttcccagcaaatatgtccattagcccagcaaatggtgggcggggctactactccctttgatggttaaggagacttgaggcttagaaagggtaagtagccgcctgtagacaacttggccagtaaagcagtcaagcagggctgagggaaacagttgtgaactatcaggaagctctgcgagcaaggaaggaaacttggggtgcaagagagatcgctgccaaatgtttaaagaaagagaagagcccagaaaaggcaaggctgtgggtcccacccccaacacacgccccactttctttttcacccttgtccaccgacactgtggaaacaatggccattccaccaaagctgcccgatttgaggcaaaaacctcaatccccaagtggacctctgtctcgaggtgcgaaggagcgcagcaggcctttgctgcatcacggcccatgcgacaaaatcagaatgatgtcaggtcctgttgcagtcagctgcatgggggcttccgttaggatgggccttctgttaggcggaggctcgcagcaaacccgtctttaagaaagagctttcttccaagagaaaaggcaccatggcgcacacagtcaatgatatgtattccagcccatgtctggtaaactctcggatgatggcagcaaggcagggtcacccgggttctattagctcaattaatgaggagtaagataaggctaacaccctgctcgtcgggaggctcaggcccagagctgcagtaatggagttattaaccttcgtcagccactggattttgctgctgattccaactccatttcctagttcaggcctccattaatgggctgtttattatccatagtccgcataaggatcagctgcagaaatagtgcttcctggaaggacccgtgataatgaaagagagagagagtggggcgggcaagaaaccctctctactttgcattttaatttttctttggtcctactgctgtcctcttaagaaattacagcatccttctcactttggaccatgttagaaatgacaaagtcattatccaagggtttcaatgtgttgtcccccaaaagaaattgtcatacggaaataaattacatcaaattagggagctctggcctataaactatatgccaatctggtttttaatttcataatgtaccaccatattccatcgtttaaaattggacataattgaaacaaaaaaatcaaaaccacatttagcagaataattttataaacattggtaaatgccctgattaaaaatttccagtttgcttcagtttgaattgaaaaaaaaaaaatttccagttttcttggctcgatggggtcctgaacaaaagggcaattttgtctttgactattttggggtcattcgccgcatgtgttaccagaagaacaggctaccttccccacttccaagccaatgagaagaacaggctaccttccccacttccaagccaatgagtgtctttaaaatgtcttccatagataaggaaagcaagcaggtcaccattagagaaaaaatatttttaaaattatttgtaccaacccatagtgagtagatgcagcaaatactctttgagggtcatcccttcaatatttgccatcttagcctctttgtattgagcaggaattcagcgtcacatggggaagtgtcatagtaaatgtgtttacacttcttaacatatagacaaatctgtagcatcctatttgggggctgtgtgtgctttatttatttatgtatttattcattttcggagagacaaggtctccttctgtcacccaggctggagtgcaggggcacgatcatagctcactgcagcctctgattcctgggctcaagcaatcctcctacctcagcctcccaagtagctggaactacaggtgtgcaccaccatgcgcggcttagcgtgtaacttgttatgtgagaacaggcgagaagacaaactctcccctacacatttgaataagagtcggccctgacaggaggtactctgggcactcacgtgcagagcaggtcatagccattcacagtatccgtacagctctttcaagctatcaaccacatgcacacatcctccatctactctccagagcagtagtgctgtgaggttaaaagagtagagattattgtcccatttaacagataaggaaattgacgttaaatgtgtcttcttcaaaccagctagccaacagagaaggataaatgcaatcccattgcataaaggatagaatttaacagttcagagcaaagagttgggttcagggctggccccttccatggatcttacctggctatgtggcctggagcaaggacatggcttctctaacgctgactgccttttacctgagcaaacctcctttactgggctgttgaatggatggaatcacataggaaacaactgcataatcagcactcagtaaagaccagatatcatcattattactcttgttgtcaagataatgctgattatgaaggaggagggggcagaagagagaaggaggagggaaagggaagaagtgtcctcaatggacgtgatctgggaacaaagtgggaggggctgtttcacggcagtcagagaataaaaggagaatgaactgaaagatgaagaaggagaaagagaaaagcagagaggaagttgagaaaggcagagcagagatgccctgtgcaaagccatggcagttttgtcctcggaaatctaagaagaaagcttccagacctgaggggacaggcttggccccagcagactgcgctgagtgcggaagtgacagccccttgtgcctgggggtgggtgtctgccagcctccctcccctcggcagctctgttctctctggctttctggaggaaatgtctgtgtggaaggtctgtttagcaaaagccaacaacaacaactacaaacccagcaccaacggggagccatatgcaatgagaagagacctgtcactgcctttccagggacaactgaaaccctctgggctcctctggatgtgggacacacatacccatcttatttaaacaacaataatacataaaaattcagaaaccaccacatcctcaaaggaacctatatagcagtttccagtttgcacaaaatgacctggcacccaaatgagctaatcagaaatctcattcttgggtggtttcctgagagtcctaaaatgcagtccaatgaagagagaaaaagatactccagaaaacaacaccaagattaaaactccctgctaccattttgctgaatgtcattgccactgactcatctagaaccctccttttacatccttttccggggatttctgagatagcatgaccaagaccttgtgggggagggttaaggtcacagcttgccctgccccctccctccttgcagcacggagggaaaggaggatgcaaaaaaacagtgggtctcatacacggcaaacttcccaacatcaatcagaatcctatactctttctctgtagtaagcattaattttaaaagaaaatactgtgctacaagcttgcagcatgaaatgaattattttacagccaggcagagggcaggtttctggatgcagccatgaacatagttctttctttgtttctttctttctttctttttttttactattattattacgttttaacaaactttatagcccattttatttgttctgaaataactttttttccttcttttcgacagatcaattacttggtttgtttcccttactgtatgatgttggaatcaagagattgatactgctcagtggaatataatttagtattatgtgccatgggtttatgaggtaggagtcagacaaaacattgcatttgaacactacccatttattagctctaagaagagatttatatttgacaaggagacaatagctttgttttctgataagccaaagaggtctatttttgtgtccaatacactgagtagcttacccttccccgataactctatttactagtgtgaatatattttaataataaaattgatatatatgtaaatttattttaatctaatttcattgaaccttccttaaaaaaagagcctttgtagattttcatatctgaattatagatttctgtatcgtattcccagattgatttctaggctataattctgtcaagatttcctcctggtgtcaaaaacagcaacaccacagctagagtgttttataattggcatcacaaccgaaccagaattacagtcctgatagtcatcctggtgctaggtggattcattttagaatatttctctctttcttagcctgtatctgaacttgaaggtttacggctaagattactttctgagttaatcataaaaatgtttaactgaaagctaaggtgctggagatggaagagacagagatgagaaaggaggaaggaaaatataccttcaatgactacgaaaggatgatcaacagcagcatatgattaaatctacattgtaaatcaagattttttgttcctgcctgtccttcgccctagggtcaaataaattaaattggcattctttactaagtctttagaacgtgattttcactccgtggtgaacggaagagtgtttccttgcaaccctgccctaaatcaaatcggttcttgaatattcctcctgtgtgcttttcctccctgtgttggtcctgtagtactggtgcttgggctcggtaagtaaaacagtcatttttccccccaggcttcagaaaaccagcacaggattctctcccctgacctgttaatgacaccctgcccctgccttctttaaagtgattgttctgcattttccccagtgcgtttcatcttcacatagctgatgcgctcacaaagaagctatgcaggctgggagcagtggctcacgcctgtaatcccaacactttgggagcccagggcgggtggatcacctgaggtcaggagtttgacaccagcctgaccaacatggtgaaaccccgtctctactaaaaatacaaaattagctgggcatggtggcacgcgcctgtaatcctagctacttgggaggctgaggcaggagaatcacttgaatccggaaggcggaggttgtagtgagccaagatcgtgccattgcactccagcctgggcaacaagagcgaaattccgtctcaaaaaaaaaaacaaaaacagaagctatgcaactgatgctgtgacattaaccacgtctgtggcattaactatgttaggaagaacagagggtggacacttagcctttgggtactttggtccctggaatttcacaggaataacggcagtaaaacaggatgctcaggttaacactatcagatccccgctgccctgggcctaaacaggtttcagtcttccaatgggaagctctgtagcccaaactctagggatataattcagagttgaggagattctaactttgggaaaggcagaataatgcctgcccccaactccaagatgttcacctcttaattcccagattctgtgaataggttatcttaccaggaacaaggaactttgcagattggattaagttaaggactgtgttgatatggtaagattatctcaggttatctgggtaggcccaatctaatcacatggctccttaaaatctgagaccctttcccggcgctggtctcagggagacatgagtacagaggaaggatgggagttgcactacggcctctgaagatggtgggaggggttgtgagccaaggaatgtggaagcctctagaaggtggaagaggcaaggaaacggattttgccctagagcctccaggaaggaatgcagccctggcagtgccatgatttttagaactacagaatttgaagacaataaatttgtgttgttttaagccaccaagtcagtggtaatttatgatggcaatataggtaactaatatgccaactcacactattcttagacaaacaaccagcctattcaaaggtaaaggatttacagaatatatccatcttgggacccagttataggtgctaccaaaaaatggaaggaaaggggcataaaagttaaaaaaaaaaaaaaagagagagagacaatgaatacctgttagaaaatgaattactccaggaaacataagaacattttagataaaaccttaccagaatgttctaaataatttaaagagaatggactccatgatataggaagtgaaagaaaagatgatgagatttttaaaaaggagatgcaaagaaagctcacaaaatgaaggaaaaatgcctaaggggaaaagtaaaagcattatggaaacaaaaaaacaaatgaaaaacagcaagaaataaacacagcagaaaacagtcagttaccatgaaggtcagagtggagaaaataataccaaaaagagtaaggtaaaagccaccagcagaaaatccgaattatgaaaagctgatgataaatatctaacacacacataattggtcttactgaagaagaaaaccaagcaaatgaaccagaaaaatattaatatatctactggaagaaaatcatcctgaaatactgtaagtgaaagggttcctaatgtccagagaaaagtaataaggagaaccaagactgagctatggcctggtgattgtaaatgaacttaaagagaaagagaagggggtaggggacacagacagaggcagagagacagagagatctcccgaacacccaggcaaaagaaacacatccataggccgggcgcagtggctcatgcctgtaatcccagcactttgggaggttgagggggtggatcacctgaggtcaggagttcaagaccagcctggccaacatggtgaaaccctgtctctactaaaaatacaaaaagtagctgtgcatggtggcacacatctgtaatcccagctactcaggaggctgaggcaggagaatcgcttgaagtcaggaggggaaggttgcagggagctgagattgcgccattccggcctggatgacagagtgagactccatcaagaaagaaagaaagaaaaggaaggagggaaggaaggaagagagaaagaaagaaagagaaggaaagagaaacacatctggcaagatgtcagaggctgtgcagaagggatttggaacactgagggcgggggaggagcttggggagagaaagaaagaaacatgatcaaagaattctttgccagatgttgtttacaagtaaaaataacagaaagacattctcaagtatgcaaaaattcaggaagtttagtatctatgtaccctagctgaaaatgaatcaaagacataatccattcaaatgaaagataaaatcaaaattaataaatgaagaggttgaaatatataaacaactggtgttgaaatcttaatccagttttaaagagaataaaaactttgtaagtatagtaattatagttaaaaacagaatataattgttatatttctagaaagaaaagcttaatcaatactgattaaaaacaataatctgtgtataatagactggcacagaaaaatttcaggatatgtctgtccctggctcccccaaaatggagaatggctggagaagggggatgaggaggcagtacatgtgggatactctttttttttttttttttttagatggagtcttgctctgtcgcccaggctggaatgcagtggcgtgctctcggctcactgcaacctctgcctcccgggttcaagcagttccctgcctcagcctcctgagtagctgggactacaggcgcccaccaccatgcccggctaatttttgtatttttagtagagacagggttccaccatattgtccaggcaggtcttgaactctggacctcgtgatccacctgcctcggcctcccaaagtgctgggattacaggcgtgagccaccacgcccaaccgacatctttcatatgaaggggtcaagatattctgctgcatttcaaaatcaacaaactgagaaataaggtttaatcaagtcgtgttgaagagactattagaactataaacagattatcttctaaattaacggaagtggggcaggtaagaagctaacaataacaagaacaaaactcaaaacacatcccataaagaaaagatggaaaacaaaggaaaccataatgaagcacaaaataaagtaagaaaagcaaaaataagtgggatagactcaactattcaaggaaaaagtcatttcagattgaagaaaaaatatcaaacccaatttcattctgtccacagtgaagacaacatctacgggctccacccatgcatccagagcttccatatagctttttagttgtgtcatcaacaaaaaataagagaagcaaaatagttgaaagtaaaacttaggaacatgcaaatgtaacaaagaaatcagagtttgaattccagataaaaatggcttcttgaaacccgcaccagattttgtttcttccccaaatcccacagaaaaacgataggaaaggcactttgaaaacctaacctacaaggacagaaagaacagggaagaagaaggcaatcagacaaaggtttcgatgctggaaagcagacttgaaccagaggcaacgagctgaggcggcctcagaaagccaaatcctaaatcagtagtaggaaagctgagaatcaacctcatcttccccagaaaatcctcaaaaggctcaggcacaggtgccacctgggaactggtggctaaaataagggggcttggttgaaatttgtttcagaagagagtgagtcctagatcccttcctcactccacccagctgagtgaatgtctctcctccacttgggaagaaattaaacatttattctctagagaggataaaatacaggctctttgggctgaagaatgccaagcacagttgagagcctgagtctatggtaaacacaggggaattaagtaaaagtatgcaaactgcatgcagtatgtgagacccctcccctgcccttcccagtgtcctgcttctcccctggacccccagagagggggtcctggcagcaaggcctttaccctccagcaggagactgcatgagtcctctctggggaatcggagcagcccagaggaaaagatctaaagatgttgacacttggtgggagggttctgcacaaatggcccaattttatcaccccaatgataccaccctacagtgaagactaaacctgtgggctctttccatgcactcagagcttccaaatcgctttttagtctcccattcttagacgtgagcaaacaaccaagggtaattcaacatctaagggtaaaaaaagactctgctgagaaagaataagaccaagacaaacaaaaattcaatagaaactggttatgcagaaaggaaaaggaaaaaagcctatctccccatcctcctaacaaaatcaaatatgtcattaacattttcaagagataaaaaaaccatgaaataagatcaagaaactataaaaggaatattcagaaaacaaaaagctcttgaatattacagaaataaacaaacccaagagcagaaattagaattcaataaaaatgttggaagagaaagttgaggaaatctcccagaaagtagagccaaacaaaacaaaaagcagcaactgaccacacacacacatacacacaaaatacaagggaaaaaagatatttttacaacatttagaagcccagtcctgaagatccaatacccaaataacagcagtttcagagagaatagaaaaaaggggaaaaaatcattaacaaaataattcaagaaaatgtcccaggactgaaggacacaggtttcaagattaatttctggtacggtggagtaaatctgacctataccaaggatataatgaaatttcactgtgaaatttcagaaccctggagacaaaaggaagagcctacaaacttccacagaaagaaaaaagtcacgtatgaaggctcaggatcagattggcattggacttcttagcaacactggaaattcaaaattccacgggaaaatcatttccagcctatagtttctcacccagccaatctatccaacaagtatgaagatagaatagacactttcagatagaatagtagggcccccaaaatttacctcccatacactgtttctcaggaagttactgatagatgtgttcaaccaaaacaaggtagtaaaccaagaaaaaggaagccatgtgatatagaaataaaatatcgaatatgggagaggggtaaagagaatcttcagtgtagtagtgaaaggcaatcccaaaatgattgttgtgtacaggcataaagggtgacttcttcaatttagaacacatgtgtttccggtgtaacagtccactgcttttaaatcatctttttaacttgggaagcaactagaggttatgctttgtcaaatcaagggggtatataaaaggaagatgtgtaactcaggaagtagagactccaactcaaaagaaagccaaggggaattcctctgattatagtaaagaaaagcccctgatgatcaactatgcagtaagcctagaaaaaaaccagtccaaacagaagaggaatgggagtgaccaaaaaaaaaacaacaacctgaaactgacagattacacaatatgatggactttgtgggaaattgttctgaaaggctattatgagatgtggaaataattaactaataggtacaaagaaaactagacaagtgaaaaagcaagatgattattaacttcaggaaaatcaaaaagaaaggaaaggaaaaacaaaaaaaagctaacgccttccagctgagttagattccttaaagcaggtttcctggaaaaaccacaaaattgtatgcttgtatctcattagccagaacttagtgttgtggctccatatagctgtaaagaagactggaaaatgggatcttttattttcagacaccaaagtactcctctgaaaattgatcttttgttattgaggaggaaagttagaataaatgttggggtagataattagctgtctgtcactgatggtcactttcatcaagaatacatttcacaatgaacacatagctgacagaaacctttatgcactaaataacatagcaccaaaacacataaagccaaaactgtaggaaacacaataaaaattagtggcacaagatattcaaattatgttaatatatttaaagacaggggaaaggggtgattttctaagaagagaccaattgcacaagaaaagagagaaattcgaattgaccaaacaccctgaacaaaatcaatcaaattgttaacaagctacctctgccccaaagtgccagatccaaaaaaacagttactgcctgagttttaaaaactctctcagatatggagaaagaaagaaaatctacgaaattttcacatcactgatactaaagcctaacaaagcacaagaatgtggaaaaattctaatccatattatagatgcatattaatgcaaaaaaaaatgtagccaatacaatccaacagcatgttaatttccttgtgctgccaatatcatattatgacaaacttagctgcttaaagatactcaaatttggactgggtgcggtggctcacacctgtaatcccagcactttgggaggccgaggtgggtggatcacaaagtcaggagatcgagaccatcctggctaacacggtgaaaccccgtctctactaaaaatacaaaaaattagccaggcgtggtggcaggcacctgtagtcccagctacttgggaggctgaggcaggagaatggcgtgaacccgggaggcagagcttacagtgagccaagatcgcgccatgcactccagcctgggagacagagcgagactctgtctcaaaaaaaaagataatcaaatttggctaggtgcagtagctcatgcctgtaatccaagcactttgggaggctgagatgggtggatcacctgaggtcaggagttcgagaccagcctggccgacatggtaaaacccgtctctaataaaaatacaaaaattagccatacatggtggcacacacttgtaatcccagctactcaggaggaggaggcaggagaatcacttgaacttgggaggcagaggttgcagtgaacagagatcatgccactgcactccagcctgggcgacagagtgatactcatctcacaaaaaaaaaaaaaaaaaaaaaaaaagaaagaaagaaaagaaaaaaagatactcaaatttattatctcccagtttctgtaggtcagaaatctggtatgggtctaactgggcttaggtcaaggtatcagccagagctgtagttctcacctggggctcactgttggttgaattcatttcttctcacattttccacggcccccatctttgagccaccaatgctgtgtcatgcttagaaatctctctgacttcctcttctgccctcagtcaggaggaaactctgcttttaagggtttgtgtgattattctgggcccacccagatagtccaggatgacctttctattttaaggtgaactgattagtaatcttaagtatatctgcaaagtcccttttgtcatgtaatgtaatattcagacgcatgacagcagggggcaaaggtcctaagggtcaaaattctatctgccacaagcagtagaataatattccatgaacgaacaatatgccatgaccaaaccagttactataggaacaaaagactggcttactaatattaacataatttataataccaatgtgtcaaaaaggaaaaacaattttaaaggatgctgaaaagctcttgataaacattaactagagattttaaatcacggagctatacttctttttttttttttgagacggagtctcactctgtcgctcaggctggagcgcagtggcgtgatctcagctcactgcaaactccgcctcctgggttcacaccattctcctgcctcagactcccaagtagctgggactacaggcggccgccaccacgtccagctaattttttgtattttttagtagagacgggtttcaccatgttagccaggatggtctcgatctcctgacctcatgatccacccacctcggcctcccaaagtgctgggattacaggcgtgagccactgtgcccggccaacttctttaacttcatacaaattgtatgcacttcaaaccaaaagccagtagcaccttaatgtcagcagtaccaggacagcccttatggtcaggaaaaaccaccgtgtcgatcatgacaccctgttctgaaagtaccgcccaacaagagtaaaatgaaaagtataaatattgaaaaggaagaggcaaaaggatgagtatttgtagatgacatggtcatctacctgtaaaacccaagagaatcaactgaaaaactatccaaaacagtaagagggtttgagaaggtggctggggtataaaataagtaagccaaaatcaatgtcttttgtatactcttgaaaaacccccttagaaaatatggaatgaaaatatcttattataatatcagtaagaagaacaagagataatatacctagaaataaaataaaaaatgcgagacccaaggaagtgttgatattttcactagaagcaaagacagaatatatccatgtcaaactgtaacggattgtattagtccgtttcacactgctataaacaactacttgagactgggtaatttataaaggaaagaggtttaattgattcacagttccacatggctggggaggcctcaggaaacttacagtcatggcaaaaggtaaaggggaagcaaggcacatcttacatggcagcaggagagagacagagagagagcaaagggggaggtgccacactttaaaaccatcagatctcgtgagaactcattcactatcatgagaacagcatggaggaaaccgcccccatgatccgatcacctctcaccaggtccctccctaacatgtggggattatagttcaagatgagatttgggtgggaacacagagccaaaccatatcacagatcaatttgaaaatctaaggcaattccagctaaaatttcaatggcagtttctttttgtacatgataaaatcattatagtgctcgtttggaataataaatatataaaatagacaataaagaagatcaatgagagggccttgtcctgcattgactattgaaatacagatatgacaaaagtaaagtagttaaacagagaggtactactgcagaaatagacactcagaaaagagaaagttcagaaacaggcccagtatattgagagactaaacacacagtttgatgatggtcagaccatatataaaaagagaactggaacccacaacctgcagcaacctgcccggggtgtcagaccacaatctctgcagcaatcagccccaaaggaccaggacttgatcaggaattgacagcttccctcatttttgccaccatttgcaaggtatgaccaaccagagaaagccaaatatgttcccttaaccagtcacacaggaggccccgcctctagttaacccacccagcttccccaagccaacagcctccaactggggcatggtagaaccgaagcctttcccaccttccactagaatgctgtcacctccgctgcctgcctgtgagcctctgccaaaacgccaagcaatggtggctgaccccttgctattgcaagctcagactaaatagcctttgcttgctttcactttggtgggcttcactgctctccacaatatatacaattgtgatgagctctcaagttcaaactagtagagggaagacagaacatccagtgatattcaacactctgaacaaatggttaaccatttggggaaaaaataaaagggggactcatactgcctactcacatccaaataaatatcagctgcaccaaagatttaaatataaaaatgaaactgtaaaaatagtagaagaaaacatccattgatttgtataacaattccccaaggaaggcaagactggtatttattactgttttacagatgagggtccatcaaggagggtgaaagccaggatttgaacccaagcctgactcctagtccaccgggcagatgggatgggtgggaatggggatgaccaggagacattccacttcaggaacacgtgaaggcttgtgtaacctggaccccttcagctgagccctggagagggggtgcccaggggcttggccagggctgctggcttggctggggcagctcacctgttgggattgtagcccaggcggttcagcaggtgtgcctggtcgaggtcccgcgggacgccgtgtagcacccagcctttctggatgcagtcctgctggtccaggcgctggctcagcaccttcatgaggaggctgtcaggaactgcagagaaggggggcaagtgagtaccctgctggccggcagcccatgggtcctgggcttcctaactttacttggccatagattgagctgctgaagaagtgggtctaggtggagccacttggaaccacttggacaaggttgtcagtgcctatttcccaggtccctcctcggtcccagcaacggggctgcgtgagatgggaaatgcactggctgaccttgacctcggtctttccctttcctggacacgacaccatccccacctgcaacccagtgagatgtgagcagattgtccccctgtcttagtccatttgggctgctatagcaaaatcccgtaaactgggtgtctggggagtctaagatcaagtcagattcagtgcctggaaagggcctattttctggttcacagatggtgccttcttgcttcatcctcacctggtggaaggggtgagaagtctctctggggtctcccttatacgggcactaatcccatccacaagggcccctgccttgtgacctcatcacctcccaaaggtcccatctaacaccattgtcttggggattagattttaacatatgaattttgggatgacacattcagaccatagcaaccactatgggcccagtttttgcagcaaacacttttcctggaagcgcaccagctccagctgcagtttcagttttcctcaagtgggactgtgccagcgcccccaaagctctctgccagtctgtgatgcgctagcaacgcccactcccctttcccaaaattctccaattctcccatccttgatgcttagaacgaagtctctcccaagaatcacagaactagttataaccaaagactgaaataaagtcctaaggagaatgagatattgagaagcctcttgtttacattgcggcaattgacattttcctgaaattcatacgtctcttcccagactcattaaatgtcctatgttgctaatgtactgcgttctagcaatttgcactgtgtttcctgcactttgcactcatttttccagaaatacttggtaaatattaccattgtttgctatgactgtggccccattggaactggttcctaggggtgtggtggcagtgagtttggcagtttctctggaagctgcctggttaccctcctaccgactgcccgggggtctggcaagcgggcctgaagcacacatttgaaaccttccacagggccccccaggctgacagccaggtgaacgtggaagcaagagatgcagaaaaatcactgccagccgttttccctgtggccgtgacttgctgggttgctgcccttgtcaccaaaaaaccataaccctaattctaagcagtctgcatttccctgaatgtgttctctctcatgcccttcagcctttcttccccagtccctaggaaagagcagaaaagggtttttgctttaacgagaacatctggctatctagcatgaatgagaagtcacttcagcgaatcccatcccttcccctgcttcaaacctgcaggggctccccagtgctccgaggataaagagcagtctcctttccaaggcaaggtctgtgccctgccttcctcccaggtgaatcttgccagcttgcacctcccttcgaacgtgccacctcctccatccggaacacccttctcccacatcttgcctgggccagccttcaaactcagcctcagggccacggtgtgatgttccctccccagggaagtctctgaggacagcccccagcctgcacttctcatcctccctcacttgccacccttgttatcacaaagatacttctctctgggtgattctttctttaatgtctgcgtctctttcatggatgggtcccataataacaaagaaccatgtctctcccatttttccctgcctagaaagatgtctggcacatagtaggtgttgaataaatagaaggcttctctttttcaaatatttcaaaagtaatcaactctgttaaaatcaacttgaccagactttggggaagccaggttgtagacagaacatgggcttggggcattcacaaatccaggtctcatctcagctcctccctttcttgctgcctcatctccaggcagtctctcactctctgagcgtcagcttcctatctgctgaaaggataagaggacctgttgtgaccggctcacaccgcatttacgattctggcacacagccgacactcaaaggtggtggctattacttttcaattcaggagatgtgtgtggggaagtgatgcttcacgaatattttcacggttgcctgtggtcagggcgtgccagcaaagactgttggcacctgggataaaggatgacagattaagaacagccttggaagttaaagacagagacctccagagagacttagggacctctgcctcgagacatttgtttacattcaaagggctgtaaacctagtgacctcctcctcctctccccagaaggagtcggagtcagagtcggttccttccagagtaaagctcgggagggagctggcatgttgtcttgcataagctccaagagtcacagtgttggggctcccctcctgctatagaccccctgtacactcggggtgcacttggctctttccacattgcctgtgaggaactggggcgtggggagccagctctgagattactgtgtgaaagaatttggtctgtcctctgatccagagaccttgtgttttcttgccaggatgaataaataccgatttaaaacaatgtagggtaagaatctgccatagagccttccagtccaggtctacccttaatatttacagatattttcacggaaagaagaaaccaatacagaaataatcctatccccacgattcacccagtgggtagttgctgaccatctaggctgtgccaggcactgtgctggacatgggatacggtctacgcagcaagcctgactgccaaggcccccgggctcctgaagttcacgctgtctcggggagacaaacattacccaggtaacaaataaccatttctaagagtcatgggtactgtgaagaaaatcaaccaaatgatgggaggctgatggtttgaccgggcctaggacggctactaaggaggccgcatttggctgagatcagaatggtggatcccgctaataatccaggcccactaaggcctccattgtttagcggtgagaattatttggaccaaatattttctgagtgtcatctctaataatcaagtatggcttggaaacccagctgcactgtaggtggtctgacctttggagccacagctttctgagggcctggaaggtcatcccattgacctcttgtttcaaagttaggaaactgaagcccaaagaggttgtggtttaagtgacccgcccaaggtcatctagccagctggtgatcaggctgggataggaccctgatccccggcccataacacccccaactgttctgctgcctcattacccaatggcctggagcccctgagtccctcacattggccacttacgaaccaatacaaagtttctcaactgaggagaaatctgactcgagggaaaaatggaaggccagatagaaatacaatgaggtttttgtttttgttttttctgttagttgacaaagatttctagagagaatttcccaacttgcatcaaaatttaaaatgtacatgtcttttgacccagcaatcctatttctaagaacttgaacctaagaggggaaaaagatgtgtatacaaagatgtccatttcagtgttgtttacaatagtgacaactggaaatgatctagaatgtccatcaatagaggacagattaaatcaaagaaggtacatctctgcaatagaatattagacaaccttttaaaaacaatctctatattaacttgcaaagttaatatagacaggtcgaggcagaagtctatgacagaatgagaaaaaagcaggtaaataaacggcttgtatacatggtctaatttaaacatatattcatatgtgactatattaatatatacacatacatacatgctacacacacacacacacacacacacacacacacacacacacacacacagagggagggggaagggtggccgccacttcacgctccatgaatcggactcaagcccttgctcatggagcccagggtggtggaggtgagagggcacccggatgtaatgcaacacaaacctggcaggaaagcagaggtcacagaagtaggaagtgctggggatgtcggaggcagggagggccaaatttccaaaagattgaggaagaaagggaatgctcacgctggttcccactttgagccaaaacccaaacaaacccctctctgcaggaatcaggaaacacaggctctgcagccagcacttcctggaagggctcatcacaagcgcacatcagtaacaactgatgtagtatccacttaatacctgcattcccaccccaatgcccaccccatgaaagcagggatccccccagtagggtcaggctcattgctataccccagcacctggcacagtactgggcccacggaaagcatctaataaacacgaaggaaggaaggaagggagggagggaaggaaaaaagggaaccatttccaaaacccaggaagttctttagttcctcaagcgttcatgggccagagaacttaaggacttttctcaccaagcactgaatcaggtcctgcggcaacagaaaataaccaagggagacgcttcctctcagtcgttccattcatctctacgtgatcacccactcgtgaattaaatatgcagccaaaagaatgagcactagcacctggggtttgttgggaggggtctctggggtaggggagggtggttctagatgcaacaagggtggccacaagcacgtgaggttcattatactagcgatggctcccacaggttcattattctattctctctgctttttagatgtgtttaacgttttccactaaaaatgtgatttttttttaaaggaaaccatttaatgcttaaaacagattgaaatggcccctgtgagagaccgttcctaaagtgacaaaggacacaatctcccccgaaggccatgggcggctctcccttttgggggacctgcagtttgggtggcctccagccgtcctgtaactccaccagttccggaagctctgcccagaagcctggcatcacgggcacttgcccacatctgcctgtgttagcagtcctgcgaaagctcctcgttcgagtcctttaaccttttataaggaacagcaacacattttggctcacagttcctcactggggctgcgtggctaaggaactgcactggtcctctcccagcgcacagggatcctggatcctggtagggctctcccatctgggtcaagacaagcaacagaccccactgggtgctgctctgaggctaccgacctttcccagtcagcatctctcctcagtggcagcacgcagggttgaggagtgaggggtgaaccctgaagaccctgcctttagtgtaaattccccaaacccacccatgtctcctgtcccagcctctctgaggctcggtgtctgttttgctgtggcttgtttggattttcctgccagctatggactcacgtttccagccccacatggtctgactggccagctcagcacaaagctgagaacaagctgctccttggttcactgtgctctgccagaagtttcgagtcctcttgataatgctgtccatttaccctttctcctcctctcagacagagatttttcagtgcggtctaaagtctttcaccattaagtcagatgcctcaggcttgatttctgggcttgacagttaacatctcacccttcatacaaagctaccgccaagggttacctctctggagtgttctgtcagccctaaatttagccaactgcaagatatgagtatctcattatttcataaggccacaccacatggtttcgtttgtttttttttttttttttctcaagatcttccataaaagatggcagtcctcaagttgacctccaggttattaaaatctcaatccatttattccccgcggggctgggtgtgcttggcccttggcatgggggtagatggggatccatggtggcaagtgggatgctcccaggcctccactccccaccgcgggcccgtgtcccaccctcctgtctcgaaggggaaggagtcctgtctaaaggcccaggatcccattgggctccctcccgcacagcagttccacggctccggacaggagtcccgacacccatgagatgcaactgggcagcactgactcctcccgggctgcaggtctggcttcagtcaccctcggtcacatccagctccagagctgatgggtgtgagtagggaagggctcggagagagcacccaggccagcttgcggttttccagcaggcaccagaggcccctcctgctgcgccacgccgccgcctgctgtccgcaccgcagagccagccctgcagggaccttggctttctgcccatcagttattgttgagggagaagatatgagggacactaaggtttctggggctggcatataaagataggacaaaaagtggagagaaggaaatagctccttcagccagtggcttaaagataaaaaacatgctaaggttgattgctagactcacgacaagccatgtgagcctccttggcaccctagggcaaacaggaaagagctgagtgcctccccacacacccttgcacatgccctgcacacgtcacccctccatgcacactcataaacgcccccacacactacatacatgtctacacacacgacacctgacacactacaacacacacaggcacgcacacacacagacatgtgctcatgcactcagctacaaacacacacacacacacaccacacacccccacacccctacaccccaccacgtgcacaacacatactgtatacccacctatccacacatagtacacgaagcacacaccctcattacacaaacacatctagcaaacacacctacatacctacaccgcacccacactgcctctcctcatccctcacattcgcttcaaactgcccggtgtaacttctttccttcttcaagccctccttgaaattgatgtcaagatgagcatcagtgttcatgggggaggctggcatttgcttctctttctcctgtggtccctgggtccctgggtcccgcccctcctgaaggatcccaataggacccaggaggtccagggaatcttacaaaaggaacaggactgtggaggaggaaaaggggttgcttttggttttgttttttaatttccatttcacacaacctggtgcctgaaagaagcggggctcgcatcccgccaggggctctactctaggctgctgggaggtttgcccaggccctgacttaattcaaggaaagccgaacgcctcccatctctggaggccatcactctcgggatggcactgattcccggcagctgggcctgcaagcccgtctcgctgccgtcaccagaaatcctgcgtgccctgaaggccctgcagcgccccagtgccaggacctggcgccaggtgtttctgttggtgatgccgtttgtttgttatttactaccacctgctggtgaaacatgggttctgcatcccccaagtgaacgccgccagcaacgcacagaacatttccaaaccctggagaagagaatgaggagaaactgggattgttccatcggccgcaccctgcaattcctaagggagggtaaggccactggatctagcttgctctttggtaaactcaagtcaattgccccagacaaacccccatctggccgggccttggttccccaagtaggagatgaaacagatgccttccatggttttcttagacgccaacctttctactctaatatctctactgcttaacaacgtttaaaattgcctggcagacaatggcgccaggaaataacaatgtgttaatactggattttctttcaagaccagagaagtcagtacatcagccctgggtgccctgcagactaggaggccatgttgtgcccctcctcccttggagagggccacccactttctgtcactctcttctttaccatgtctactcaggcaaaaggcaaagacaagactgaggtgcccacacggcattgacacagctacctgaggggcagagatgcccaacagtgaatatttcagtttgtccttttttttttttttttttttgagacggagtagtctcgctctgtcgcccaggctggagtgcagtggcgcgatttcggatcactacaacctctacctcctgagttcaagagattctcctgcctcagcctcgtgagtgactgggattacagaagtgcgccaccaggcccggctaattttttttgtatttttagtagaaatggggtttcaccatgttggctacgctggtcttgagttcctgacttcaggtgatctgcctgcctcggcctcccaaagtgctgggattataggcatgagccaccacgcctggccagtttgtccctttcaaatgaagttttaggtgacaaaagagaccattcaaaaatagacattcttctataaacaactggtacatcacttagcaaattagtaaaacttctctattggaaatgctcggctagccacactgtgcagaatgatttgacaatttttattttaaagtacatttttacatctttcaatggaatatgaaagtatctgggaaaatgagcagaggtcggccagtctgcatgtgaactggattattttaaagagtgatgtattcactaagtgtacactgcagatcaaagcatttaaggaacacgattttccttccattttaatgaattcagggcttagaaccagttttttctcccacatctcaagggcagcaaggatgccatagcccacgaaatctgggagaagaaagtcagcagcaaacagaaccatgagcccagttttctgggagggaaaagatatgatagtatattgactcaccaagcatgtatgctacagtgcatatgatgagcctggccctgttctaagcatgtctttgttctaatacaaatattaattcatgtagttttctccctatgaaagaagtagtcacagtatcccattttacagattagaaaactaaggcacaggaagaggaagtgacttgcccatggccatacagctcacaggtagtggagcttggatttgcatccagccaatccagctctggggctgcttgctgccacctgacttttaggaggacgagcactgtgacgatgaggactagaggcccaaactctgccctgcgctctgcattccacttgcagcctgcctttgggcgactcattttacctcctagccaaggcttcctcctcttcatggggacaaaattgggctccaaagccacggaggtattggtaggcccctgtgtggcacccgatgtcgcctggggatccagctcctgagggctgcttaggctgtggctgcctcccaggcacgtggtgcagcccatcctgaacaaaactaaaatgttcacatcaagccttccccggtgtggtgtgggagattaaagatggccacgccttctttgctactcctcccagggcagggggcgggaggggggcggtgtctcaatcccctccctggaacctgggctggccccagtgacaagctctgtgaacagattcagacagaagtgtatcctggggtgtctgtggtgaagtcatgggatgcctggccgctggccccaccttccaccccaaccactgccgcccttgaactctctggagtgcttgtgccaggagcagccagacaccaagtaagaaggcaggtgaagccagccccacggagaggctgtgaggagggaagatgcctggccagccccagccattccaagcgtgccctcccaggcaccgggcatggcgatgaagaatccgtcttggacacactatccctgcagatgcaacgtggagaaaaaccaaggaatcaagctgacgccagaactgagatccagatgtaaatccccgggtgagccagcccagctctcttaggcagttcaaggcatcccacctaagcccaagtcagcacagagcagagtcgagacctccttgccatgtcctgccccaaaccctgacccactaaatcaggagcataataaactcagcgtcattttatgccattaaattggggggtagcttgttaggctacaagagatacttgggggacatacccaagactgggtaatttataaaggaaagaggtttaatggactcacagttctgcaaggctggggaggccttgggaaacttacaatcatggcagaaggggaagcaaacacgtccttcttcacatagcggcagccaggagaggtgcagagcgaaggggcagagcgggggaaagccctttataaaaccatcagatcttgtgagaactcactatcacgagaacagcatggaggtaaccacccccaagattcaattacctcccaccgggtccctcccatgacacgtgaggattatgggaactacagttcaagatgagatttgggtggggacacagccaaaccatatcacggagcatcagagtaatgcaaactggagctttgtcagttcccagttaccgcagggactaggtccccaaagctggtagcagtcatgggaaataaataaatataaaaaatcccccatatataaaatatattcacacccgacaggacttgctgtgagtaccattactaccactaagatgatgacgatggcaactccattcttgataataatcatggtgagtaatcagtgattacaaccagtgaccatagtaagtaattagtgaattacagacacaattccctttatatagagcaagccaacaaatgggatcctaggaaagctcgccttacagatgggaaaactgaagggagctctgagggggcgcatggcttgcccaggagcacagctgggaggaagcagagtctgaatgggaaccaagtctgtgtgattctgagccacggcccctcccatctgggagtgacagtcacttgcctcccttctagaaatccttcaggctgcatgctgccccctgtgacctgtctcctctttgttccttcaagactaattctctgggccgggcatggtggttcacgcctgtaatcccagcactttgggaggccgaggctggcggatcacgaggtcaagagatggagacctggccaatatggtgaaaccccatctctactaaaaatacaaaaattagccgggcgtggtggtgggcgcctgtagtcccagttactcaggaggttgaggcaggagaatcgcttgaacccaggaggcgaaagttgtagtgagccgagatcgcgccactgcgatccagcctggggacagagtgagactccatctcaaaaaaaaaaaaaaaaaaaaaaagactaattctctgaagccactggggctgcccatggagagggacctcacccgaatagaaatgcaggcagcagagggcagcatctgggccctgggattgtccacaccacagggacccaggtcaactgccacaggcttgctcttccactaaactagctgagctcctaccatgagccctgcgggagctgactcctcagcccttgaagcagccggccgagcagacagcgtgagcagaaacagggggatcctggggtagggaggtcccagatgaggccatctcatctcccagtaaaaaccaaccaaaggctggggggaggtcagagtcctgcaatcaagatcgtggatggggtaaatcagaggtctgcagtgaggggtgaggagaaggagttccccttcccctgcctcccgcatcccctggcttccacaggctcttcccagggaggggggtgggagcaggtacatccctctgtatgtcaggaagtctcttccctcgcctctccccctcccgtgtccctctgctcccatcttgcttcttctgtcgggtgtgcccttgtcacccagagcagcagcgacaggtgtgaagctgcagggcgtggtccccgcttccctccctctatgtccgatgaggctgtgccaagttcccttgcacaggaaacctcagagccagcttctggttgacaaaccccagcaagtcccacctccctgatcataagtgtagaggctgcagagggtcactggggccacctcttcctcacccctcatgtcctgcccctgcctctgcaggccccgctcacagcccaatgagaaagaacccgtgtcagctcccgtcaggcgaggatgttcccagagggaaagaggcttcaagctgcacctgccgttggggggtctgtgaggggcaggagcacagctctagccatgccaagggctgcccagacagctacactgagagacctcccgactggagaagaaggcccggggcctccagggtcaggcctgtcagagacaatttcacagctgagcgcactggcggtttgctcttctctgaagccgctggggctgcccacggagagggaaacgcttctagaagctctggtcagagcaaggatgactctgtgcactccggctctccttggacttcccagaaatgtcagggttgggttgggtttcttttttaatctggatgcctgatacacagcaacacttgacattcagcccaacaggaaaatctggctgtgcccctatggtggctccagccagtgacaaggaacagcgctaagcaggccagacctacccccctccggcagcgcccattcttcttggggagacaatgttgtcgaatggatgcatgaatgaatctggcatcacttactgcctcagtttccccactggactagccattgagcaaaggctttttgatcttttggtgacggggctgcctcctggcaaagcatcattttcataccggagaaagacaaggcacactttcaaaatcaaagtctagtgtaaaaaaaatcaaagagaaggaccctcgggggcacaaacctgttgataagcaaaggtgctcacccgcttcctctaactgtgctcattcctaggccctccagcccccacaatgcaaacaacgcttttaccctgccactctgcttggctatcttggccacagctttctctctggctgaaaaagactcctacctagtttccatgaggaaatctttgtagcagtcccagcggaaaagtcaaaagtttgacttgaaaaaaggagctacttcaaaagcattgtcagaccgaggtgagggttcctttaaaatgcataaattacagggggcatccattaataaacctctaggccaccctacagcgggggctctgggttgggggtaccaaagggacagaggccaacacacctgggggaggcaacgcgaaggaaatccacatagaataagagtaaattaatgtgtttattacttactgcttggcgtgtgtgtgtgtgtgtgtgtgtgtgtagaaaaatgaaagaaaaatgtagagttttttcaataataaaaagggagttgcactgcggggcccctaaagcttgtgaaaaattaaactcgacggattcaaactgtcctatttccacttcaaaagagaagaggcactgagctcttcccaacttatcttcaaacgcccagcaccctagaaagtttctttaaaaaaataaaggctcctgttcccccaagcactgtaccggttactgtacccactgtctctccctcttctaattatacccctgtgagtctattaatcaacttgtaaattatttagagagtcatgcgctgtcttcagcgagtacaaacacaccgcatgcaaaggcttgctggaaacgggcagagggtccctcagggtctcccctccacgggaagacagcttgcagctggccgaggctgctctgctaaaaacaagaaatagcattccgcttacctcctcagatggggagatttactttgtctttcaactcagcaactctttgcaagtttttaacaaaagagaaaaactggtctatggtcgatctttagtgtgcatttagtgatgagaatattaattcccccttaaaaatgcagcactttggctgagctctgatccacacctcctgggatctggactcacggaaggctcttgaaaacacatcatcatcccaattgggggctggtttggcttgtttgtattacgatggctgcatttgctagggtgaggtctcattaccagaaagggtgcaaattagcttcttgaaactctctcaaatctcccgccttttctcgggttctattaggccatgagggacctttcccagacagaaatgtttaggaaatgtagggatgtgtgggaggggcacaggtaacaactcgataatgatctgtcttccacatcaccttttctacataccaggactttcgcttttaggggaaagtcattaccaattaaatagctgtcttccctcctgacaataagaaaggaatatgtctggtatgtgccaaggaatgtgggccttcctacaactgaactgctttagctgttgggagatgctggggggggcggggccacaggggcagctgccagttaggagctcaccgtaactgggccgacgagccagttgggcaggtgttgcagagtgtatgcagagacaggagatgtgaaaagctacagtctagctcagaagccccactgctggggacatggcatggctggcgggctcctgaccatgcagttccagcatgttccgagtgcgctgtggacaggctgagatgagcatctcatgcacttggagcaaagacataaaccagcaaggacaagatctgcctttggctgtttttcatctcctccctggataaccaccctccagaggaagtccaagcaactcatgagaacgagaacagttccttgggccagggcagaagccaagccttctggctgaagagccggcgttgtaccattcactgggcccggcaacctggaagtaggttatatccaccatcaacagtccctggaccctaatttatggctaaaattctcatgagaaaggctaaaaataaagcagtgcagacttcagacttctttatgttgggtgagtttgaacaacagagtgaggcccatgagcagggctcattttatattaagtgaaaatcgggaagcgacattccaagaggcaaagacagaattatggccaatttccttaggaagctctgggcctccagaattcagaaatttcaaacacacttcggtaggaatggagctatggggaaggagctgaggacatcatttggcagtggtggccactgtgagccaccgctgatttaagcaaagaactgagatctagtagcgcctttgcttgagttcagagaggaaagaggacatctgtacacatgctgtagaacacggtggcaatggagtccatcagcagcaaccatctcattttaaatgatacagaaacagctgagaacttatttttccaaaagcccagaatcgtttttacttgttttgtactagtgtaaaagtgacaggagctccctggcaactaaggctgcatgatttaagctcgaccctgtttatcgtatgcagagcaaactcctggtgactttaatggaggttgcctgcataaagaactccacgtgcggagccctggggaataaatttgttctgttcactgcagctcaagtcagaacgagtttagggggtcagacctatatatttcaaagtccaggcacagaataagcatctccccagtcctctgtccacagtgccatcaccaagagcctgggatcaagggactgaagatgcgctaagatggggccctggggtcctttgcccagtaaatgtggaaagatgggaaaacagtacagttattaattttgctgctgattcgaaagaaggaggtgttggcagcacctgtgaggacaaaaaaagaacataactaagtctgcagaggtcacggctgggacataacatcatgaggcctggagtggggataagagcaagaggctgcacggggaaaagatgacatctggctctatttggctgagccagtgatggtggtgatggtgactgtgagggtggcagggatgcacaataacaaaagcgcacatctctggggcacgcagctccaaggtgagtggagagaaagcacaagtctgcaatggcaggggtcccagtgaaagaccagcagaaggccagcagccgggagcacaggcagggcggagtccccagggaaggaggtccagtacccaccagggcaatgagggggtacccaggaagactctatagtgcctggcttggggagtggtggggatgggctttctgcactgggtggctagatggtagggtgttctggcagtgacacctgcaagctcagagatgctaggggcctctgccccatggcgatgaggtctccatgtctttacaataatctcacttgctgagctcctgaaccttacagatgaaaactcctaacaggcaggggagtgactgggtgctttcctatgttcccaggaatgccgctggcacccaggacagagatatctgaaacagacctaggattgaaaaggggaatctgggatgtctccaatgactccccaaaggtatatgggagagcaccaaccagcagctcctcttctggaagttctgaaagcctcaggggatacagcagcatgtcctccagtttcaggaggcagggcaggtccttctggttgcagggcagtgttcggaagctgaattccactgttcccttcaccctgtggcctccctcttccccagagcagggagtcactccacgacaggccaagtccctccggctctcccatcctcccgctggcaggcactggcccacagtgcagaggaatttccttccacatctgcctccactcagtcagggctcttcctggggcaagcgtgggggcccatctccctgtccccaccactggagtatggccatacaatgggtggtttgtctccaggcctggcctccaaagggcacgttaagcccaaatgtgacctgggttctcagccacattatccattctatgctctcagcaaactctgaggtctgtctcctatcgggttcagaactcaggatgaggggaagggatgtggttaatcaccacccctcaagcccaaacagtggggtacacctgcaggctaggggacccctaagtcacagatgtcaccaatgctcaattcgggaaggagggggcctcagccagctgggcttattcataaataagcaggctgtggtcggctaggcagagtttccctgttcagcctgaccttcccttcaaaaccaaattctgtcaagaatcatttaaattttcttcctgtttcagctggcggtgaagtgggtccctgccagacctgggtggttccagcgctcctgctctgcgagctgagcgctttggttttctcggcagcttctccacagcccactaatgagaccctgttagtggttatgaatgtaaatgcattctttgttatccctgcgagatcaggattagtgaaatgacagaatttattgcttccgttagggagatatgatattggttgttgttgtgtctttaattttgtaggaagagcgaaagtatagaggtacatagtctaaataaacaaaaagctgtggaagaaaaaatttagcatgaaacattgaagatcgaagtgatccgggtctcgctaactttatagaaaattgggaattgtgccgtcagcctcctttgcatcccccaaataacaaaaaacaaacacaaaaacgactctgcgcctggaccacctttgaaaggactcttgggtttgcttttagtggtggatgaattaagccggctctgtacaaagttgacgtgctttgattcaagcaaattcatttctgtctctcgaagaggaagtaacaataggtcccatttactcaaaagatacagtttgaataagtcagcaaaatggtgcccatatctgatgattaattaaggatctgtaaacgcccaactccctataagacgaggaagataagactgtgctgtcagatggtgaggagagaggagatgaggaaaccaggaggccgagtgctccgtgacctcataaaaaaccaacatcctcatatgaccttcttggcgaccgtgacatcccacgatgcctgagaactaaagggccgcgatgagccactgttctctttccaagcaattgctaaaactacaaaattataacgtgacttgaaacagagataaaatatagaatgtaagtataaagaaaaattaatggaaaaacgtaaacaaccctaatatgcaaagagcactgacaaaccaattaggacaaaaaattgcttaactggaaaatgggcaaagggaaaaacagttaataggccagggctatagagaggtggttcacaaagataaaacacacgtgaccaattatcttatgaaaatacgttcaactttaccaacctcaccgacaatcataagaccacaattaaaaataaatacatcttttgtcacataacaaagtggcaaagattcaaatggctggccatggcaggcagaataatacctcccaaaaagatgtccacatcctaatcgctggcacctgtgaatatgttccctgatatggcaaaaagggctctgcaaaggggactaaattaaggatctggagatgaagagatgatcctggatcgttctgggtcatcccaagggtccttataagaaggaggtaagagggtcagagtcagagagggaggtgtgatagcagaagcagaagtcagagagagagagattggaaaatgctactctactggctttgaagacagaggaaggggccacgagccaaagcatggggatggcccccagaagctggaaaaggcaaggaagtaaatcctctcaagtgccccaggaaggagcacagccctactaatacctggatttcaggacttctgacctacagaactgcaagataaatctgtgttgttctaaaccatgacatttgttatgaagtaacagaagacaaatacactggcagtacccagagatggcaaagacaggcagggaatgagcattcgcacactgatggtgggagcgtatggcagtacagcatcaccactgccactgttcatgggcatcactgctgactcaggcctcagggtatcctaataagatcaccagggatgtttctccatacaagagtgtgcattttagtattattgaaggactgcaaatctggaaaccaccaaaatatttatttttgtaattttatattttgaaaaaaattcaaatggacaaggaagctgcaagaagagtcaaagaattcctgcagacccttccctggtgttggccgattggcactacctcagctgcttggccattgtctctgtttctgaaccactatctggttagtggggaattaaattatcttccaggcatactatggaatactactagcaacccttgaaactatatacattaggttaatttggtatcacattcactcatttttagggtgctaatccccatcccagtaaatgggaatttggagagaaatggagagaaattatgcttgaggatgcaacaggtactccgccattgctgctgcttgctactgtggctttttttttttttttttttttttgagactgagtctcactctgtcacccaggcaagagtgtggtgcaatcttggctcacggcaacctctgcctccccggttcaagcgattctcctgcttcaacctcccgagtagctgggactacaggcgcccaccaccacacgtggctaatttttttttttttgtatttttagtagagatggggttttgccatgttggccaggctggtctcgaattcttgagctgaaaacatccacccgcctcggccttccaaagtgctgggatgacaggggtgagctaccgtgcccactgggatgacgggtgagccgccgcgcccggccgctaggtggatttgaagagcagcagctgcctgtggcctcccagaccctgtgcatgtgcatgagggctgctcctcaggacgaccttgcaggaagggacctctacctccatcctgccacccggaagcctggggcttcgagaagggcagggtggtttattggtgccacatggctggtgggggcagcgctggaatctgaaccagactgggaagcataagagctcgtgctggttttcaccctccctggtgcctcctacatccacctcattctgtggccaccgcagacacccaggaccagacccactcactgccctgagcctacacagatcacctcattctgtggccaccgcagacacccaggaccagacctgctcactgccctgagcctacacagatcacctcattctgtggccaccgcagacacccaggaccagacccgctcactgccctgcacctacagagatcacctcattctgtggccaccgcagacacccaggaccagacccgctcactgccctgagcctacacagatcacctcattctgtggccaccgcagacacccaggaccagacctgctcactgccctgagcctacacagatcacctcattctgtggccaccgcagacacccaggaccagacccgctcactgccctgcacctacacagatcattgcgtctgacggctcctactccacacacttgaactccaccccgcggactaggacatcttaaggagggacttgggagggctggccaggacatctcccggggaggcccaagcagaggatggctgggaggacagagcctgttttcatgtgcttcctcctcatcaacctgctccatctagaaagtggtaggagaaggccacaagcttccaccaggaggattcctagccaatgcccgcactgctcactataatggcagctgcttctggaattcattttcttcacaataagcacgtgttcacaacagacttgataagtgggtgtgcactgactgcagggaggagctgcagcatgtgcaggggaggaaggtgtgggtgcgtgagtgggaaattcactgccccagggaagagacagatgcaggatccccagaagcccagccgccaactggctgtgtggcctcagcagctcagtcccttctctgaggctccttcgtggactcaggaagcctgactagaatgctcccaaaggtgcccttactgtgggtcagatcctaggaaagctttcagactgtggatcacagagggcacctgggaagaggatctggtcctgcttcgcctgtcaaacaggcgagcatctaactgctgaggaccaatgccggtcaacactcacatctgcaaagctgtctgaaacttctggcttctaagtgctgattaaattggaatatttgcccacagtatttttatataccaaataataaaggatgtgggggcaggaagtggtggcttacacctgtaatcccagcgttttgggaggctgaaacaggaggatcacttgagcccaggagttcaagatcagcctgggcaacatggagaaatcccatctctacaaagaatacaaaaaattagccaggcatggtggcatgcacctgtagtcccagctacttgggaggctgaggtgggaggataacctgagcccaggaggttgaggctgtagtgagctgagactgcaccactgcactccagtctgagtgacagattgataccctgtctcaaaaaaaaaaaaaaaaaaaaaaaaaaaaaaggatgtggggaggtctgtggcctctcctggctctcaattttaaatggtaccagttatgaaaagccaaccgtcttgagaaataggaacatcctaaaccatcagggataacccccccacatccacaaactcacctcactggggatcgggctcagacaccaagaggccttaccggaagcaagcagcagagcctttgcttacaagaaaacccaatttccatttcccggctgttctccccaattttgagcccctgaatgttcagagagccgcacaaaaagaaagttctctctggagcctgtaaggtcatgacagttagtgggaacgtggcctacctgccatctccttttcaaagaagggctggatgagctcgccaaacgtggtcctatctgccacagcctctttcagcagttgcccacagcagactgaaggagaggggaacagaaagacacccattaaattttaaataggaggaaggatgagaaaaaaagaacccccagtgctgcctgctgagggaaaaaaaaaaggtcactgaaaaaagcataaaagggtttttctgtgtgtgggtatgtgtccaagtaaaagtaaatatcaaaaaggagccgggaaataaataaaagagagaggtggaatgaaaaggaatgcatttggcaaagaacacattaaaaatggacggcgtggggaagacactaacgaggatgttgcccacagaggagccctgcagggcctcgctgcacctggaattgctgcgcagaactcggcgccctccagggtgctgcggaggatcagcgttctggccgggggctgctcatctctgggcgatgtgcctcaagtgcgtccacatttgcacccttgttacacagcagagggggtgcagtgtgttgcttccacagcccttccagctggcagggcatctccatgggatggtggggccacacaatacgatagattcatattccaagtgggctgactcatcattaaagggcaccatgtggctgtaatcccagctttttggctgaggcgggcagatcacttaagatcaggagttcaagaccagcctggccaacatggtgaaaatccgtttctactaaaaatacaaaaattagccaggtgggtggcatatacctgtaatcccagctactggggaggctgaggcaggagaatcacttgaacctgggaggtggaggttgcagcgagccaagatcgcgtcactgcgctccagtctgggcaacagagcaagactccgtttcaaaaaaaaaaagaaaaagaaaaagaaaaaaaggtaccacgctgcagtcacctggccagtggcggctgccccgctctggacacctgctcgccctgggcaggaacctgcctctggccccactgtgtctcgagccctgagctagggccggcacaaaggaggtgctgggcaacaagcatgagtgaataaacacaggctacctcctccttggctgtgaaagtccttcctagccaaagccagaagatttaaactatattttcatgaattgttcactgcacgcttttggctttcttacctttagggctaagaagttttctgcctatactaaggagaccaaaaaacatcctaaagttaactggatagcatgaatgtttaacaaaattaccatcaccagggattcattcctcaataatgatatgcttaattcactatgtaaatgacagcagttgtcatttaatttaatccaatgtgcttggcagcctcaccagcaaaggacatataagtgagaataaaggctgctgggagctaggcgcagtggctcatgcctgtaatcccaggactttgggaggccaaggcgggaggatcatttgaggtcaggagcttgaaaccagcctggccaatatggtgaaactccgtctctactaaaaatacaaaaattagcccagtgtggtggtggaagcctgtaatcccagctacttgggaggctgaggcaggagaattgcttgagcccaggaggcggaggttgtagtgagcagagattggcaccactacactccagcctgggtgacagagggagactttgtctcaaaaaaaaaaaaagaaaaagaaagaaaagaaaaaaaaagctgctgagaactgagacaattctgtgtgccaagcactgtgctaagtgtgctttgttttatttggtcctcacaataacctgctgtttcttaggtaaagacactgaggctcaaagagatgaaataacctgctttaggtcacagagccattaaggggcagagctggggtccaaacccaggtctgcgtgacatcaaacccatgcttagcttccagttctggccatgaaggagtaacaggtatcatatttaacttctcttatagaaagctgtgaaactgaacaaaatctatgaagcaattctttagagtcattggacaacagagagacaggtctgtaatccttgagaggcaggaaacatacaaaacgagccccatagtcatcctggatttctacctatgggcacttctcaaatcatggcacaggagaagtggagcccaaacagatcagcagtctcactgggtggaagcaacaaagactggagctctgagacggccagaatttgtagaacagggtaagggagaggaggcagctgtgcacagaaggagttccagaaatctcataggggttcactgagcctttggccaatatgaagctgcacatgtgcagggtgagactccagaggcctggtagagaaaagctactgggaagctgtgaactgaatggaaattcacacagggctgggagatgctggcattctgacaaccaaagtgacagaccctgctgaacaccccggacattcagctgagattccagaaagggcagaccttagctgcagggatactctagccctagagtaagaacactctactcccacttaacaaagcctgaaaataagcttcagtaggatggagttaatcctccaaactcaatactcttaaagcagaatggtgacacaatccagaccttcaaaaatgtgagaaacacaatgtctagcatttaatcaaaagctccttgacatgcaaaaaagcaggaaaatgtgactcctatgaggagagaaaacaggccagagaatcagatcggggatgacacacatgtcagaatcagcacaccaggactttaaaacagctattatgagtacacttaaaaccttaaaggaaaagatagttaaaatgagtgaacagatggagaatctcagcagagaaaggaaaactgtgaaaaagaaccagatggaaattctggacctggaaaatacagtatcttaaatgaaacaaatcactaggtgtgctgcaatcagtgaatttaaagacaggataaaagaggcaataggaagtagccaaactgcagcaaagagggggatgggaaaggaccggaagaaaagaaccaaatctaagagacctagaggacaataccagacagtctaacatatgtggaactgtagttccagaaagaagagaggcaggcagaaaaaagatttcagaagataatgacaggagaacttcaaaatttgattaaaaatttcagcccacacacccaagaatctctgagatccaagcagaacaaacacaaagtaagtcacacttcgatacatcgtagtcaaattgctgaaagctaaagagaaaatattaacagcagctgagggcagggggagtgcttcacatgcagggcaacaatggtaaaaataacctctgagatttcatcagaagaagtgcaagccggaagacaatagaatgacatctttaaagtgttaagagaaagaaactgtcaacatagatttctatatgcagccaaaacatccttcaaaaatgaagatgaaatcatatcattttcaggctatgaaagctgagaaaatttgtcaccagcacactttcactacaagagctgttaaaggaagttcttcaggctgagaggaaatgataccagatggaaacctggatctaaaccaaggagtgaagagtactgataggtgggtacatataaaagtctctccccccttatatcttcacttctttaaaagatgaatgactatttaaaacaaaaataattacaatatattgtagggtttataacatacgcagaagtaaaatgtatgtcaactgtaaagaagtaaggtaaatggaaaaatctactgctgcgaggctctgatatcatacatggtgaggtgtaacattcactcaaaataggctgggacaagcaaaagatgcatatttaatccctagagcaaccactaacaaaataaagcaaagagatatggctaaaaaggaaatagaagaaagaaaatggattactaaaaaatacttggttaatccaaaaggtggcaggaaaggaggaacaaagaacagatgacacaagtagaaaacaaaacaaaacaaaaaaacaggccaggcttgagggctcatgcctgtaacttcagtgggaggccgaggcgggaggttcacttgagcccaggagtttgagggtgcaacgagctatgattgcaccactgtactccagccagggcaacagagcaagaccccgtctcttaaaaaaaaaaaagtgagacccaactatatgctgtttacaagacacatagttagactataagacacagatagtttaaaagaaaaagaatagaaggtatatcatacagacacaaatcataagaaagttagagaaacttcattaacatcagacaaagtggacttcaagaaaatgagtattgctagagaggaaaagcaacatttcctagcaataaaagggtcatttcaccaataacatataactatccttactgtatacagtcagccctccatatccatagtttctacactcatggattcaaccaaccacagattgaaaatatctggggtaaaaattacgtctgcactgaacatgtagtcttttttccttgtcagtattccctaaacaatacagtataacaactgttgcatagcatttacattatattaggtattataagtaatctagagatgatttaaagtgtataggagaatgtatgtaggttatatgcaaatactacgccattttgtatcagagactggaacatcctcggatttcagtatccaagggaggtcctagaaccaatcccccatggatactgaggtgtgacagtatgcacttaatgacaaattacatgaagcaaaaacttgcagagaatagacaaatccacaattcagagttgggagattttttaaatgttgggctggatgattgtaaaaaattaaaaataaaagagttgggagagtttaacacacctctctcaataactgacataataagtagagtgagaatcattaaggacatagacgaatttcaaaatttgattaaaaatttcaaacatcttatcctaatcgatattatagaacactataaccaacaatgcagaatacctatttttttaagtacacttggaattcaccagtatagaccatatatgcaaatttcaaaggatcaaaatcacatagggtatgttcttttaccacaatagaattaaattagaaatcaagactataaagcaatcaggaaaatccccaaatatgtgggaattaagcaaggtgtattctaaatagtacacaagtcaaaaaagaaaccagaggctgaggtgggaggattgcttcaggccaagaatttgagaccagactgggcaacatagagagattcccgtctttacaaaaaaaaattagctgagcatggtggcatacacctgtagtcccagctacttgggaggctgaggcgggaggatcacttgaggagttggaggctgcagtgagccatgactgcaccactgcattccagcctgggtgacagagtaagacccgaaaaaaaaaaaaaaaaaaagacaaagggaaggaaggaaggaaggaaggaaagaattcatgctcactgtaaaaaaaaaaaaaaatctgaattgtataatccacagctctgccgagataagcagtttggtgtatggatatttcttcatgctttttctgagcataaactaacatgcttttttgaacaaaaatgaggtcaccccctggatactgctgagcaaattgttttctgcccctcccttatttagccatgtatcactgacatcaaatcactttacaggtttatttttaacagctgcctcgcaatccattacatgggtttatcacaacttatttcacaaacctgcttattaacagagttagaggttgcctctgtttctcattatgcttctgccacatctctccttacatatctgagtgttggagcagaataaactcctaggagttaaatcccagggtcacagggtttgcgcagttagtgctttaaccaacagtggctttcgcctttcagaaagtcgtgtccgtatatactcccatcatcctaagtgaggtcttctgatgaactttgtgggagtgagtgtgggggctgtctgtttttttgttggtttggagatattttcctttggctgagagattcacagatgtgaagattagaaccaggcgagcggatggccgcagcggagcagacagcacctggagctctgggttcagacacgcatttgcagagagatctcaaggctacctgccttaggtctcttaaatgggtttacttaaatctcatgacatcttgtatttatcaagaacacctttgagaaatgtgaactttctgagatagtctccaaatgcttaattatctaaaagagccccatcatggctcttaggtaacaagcaaaaaccatgatgagcttttctattttcatttttggaaaaatctaggcaggtaatttcatctcttcatggctggtgtgctgaacgcaatttgaattaaaaaaaaaaaaccttttattgaatgagagtgtctgcatcataaaacagagcaccgagacaattatttccataaagccctgcactgcattaaagtattgctgccgtgttttcagactctccctccaccgcgagtgcccctccacgctcactctgtcccttcccgtaacgatgtgggcacatgcttacgtaagcaagtgatgccgccacaggtagactgctggtcatcggaacaaagaagccatccctaacactgctggaaatttcatcttataattctcttaagaggaacaatcaaaagaagaaggaattattgaaataatttatttttaaaaacggactcaggaacattttttattctaaatgtcctgattaattttccatagtaatcaaatttgcagagtaattgttcaggtctctatcttcattttaggtgtgtgacttttgtcatggattccttgctggtctcagtggctttagaattgtaagctggaggaggcctgagaagcatttttattcaaaacttgattcttctggggtggtatatacatatatttgtatgcatatacatatatatacacgtacatttgtatgtatatacatatatgtatatttgtatgtatatacaaatatatacatatatgtatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatatacatatatgtgtatgtatatacaaatatacatacaaatgtacaaaaatgtacatatatttgtaggtatatttgtgtgtgtccatatatttgtttgtattccctctctatattcatatggtatgcctgtataatttgggggggttgtatgcatatgcatatatttgggggtgcaggtctcgtttccttagtaaatacagtagaggctacttaggtttgtggagcatggtgtgcgtaggggcagtgcttttaactcccttcaacctggcagtgtgtctctgctacagtttcttcctgattcccatccctttatcctcctgaacacaagctggcatccaagaccgcctgggaccaccccgggaaagacctggagagctgatttcaatattttctctcttcctggtaaaatatttattgaaactgtgcggagtgagaagtcttcctctggttcagaaattgtctgcctgtaaacacactgacctgggttgggggcaccaaacgagactggagaaaataaataaacagcacattcctattacgcaggagccaaggcttcaggggagatggcaggggtgagatgggagccacccctggtgtacagcacagacaaaccccccgctccaaaggatataaaaaacgatgactgaaaaatgttctgtctctttgggctgtggacatgtttttagtggttaatgtttttatggcaatattcctcgggaggaagaaaattcctgcaaagatggactaacagaaaatggttaagaacaaagagccagaaagagaagtgatactgacccttcccccccaacaccaccccccataaaatgagagctggggaggaggggcaggaggcagggaaaggctctcgaagctgggcagcccagcacctggggcactcaccattgacaagcctgtatttctgggccaggagggcggcctgcagacttttcccactgcccacaggcccgagcagcagcaccctcggggtgaacggggcattagtacgatggttgctttggacataggtcagagctggaaagagaggatatgaggataataaacccaggtcctagagaacaggaaacccgcttgcagcccctctgctttgactcttttaacggcagtaactctttttctctttcacagcaccatggaagccctctgtgcatctggcgaagaggcagggaaaagaattacgtggcaggcctgggcaccaaggcagggagcgaggagtgaagtccacagaagccaccctggagcgccgccctggattcctctcaacacaggcgtctaaacacgtgcaggtgtctgcatttccttccaggctgaactagggctggctgtgttgcagttgggagactggtcccaggacatgatagcactctctatagggctggtggcttttcctactgaatcgggctgagcctcccaaccggaagccccggaactaggctggtctcctagaagtgcacgctggctttctgctaggtgcacctgaatgtcagacacaggctttgataaacgcatccagccacatgggggcccagtgcccagggacttctaaaggactcgaattggagagtagtttgtgcagctgcactctggtgacaccaactttgttgcgactctccaaagaggtagtgatcaaagaggtcacaggagtggccagatgtagctgcatggccctggcctgtggtgtgcccctggcatttggtgaacaaagaagtgaggagatggggtgagtgtctccaacaatgaggccacctgcaccatggggggcaccggatgccaagaagccacagggcaaagctactgaacatcaaaccaggtcacctcccgctggagctcagaaacagggagctgtgagaaaaggctaatgaggctgtaaaggcagcatttcgggcacctgaggcaggagagatgcccacagatgaggcacggacctgtgccagcccccaccccagcgttcaaaacagggcatccttccccagggagaccttccccctcctgccaaggccccagactgtcctgtgcaaactcagccaggggtggccccgttacaccttcctgccagtctgcctttaccaatgtgccttgcggtgggtgccgtgctgggtgaggggccaggccatcgtgcctccttcaggaacatgccacccaggaaccaggcaggttcctcatcctcagcactactgacatctggggccagaagattctttgttgcggggctattctgggcactgtaggatgttgagaagcatccctggcctctacccactaggtgcctgcagcacaaccgcaaggtatgacaaccaaaaaacctttacagacattgccaaatatccccggggttgcggtgggggcaaaactgcccccgattgtgaaccgctgggatatgttcattgtgaaaatcctgaactctcaaatctttgctggacttttaaattggaagggtcattagagatgcacagtcccctctttttagaaggcagagatgagttagaatggacttttttccaggttgtgatcagcatcatcaatggcatgtactaattgctacgacaaatactctataggcaccatctcttttctttggcccaacaatcccatgagggttgcgttattcatgtcccattttacagatgagccaattaggctgagacttggcagagctggggcaactctcccaaaccacctgccatgggtaccattcctccactgagagaagcccaaaggaagctactcaggcgaggctctctttattctcagaccttccataatcccgtgcatctgaaaagcacaaatactacaggcaaagcagcctgcttacaaatgatgcttaatttacagtaaataactaagttaattagaagtaatgatcccccagacagtctcaacatctaattattctttttaaaaatgtgtggttgctggatgcactgcagagagattagaaaaacaacacagagagaattctgcattccaattttcaatttatctctctgcattattaattaataataattaatattcagacactcacatttttatttacaattccaggcatgaattctttatgaacgatcatatgaacttttaaatttaattaagtaatttggaagtaattaatgtgtaaattcagaatcatggcataagataaatgttgtggttgtttatcttaagagtgcagtgtttgttactaatgacccttccgagatgcaaaatcactggaaaattataagccatcataagcctggcatttcttctttaagtagcgacattttctactaacccacccgctggctgattgctcccttcagagggcgaggctgttcaatccacgccggcaaacaccgcatctccgagctcagtgtagcaatgaggtttaagcaccgagtctaccagcaggagaaggtgctgggaaagtcagcagggaagggcttgagggagctcaaaaccacttccccggcaaaacaggacttttcttggagagttttgagagaatatatgaaaaaaaggactttgtaaactgtcaagtgtcttaaatatctgtgatgttcccatcgtaaacgcttcatttacccaacactgtgtggaagggtaattttgagacgactggattttgagatactgcattttgagatgactgaagctcagcaagacttttgaaaaggataatacagctgtttggggatagaattattctaccttgcccttgcctttttgggcagggtgttgaacaatgataggagctatgacgactgatgtttattgaggcttttctctgtgccagaactgggcttgtggctgtggacacgtgatttggagaatcccatttaatcctcacctacgcctgggaggagggcacaagttttgttcctattttagcgatgccaaaactagggctccgaggagttaggagaagtgccagaggctgcacagctgggctgcgtcggggctgagatttgaacaggttgctcagctcagccatccccgcacctcgcacaggctgcccgcagtggctcccgagctgctgtgaacattggccattgctgtggacagcaacgcagtgccaggcgcggggccatgtatctccatcctaaatgaagcataccacctgtgctgtgtgtgtgtgttttattgtgttgtgtgtggtggtggtggttttgtttttgtcttaatctttatatattttttctttcctctccctcaaggtcaggctcaaacttcttgctaccatgtccctcccaccccatcccttgcctctcctcctcccgaccccacgaccaccaaatctgctgtgggccagagatgtgaccacatctgagtgtgggacattagcccagggtctccaagtggggtacccccaggggctctgcacacatgcatttctgggcagggaacccgggtcatctatgtcttgacttccagggtcccaggcatgtcccagacactggccactaccagaataagggacaaagtggtagaaggcacagcgagccccgcccttggccgtctgtccagggtggggctgcctgcttgtgtttaccctggtagaagacgtccacacatggctggtcagcactgatgactttgaggattttggggtaggagggaatgaccctgacgatgttcctatgatactccagcagtttctgagccgtctccagctctgagatgtcctctggcaccatgagacggttctggatttcagattcgggtggccagtcaaaggtggtgtgataaatctctacaaggagagaggtgcacagttagaaatggccatgcaggggccctgtgggcgctgctgtgcctggctggggtgcttgctgtcctggaggccaggccctacacattcctggggtgtggctgaccacggcaggacaccgttgctcaacaccagcacttccagctactctgagcctgctcttaactattattcttgttacaatacaagaacaggacccagggcaagggctgccgtgaacttctgagcacttactctgtgccagccactctgataggcacctgcagactcccatttcatcttcacagccatcccatcacccattaggttggtattttcatcctcaagtacagataagaaaactgagtctcaggtatcccatgtctacagccagaaagggacagagttagggatccacaaacccagctctatctgccaccacagcgtgaggcccggaagatcaagggcagtcccgtctccccccaccctcccgccagccccttgctgaactgcctggtcttcaaggcccagttcaagggccccgtcccctgcaacacctgccaattctcccaggtaatgctcatgcctctctctcctgtataaataccaaagaataaggggtgtcaagggggcacataatttgtcccagggagaggcagacatgtcccctggctcctgtgtgggccccaagcccaggtgcctggcatgaccccccacactctattctggttctgccacaagaaagtctcctcctttagcctaaacaggcctccatttcctcatctaccagaatgtacccttgccagtgtcttccagctcagagcccagcctgtggcagccttcctcgtgtccctctgtgggtgcccagagcagaatgcgaggtcaggaaatggtagacgggctgtcatcaccatggactctgaaaccccatggggctgggtgggggtggccgtagccatacctccagtttgagggtcgattctcttccccaagtttctctcgatcaggaccgtgtctggagcactcagcacaactgggcagagaagaaaaggagcaaaaccaggcatgtcgggcagcgggtgccacacatttgaatatcacagaccaatacttgctttacgttttttgcttttctgtataatgacattaaaacaacaatcatctcccatccccgtgaattcctaagagaaaggtcttctcgcacccaaacacaaagagtgtaacgttgggacagagcacggcccatgacggaaagttctgcctgttaacaatttccctcgtcacagataacgccacaatgggcatctctgtgcgcactaaatgcttgcacagcattctatgctatgcatagaatatgcatttccttcctgagacaaggaatcgccaggctgaaaacgaaaccccacttttcttaagaaccagccctgaatatatttagctctgtgaaaaattcagttgtgctgtcctcttccttgctgggtctcagacggtgcctgggctgaggtcaggagcaggcagcatgagcggggcgctcactggccaccccttggggctgcagctctggcaggtgggggacccttgggagctactcactgacgtgtctgggtgtgatccccagggtctggatcctcagagcctgctcacgcgtctcagggatgccatccagaatccagccctagacagaagattcagagaggtgctcatctgttttgagttttagattttttggaattattttaaaaggaatataatagctttatagaaagactagaacttttaagacaaaaaaaatgtttctgatagctacctcacccttctttaaaaactactttgtaatatattattatattcccttccgaatcatatcttggtgattataatcataacatatatattttacatcttgatttttttttttttttgagatggagtttcactctcgttgcccaatctggagtgcaatggcacaatctcggcacactgcaacctccgcctcctgggttcaagcaattctcctgcctcagcctcccaagtagctgggattataagcatgtgccaccacacccggctaattttttgtatttttagtagaaacagagtttcaccatgttagccaggctggtctcaaactcttgacctcaggtgatctgcccaccttggcctcccaaagtgctgggattacaggcgtgagcaactgtgcctggcctacatcttgatttttttctaccacacaatagcgaccacaagcatctcttcatatctgcacagctcctcattgtccacattatcaacggctgtgcaatgtcccaccaagagaatgtacacagccacttaactatgtccacaaatgaacatttcaactgcgggcagtgttcactatcatagataatacctcgatgaacatctttgtgcatctagcgctttccacattttggataatttcctaaagacagtttctgagagattcctgagaccagggtgaaaacaaaaccccacttttgttttcattttctgccccatatatctgcaggaacaccccatttttcttaaaaaaaaaaaccctggacgatgattccggtttctactctgcggctaacttgttacaggattgaaattcctcacccatcagccccctcttggtacagctagggaactggtttagaggtttatttttactatttatttatagagatagagtcttgctacgttgcctaggctggtcttgaactcctgggctcgagcaatcctcctgcctcagcctccctagtgctgggattactggcgtgagccactgtgcctggcctttactaactctttaaatccaattgtgaaagtaatatacaatcattgtacactgtgtggaaaatattgaaaagctgaaataataataagagtcactggtaacacctcagacccaaacaagccactgtcaacattctggtatatctccttccaagcagcaagtgcagataccttttttcccggtggctgggggttgtggggaggggaaccacactgtacacactgtttggtaatctgttcttttctagcaaaaacatttcatgaacgttttcccatgtcacaaagtgctccttgcatagaagttttcacagctgcctggtattgtatgaattgacctgatgttaactgatcccatattgttgctcatattgctcagtttgactccagttttccaccattataaacaatgttgtatatgcatctcgatgcctatcaaacatcctcagataaatttctaaaagttgataccttcttttacgacttttgatacattttgccacatcgctctacaaaatggcccactagtttatgaatccaatggcaaagcatgtttccttgcatctctgccaatgttgggcattatctaggggaaaaaaatctgtccagcaaaatacagtataccactgctgctttaatttacatttctttgatcattaatgaggttcagtattttttccatatgtttgttagctatttggatttttttttcttttccaaaatgtccatttgtgtcatctatctactttccccttggggtcgcatccttttatttattgacaacagctctttacatattaagaacgtgaacccattttggcaaacactaccacaaaccctttgaggcaaactatgttgccaatattttcagcagtttgtcttgcagccttttcattttgtgtgtggtgttgcttttaacacaccagtttgtggccaaatgaatcgctgctttcgtctttggattctggcattgtgtggatgcataaaacaccctcccccctgaaaaagctgatacatattcacttgcctttaaattgtgttcttgtgtttttactctttacatgtaaatagtaatgatttgtgtaatagggctgcattccagtgtgcgaatgatatagggctgtgatctactctgtttccttatggctcaccacctgttccaaactcacccacaatacagtctatcttttcccctctgaggacacttatcacagtctaaatgctgatacgacattggctctggcctctttctgcctgtagattgttaaattctttttatttaactgtttaaattgttgttttataagttatcgtaatgtctagtaaaatacgctctcccttcttttttttttcaaagcaagatctttcaggtaaacattaaaaatattttgtcaagttcccaaatagaaattccactgggattctggaacaacattaaatgtgtagatcaattcacgacaaattgacatttttacactatcaagtcaatgcattatcgtctcatgtgcttaagttgttttttatgtccctcagcaatgttcacaataaacaatttctaaagtcctttcaagtcccgtgagtctagagttacacacacacacacaatgtaatgctttagacttgatgtccaggtacattagtaaagggagctttggaagagactgaaagaaagcagcgagttgcttcaagtctccattgtgtaggaagcggggtcaggcaactgggagtcaacgctgggagcccccgcttgctgtagagccctccctctcagccactgggagactcagttgctctaaggtcagatgacggactgacatggacggactcagcctccaggtcactcacgtccatatcacctgatcgacagacacagtgtgggcgactgtaagagatgtctttctttaaaaacaaaccaaaaggtggtctgggtgcagtggctcatgcctgaaatcccagcactttaggaggccaaggcaggaggatcgctggatgccaggaatttcaaaccagcctgggcaacacaatgagacccccccactctaccgaaaaagatttttaaaaattagccaggcgcgttggtgcacacctgtaatcccagctacttgggaggctgaggcagaaagatccccttagcccaggaatttgaggctgcagtgagctacgatcgtgctattgcactcctgcctgggtgacacagtgagaccttgtctctgaaaaaaaaaaaaaaaaaaaaaaaaaaaggccagcatttcttccatattaaaatatttaggttcccgtagcctccactgacatttaaaaaaaaaaaaaaaaaaaacctaaacaaatttacagcctaaagactgttggaaaaatccagcaagctttcattaatttcttgaattatacaggaagactcacagccacggaacccctggtttctagaactaatgaagcaaaagtgcaaaaacaatttttaacagtcttttgctccctcaagtccttgttatagccagccaagcgccgggctgcagctcttagaaagagcaaacatctacagacgtgagcaacaccagcagaaccaggagacgcagcgtctgacagctccctcacagttctggaagccgaaccaacattttctgaactttagctaaattcatacccccttatttttccttcatttggacggggagggattgtgagcccattgattgctgcttctagtacaagggctggcaattctgttttagtccctttttgaagctggaaggttggaactccatctttgctcagcactgaaaaaggcctctgcttttaatattgcattactgagcaatcattataatctcacccataaatttgcagcagatatcagtatgtggtccaaggcttttagaactattcaggggaacagctctcactgacttttcaccagagaaagcgggacttccaattacacaggaaaagtgcagcaaaatgaggaacatctccctaattagcctggcctcactggagtgtcattctggtgcagatgtgaaaatctaaaaggaagaaggtggggggctctggagtgagccctaggccaccagctctccaggtctgctctgagctggggaaatggtacgatcacctggggactaagaaacaaggtccccgaggaagccctcgagcagcacccaggccccattagagccaccccccactgtatggagaaggcagccatggaggctcttcctctctgcgccagcccacgctggtccacactggtccacctggaagggagggcgccttgaccaaacctctgttgaaggcgggtctgtcctacggcattctcaagatgaaagctgcaggcttggggctcagaaaagatcttctttcccagagctcttgcatttaaaggggttatttgcccagctgcaaaatgggctgcacgttcacagggaagcagcaattttggctgggaggactttaatggctacaaattctggcaaagcaagaagtcataaatcagtaaatagcacccgacaactgccatgatgggacattaagacattcccaacaagcctgtgttgcgaggttcgcgggtctcacgtccaggagtggctggatgtggaggtatcagtcaatccctaattagaatacattatccatcttcctgacacttcagtgaaatgtctattccactctgagctgcagctttgttcagagcaggttaattgatattctgatgccttcgctcaccgtacccccgtggctcggttctgttttatcacacatcaaaaaggccgtatgctcagggcactccaggcaccagtgcagagctggaggtctgcacagctgcgaggggtatggtatcacaggagggacaagcactgagcagatgtcacagatgaaaaaaaagcaaagaaaagacgccagtcagcctggggaacttggcgaggcccagcagagcacggcctgatgcggcacgagccgtccggctttgtgcgaacactggcctcttttgccctcctgactattattaaagcgcaattagcaacttcacatgggaaggctctgttgccctctgggcctctgcctttttgatgcgttgcctttccgctcctcccctctcctcccaggaccagagcgtggggctccctgggtgttttccccagtcctgcctctgatctggctcgcagctccgactgcagactccaccggaggcattccctggagctgcatgctcaatctctgcagtcccaacgaggcaagctgaggctgaagacttggactcgataaatcagtttcgctcagttccaagtctgaaccagggcaagcctcacaagaggcactgcaggctgaacgcggcctaatgtggtttcccaacatagaggagagagattctgtcagccaggaaggaaatgcatcttaaaagatccagtttgggacagtgatatgttctaaagccaatcggtgagaacaatgagactaccttgatgaacataaaaaaatctgacatcacactgtcccaggagcagttactttggtttatacaaaaacataaaaaccttagcctgccacagaaccctaggatgccgtccatattcaactcacctgaaagatgactagcaagaatttttatctcaaagttgaatcccaaacaatatgcaacccctgttagcactgaacgtggaatgcactgaacacggaacgttagtattccacattccacatgtatgactgtagcaggaacccgttaccccttaacttgctctgattcctccacctgatcaaggtgaggtgtgcccagggctttgcctgacctttttctgggcagcctaacagtgattatgctcttacaacgccgaaatatgcaggagtgatttttctaaacagagttgaattccacccttgataatcaatgatacatgcgtggtatttttatacaaacgtgcagatgcggggatatcattactcctagatgtgcagcctacaggccaatgatctctaggatatgaaaacctggtaaagcccaaatgcaggcattcaagaggtgcctttttttttttttttgagacagagtcccactctgtcgcccagactgctggagtgcaacggcatgatctcggctcactgcgaccttctcctcccgggttcaagtgattctcctgcctcagcctcccaagtagctgggactacaggcgcatgccactacgcccagctaatgttttatattttttagtagagacggggtttccccgtgttagccaggatggtcttgatctcctgacctcatgatccacccgccttagctgcccaaagtgctgggattacaggcatgagccactgcgcccggcttcaagagggtttttattagttcctaaatagttaaaaaaaatttaaattcctatcaagtatctatggtgcccctgaagccactccatggaagaagacacagtttgaagaacaaattgttctgtccccagatgcaccagtctaccctagctctgaggttggccccaagatagccccctgcagagataactcactttggaggttcacatttagttctccaagtcagacataatgtgctttagatgaaagtaacagacacggataacccagcatccagggcccattcccctcaaacactttagaccatgtctgtggtgtagacccacctgtctagaaacaagattagccctggaaagtatcagtttcttgtaacggcggaaagcagtggctttggaaccagatgacctgtgccacagccaatgtgtgactttcaaccagtcacttcatcccctctggcctcattctcctctgcacaatgtgaataatcaaaatctagctcacggttgatgaaataattaaatgaggattataaacaaacagaccaggcaccgtggctcatgcccataatcctagcactttaggaggccaaggtgggaggattgcttgaggccaggagttctagaccagcctggacaacacagcgagaccccgcttctacaaaaaaataaaaaattaggccaggcgcagtggctcacgcctgtaatcccagcactttgggaggccgaggtgggtggatcacctgaggttgagagttcgagaccagcctgatcaacatggagaaaccccgtctctactaaaaatacaagattagccagacatggtggcgcatgcctgtaatcccagctactcaggaggctgaggcaggagaatcgcttgcacctggaaggtggaggttgcggtgagctgagattgagccactgcactctagcctgggcaacaagagcaaaactccatctcaaaaaaaaacaaaaagttagccaggcatagtgacatgcacctgtagtcccagcttcttgggaggctgaggtggaaggatcacttgagtccgggagttcgaggctgcagggagctataattgtgccactgcacttcagcctgggtgacagagtgggaccccatctctgaaaaaacaaataacaaaacaagtgtagtgcctggcaacaaagaaatgacccaaagttaactagttttatcattataattttgagaaaggtgaacgatcttctttttctctacctacttccaaggagtcccacttaagtttgtagaacttaatattaaaaaaaattgtttaaaaaggcaaatctctgggaaacaggagcaactggcattccaggtatgaactgagggaagatctttaattaaggaggacttggggtagacacatttctctttttttgaaactggggtcttgctatattgcccaggctgctctcaaacttctggcctcgagtcatcctcctgccttggcctcccaaagtgctgggattacaggtgcaccaccacgcccagctgggacagacacatttcaattagaatgcgggggtctagtgagttaacagctactgtggattcaccccaaggtgggctcacgccatttgccatcacttggccagctgccctctctgaggggagtttgcctgtcctctggaagcccatgtgactgtttccttatctgtataacaggaatgatgataatagtacctacacttcatagcgtttagggttacaggcaacgatgtacctaaagtggtggcacaacgtctggcagatagcaggtgcttaataaatgtctcctggcatacacaggcttttcatagttgacaactcatttgaaaaacagaccaaactcagcctaagaatgggagaacgggccaggcgtggtggttcacgcctataatcccagcactttgggaggccaaggtaggcggatcatgaggtcaagagatcgagaccatcctggccaacgtggtgaaaccccatctctactaaatatacaaaaattatctgggcgtggtggcgggcgcctgtaatcccagctactcgggagactgaggcaggagaatcgcttgaatcttggaggcagaggttgcagtgagctgagattgcgccactgcactccagcctgggtgacagagcaagactccatctcgaaaaaaaaaaaaaaaaaaagaatgaaagaatgaggagttggcccccttctgctctgcccttctgctgtgggtgccctgctagctctcgggagcagacgtggcacctctgactctctgctcagcctgcgaagagaagagtgatgtggtcagtacttctgggtccagtcccgttcccatcatctccgtgcctctcaatactctctcctgctccaaggtctgcttgcgtctgctcaaacctcaggccctgtcctgcatttgatcatctctttttcctcttctactgcagtgagagggatgatctgaggcatcacacatccacagagcatatcggaacacgcgttcctgtccacatggagtgctacggctctgtatgcagacacatgatccacacgtgcccttaagaagcccatatcacaccaaccaaccaaccacgcctcagcatcagggtctcttacagaaacacccacaaataagggggcacaggaggtgtgctcactgtgctgtgcccggcacctcaccaagccctcagaagccctgcctcgccgtgatgcgggccatacgtttcctgagtggaactcagacctccacttccaatcccctgcaaagctaactgcatctgtatttgaggaacacacagccagggcctcagcagagctgtggatcaataaaaccgcactccttggaggaggcaagtgacatctataaacccgtgagtgtcaaaacaatggcaagaaaatcctgtgttcctactgtcagtgggatgaaagtggtgtaattaatgccagcccaatgacaccacaaggagaaataaaacaaacagctggtggttctgtggaccagcatctagctcctccactccgttactgtttccactataaaatactgactcatgttatgggcagggaagcataaatctaagaccaaagaggaggaaaaaagactatagaaacccaccatgtaaattctaaacttttggctccacagtcaaaagtgtgctacgtccgctccccctttacagtgaaagaaccaagtttccatgatattacatgagatctaagaggagtcaacctgggaacacaaaatagaattttgcatttcatgttcagtaaaggaaacacccccggccagtacagtcacttttggggctgggggcctgaccttgcttcccaagtgcatcagagacctgactccagggatctgcggacatggtcaaggttcagaatggtccaggtgttgcatctgatgatggcattcttactgtagctccaggaggaagattatgcagaagcagacattttgaacctgatgcatttctagaaggtcagtttttcttctaggtaatgtatttatccctcctttgggtcagtgggtggggctcctgtgctacggcctcatccgtagaatgacagcagctcttagaacctgcctgttcctgtcagccctctgttctgagccacctagaacatttgctggtgcacagcaggtgccccagaagtcttagctgttgaaaacatcataggacagtcatgcaggttcaatgggaaaatgcatcacagtgtgacgtggtgttcggcacatatcaggggccagtaaatgctagctgagcattctgtgtaccttattatttttttatttttttgttgagaccgagtctccaactgtcgcccagatggagagtgcagtggtgtgatctcggctcattgcaactctgcctcctgggttcaagcgattctcctgcctcagcctcctaagtagttaggattacaggcgcccaccaccacacctggctaatttttgtatttttactagagatgaggtttcaccatgttggccaggctggtctcgaactcctgacctcaaaagatccacccgcctaggcctcccacggtgctgggattacaggcgtgagccaccacgcccagctgatgtgtacccttatcttgatggaccaattttgctcttcaccaactgtgtcttggcttagttctggccttcattttccttctttcctgtctttaatgtaacatgatcacaggctcaatgagtcatggggcaaagtaacactcttttaacacactgaagcagagacccgttcatattccatttaactgatcatgggtcctggtggacaggctctgtttccttcctatgcttttgatgggagaataggaagacttctcgaagaggtgctggggaataagaggcgatgtctagaatgcattagccaggatgcagatggggacagcatccctccgcaggctcctgctcagcagcaccggggaggatgcagcaggcctagcttttgttagtcacagtgtcgctttgactccggcaggggctctgagcctcacagttaaggaagaagaatgaggagacactgtgaacagaatgcagattgaggaggtacctcccaccagttgagcactgtcttagtccgtttttgcggcttatgacagaatacctgaaactgtgtaaattgtaaagaaaacattttttttgccgggggggggggcgcagggacggagccttgctctgtcacccaggctagagtgcagtggcgcgatctcggctcaccgcaacctctgcctcccgggttcaagtgattctcttgcctcagcctcctgagtagctgggactacaggcacccgccaccatgcccacctaatttttgtgtttttagtagagacagggtttcaccatgttgcccaggctgttctcgaactcctgacctcaggtgatccacccgccttggccttccacagtgctaggattacaggtgtgagccactgcgcccggccccagtcacctcttaaaggtagtactatggctctcaatgctgccacattggagattaaagttcaacatgagttttggagaggacaaacattcaaaccaaagcaagcatcaagaaagcaaattcctgctgcagtcacactgaaggtcccttccctcacagcccagctccatctccaaaggagtgaaccgagcatctcacgtgcttggcttcttgcattacgctcgcgtttggcaacattttgaaccattcctaacctccagagtggtgggactcaatcccaagtggacactcacacacacacacacacacacacacacacacacacacacacaaggcaagtgaacaggcatgaggaaggcagtctgcagctggctcggaaatttcactgatttttttcctcaggcactacactgaaaagactgctcactctcattcatccaggtatggggatataatagaactcacttgagtggtggtttcaaaagtgcaccacaggccaggcacagtggctcatgcctgtaatcccaggaatctgggaggctgaggcaggtggatcacctgaagtcaggagatcgagaccagcctggctaacatggtgaaatcctgtctctactaaaaatacaaaaattagtcagttgtggtggcacacgcctgcaatcccagctacttgggaggctgaggtgggagaatcacttgaacccaggaggcggaggttgcagtgagccgagatcgcgccaaaaaaaaagtacaccatgatgttgctggtagatcataaacccacccagaaagtgtccaggactgttttctaacacaaagcccaggtatgaagaagtagcagacttctactcataagggatcctcaaatggccttcacccaagtcatccagcatgtaaaaagcatcaactctaagtggacctccgggctgggcacagtgctaagtgctatgcttggatcgtcacattttaatcagacagtgagacagctgttacttcagagcatgcgccgcagcacctaaggccatgctgcctgcctgtgaattacagggcgctctacatagaaaagcactgcagcccgagcaggctgtccacaccagtccctgtctgagtgtccctcgctgctgtctgccagcccagatattcaagggtcagctcaggtcagcagatgtgaacccgagccacgtgtggagcccataagaatcacattcccggtgcgtgaaggcctctgccttttgatgaataataaaattctccgcacatgacgagccgtcataattgggcacaagtctttcctttgccccctgcagcggcgtgggggtagcatccatacatgaaaacatttctttttttctttgccagatattttccagtctgtgatattccaaatgtctggtgctggtgacataaaaatgcctttgtcagaaggcctggcacaaacctgccgagtccagctgaagcctgacctgccagtcaggtagccaggagcctctgcgtggtggcctgtaaaatgccacactgacctggcctgtgggacgtcaaccaaattccttcctccatctgggcctcagtttcccttttcataagaggtttttgtgggatgatttctgtagatggctttttaaaagacattgataagacaaactgggattcatccaccaggtgtgatcacttttatgttacacatttatttaatgctttaaaatcaagcaccctggcgcttgattcttgttacagttgattagaggaatagaggaggaggagacagaaaatctcctggcataggagatcagattggaagactggttctcaaaaacctgaacccggggtcccaaggggggacctccacccttagggtgcagtgcttgaactttctcaaggtgtaggagtccaaggccaaatgggaaacttgaaagcactaatgatgggaataattttagaatacaaggaagaagtcgctaaacagatccaaaattcacagaaaacaaagctagcacactggccaaaacaatctccccaaagaagcctgaagacaagtatgttcctagtgttgaaaccattattagggcatccggatgtgactggatagggctgctggattttaaacacctttgcctccttgggccatgtgcatgttgggataagatttcactgccacggtggtacagaactggggaattatccaaatggcattgattgattcattattgactggttcattcattcattcattcattcattcattctataaatatttacccagcatggagtctctgccaggtatcacatgaaagatcttgcattcctactcctaactatgacagtgcagagttggagagcagaatgctgtgagcatgtgtaacaggcaggtcggcctcatctggggctgggcaaggccaggggaggcctccctgaagaagtgacttgaagctgaggctgaggaatgagagcagttttctagctaaggggtggggttaagagcactgtgtattccttttccactgctgcataacaatcttagtgactgtagacaatacagttattatcacatggttttcaaggagtctgagcacagctcagctgggtcctctgctcagtctcaaaggctgcagtcaaggtgttgaccaggctgtgttcccatctggaggcttgactgagggagaaccctcttcccagctcatctggattgttgacagaatccatttccttgctgccacatgactgagggctccggtttctcgcttgctaggggctggaggcccctgcagttcctagagaccagccatgtgggcttctccaacatagctgcatacttcatcatgccagcaaggaggatctctctctggtctgctaaggcacattcttacataacataatgtagcacaggagtgacatcccctcacctttgccacattcagctggtcctgcccccactcaaggggaggggattacataggcatggacacaagggggtgggaaatcactgagagttgcttagtgatatagtttggatatgtgtccccacccaaatctcacattaaaatgtaatccccattgctagaggtggagcctggtgggaggtgtttggatcatgggggcgggtccctcatggtttggtgctgtcttcacaatagtgagttttcaagagatctggttaaaagtgtgtggcgcctccccctcccactgtctctctcttgctcctgctctggccacatgatgtgcctgctcccccttcaccttctgccgtgatggtaaacttcctaaggccttcccagaagcagagcagatgccagcaccatgcttctcttatagcctgcggaaccatgagccaattaaacctcatttctttataaattactcagtctcaggtatttctttatgcattgcaagaatggcctaatgcaattagggtctggcagctgcccacaaaggcctgagcagggtgggtgcaggttgacctggagaaaggtggcgggtactgagtgggtagatgagagaagtccagggatgaagctgaaccgcaggcaggcccaggacacacagggctcctggaagcagtggagggtcacaaccacatttattttaaaataacaaatgtttctctatgtttaaagtcatcctcagaagggtgcactttcaagaaagtgtgaacatcagttgcctccagggaaggaagctgggtggctaaggaacaggagtgaggggggactttggtgcctttggaaccataggaatgaatatatcatggtaatgaaataaattcattcattctttaaaaagccatccttccagcagcaatgtgaagaaagagttgggaagaaaccagggtagctgtggggagatggatcaggttccaaataaaggaaagggattcttagcaatttaaataaaatggagcacaaatggtgactatggtcaaggtaaaatttagaatctctttggtactgagcctttccccccaagtttccagaacttactgtcttatgtcttggcttttctttgccctacaggggtagtctgaggattcgggcacattctcttgattgtccctaacaatggctaatgggtatccaacaggtagagccaactccttttgatcgttccaatacagagtgctaatttttctttctctaatgcatttgatggtcacttcaaaaaaaaattcttcaaagagactgcattagaccaaaaaaaaaaaaaaaaaaagaaaaaagaaaaagaaacgacccccctgcattaactacagaatcctgatgggttatgattgcgttatttttccctgaacactattccctgcattctttctgtgctctaaattaccaattctagtccctgtgtagctaaataataataattaccatataaatgaatatgcatatgtgtcatttttctccctaaaagcaagaaagcctgtttattttggatgagggtttgttttgtttttgaacaaccaaagcacataattagaagtctaacctcttactcttgaaatcctgtctccagcgggaagagatgaaaaggcaatggatgccccttaaaggttagaagaaagtttaaaacaaattgaaggagatatttctttactctgcaggtaacaacagcgtggacatgatcagaatcacagaactataagactagaagggatttccatgctcaagactagaagggatttccatgctcaagtccaaccccatggttttatagatggaaaaactgaggcctaaggaagtgaagctctcaccagagtaacacgctctgtgccttcctgagatgcaacctttgaaacaagaacagtggccaatagtacaacactgtgtttgcatctcagttctgggatttaattgtgggatcttcagcaagatacacaacctcttcaaggcctggattctgcatctgtgaaatagggtagacagcagtgccacctccgcaaggttgctgtaaggactccacagcacacggtcctgctgccaatgctacactcccaatcaaggggagtcacccagaatgtaattacagcctcttgcatagtgcaaggtgcacctgcaatgtcatgtagcagataacatgccagaccaggcgcgtagactacagctaccaccatcatcaaaataatcataataataacacacattataaatactcagtcaatatattatttataatacaatgtaatcacatatagtgtaatgtaactaataacgatgtcaattataattgagattttaatttctaacaatagacttcatcatcatttttatgatggtgacttgggatgcatggtcctgtactctgtccacactgcaggtgcactatgcaaagaggttatgcagaccaagcttttaaataagctcaggaagaattcacagaagttaaatgcatatttgaaagactattctaggccgggtgcagtggctcatgcctgtaatcccagcactttgggaggcccaggcgaggggatcacttggaagtcaggagtttgagaccagcctggcccacatggtctctactaaaaatataaaaattagccgggcatggtggcatgtgcctgtaatcccagctactcaggaggctgaggcaggagaatcgcctgaacctaggaggcggaggttgcagtgagcagagatcgcgccactgcactccagcctgggcaagaacgaaactccatctcaaaaaaaaaaaaaaaaaatgactattctagatcactgagggcatgtttgggatatccagctgcaaacacagagagaatcaccatattttccccagaaactatcactcagtgaggtagaaattttttaaaaatcacggaaacaaatctgtccaggcagctggatcctgtgtgaaaactgtgcagccttgttagattctggagtggggaaagaagggcagtgcggcttcaagggcgtgtatatagccagtgggacacacagacgatcactggcagcccaccctgaggccctgcatctctggattctagatttccacctagaatccagaatgcttacccaccagaaacattttcattggaatgctgtaacttgtaaaaattacttacacgaaatagtactgtttcaaatgttttgaggttggaaaggagagagactttgagggttgctcagtggtatccagacacccaccctgggccttctgcaatggatgtgtggggtggatggggcagaggggcccacagatgccttggccccatgccaagcctctcttccagctatgaagttcagatctgcctctaactgacgtgactcctttgcttatttatctggtttattgtctgtctctccatgactagaacttctgttccttgagagcaagacgtttaactctcttgttcactgctttggtccctgtgcttagcaaagtgatttgttgcatgagagaatagatgaatgaatgaatgaatgaatgaatgaatgaatgaatgaatgaatgagtacttttaggaaacactgactggggagccgggtaggccaacaaaccatgacaaggcttttggtcacgactctagtggaggaacatatcaggtggcatggggacacgttgggggcctgtgaatggcacaaaacacgacagggagtagataggctttgcccagcctttgagcttctgtcctgggctgcatagcacagccctggagcccctgggtcagagcgctggccctgtgcaccatgtgcctggtctaccctggccagccctgccgcttcccccggtgtggctctgggcgtgcctcaggccctgcagctacaacatgggcacaataatagtaacactggccatgtagggtcccgtgaagctggagaagctgctgggcgtagtgcctgatgccaggctcagacgcatgctccattcaggtctctggcttctcccgggccgagatagagagctggagcagaggctctgggcctgcctgctctcctgcctgcctggatcccagagacttctgccttccagtggtcagcaggccagctcccggcttctgctgcactaaggcagctggttgaagcaaacactcttgaccaggagagcgggccgggggaagagcggcccagacacagcagttcctgctcaagttcctgggtcacaggtggtttggggatcatagcatcttcaaaggaaatctgaaaagggaaaggcaggtcttctaccaccaggcgtggggaagtcctgctgcctttgctgactaagacagaccgtggcgccatctccaccgggcctttcgtttggcaggggcagtgatggtggctcatgagtatgccacattttttaggtgcgtgttattcctgaggatatgaactacatagtttctcccttcctgtgtgcttagaacgaatgctcatcacactgacagtcctggttccaggaactcttggcatattgaatttgaaacactgcctgatgggcaagaccatatccagctgtgctttcacagacagcccccacccctgctgagggggtccagtcctgggcaactaaggtacaattaagccaaaggagtaccacccccctatatttgaccaaatttgatgagtagctatcatgatgaaaaagagaaaacagcttagctttaaagatcaaagagagccaggcatggtggctcatgcctataaccccagcacttcgggaggccaagacatgtggatcacttaagcacaggagtttgagaccagcctgggcaacatggtgagaccttgtctctacaaaaaatacaaaaattagccgggcatggtggtgcgcgcctgtgatcccagctactcaggaagctgagcaggaggatcgtttcagcccagtttaagatcagcctgggcaacattgggagaccacgactctacaaacaataaaaatgaaaaacagatgggcatggtggcatgtgcctgtagtcccagctactcaggaagcggaggtgggaggattgcttgagcccaggaggttggggctgcagcgagccatgaccgtgccattgcactccggcctgggcaacagagcaacaccctgtttcaaaaaaaaaaaaaaaaaaaaaaaaaaaagattgaagagaagaaaggaagactcccttgaatgcttccagcctggtgatctgctatgcaagagtctaatccaacttggcaaatgcataagaaataatggataatggattaaggcacacagcattttgtatgggaaaatgctggcccatttccagtcactcgggccatctttccctcccctttaatgctctgccaaaagattgtttggcacttcctaggtaaaagaggtgggaaaccttaaaaatagtgaccgactgatgggtcagttttaggaaaagttcccgtgaggttggtttgacactctgagttaagagtgtgaaattggggtaaaggactgggttttctggttcctgcctcacttctggctgccattccctccagcctaagacggcccctccacagtccactccagtccccttcactagaggcttcaggaatcacttgactctcccgccctggtttttccatcacaacccttctcaccatctgccttgccttggtcatgtttgactctgccttcaactgcagatggtgagcccaaggcaggcaagaccatcttgctagaagtggggggtgctgaggaggaaggtctcgggtgtggggaagggtcctggtagtgaaaaccatgcagggcctgcagggggcactcaactggagatgcagaatcaagtcgccgagcttggaagtcaggtgactgggagggaacttagttaaaatgaaagtctatggggaagctggcctttcttctaacactcctgtttgcttttttttttttttttttttgacacggagtctcactctgtcgcccaggctggagtgcagtggcgtgatctcggctcactgcaacctctgcctcttgggttcaagcgattctcctacctcagcctcctgagtagctgggactacaggcgcgtgccaccacgcccggctaattttttgtatttttagtagagacgaggtttcaccatgttagccaggatggtctcaatctttggatctcatgatccgcctgtctcagcctcccaaagtgctgggattacaggtgtgagccactacgcccagccggaagtttgctttttattgagagctcaagagaaagggcagaaatgttttcatgatcaatgtgaaagtgttacttagaacaggggttggcaagctacagcccgcgggccaaatctggcctgctgcctgcttctaagataaaagtctttctagagcacagccgtgcccttttgtgtctgtgttgtgtacggctgcctttgtattacatcagagctgagtcgttgtgacagaagccatatagcctgcaaagcctcaacgagtgtctctccatccttttcagaaaacatgtgtccacccccgatttagaatagcctctgggctctggatatctgcccacacctgggcagaagaccatccactcacagtgaacaatttgagacaattcagatgtaaacacactgttcagagccagtgttgcagcccggccggcagggtgtttgtgatggagatcccatggctgagggccatgcagaacaagctcgtgagaactgctactccctcgccagcatgctggaaagattcctgcttcaggtttggggcttcccaatcaatatatttttgagacagggtcttgctctgtcactcaggctggagtgccgtggtgcgtgtcggctcactgcaacctcctcctccaggttcaagcgattctcctgcctcagcctcccgagtagctgcgattacaggtgcacgccaccatgcccagcaaattttttgtatgtttagtagagacagggtttcaccatgttggccaggctggtcttgaactcctggacttaagtgatcttcctgcctcagcctcccaaagtgctgggattacaggcattagccactgcattcaaccctagtacatttttttttttttttttgagacagggtctcactctgtcacccaggctggagtgcagtggcgtgatgtcggctcactgcaacttccacctcctgggttcaagccattcccctgcctcagcctaccgagtagctgggattacaggcacccaccaccatgcccagctaatttttttttttttttttgagacagagtcttgctctgtagcccaggctggagtgcaatggcatgtgtacggctgcctttgtattacatcagagctgagtcgttgcgatagaagcctcctgcctcagcctcccaaagtgctgggattacaggcgtgagccactgcattcaaccctaatacttttttttttttttttgagacagggtctcactctgtcacccaggctggagtgcagtggcgtgatgttggctcactgcaacctctgcctactgggttcaagtgattgtccctgcctcagcctcccaagtagctgggattacaggcacccaccaccatgcccagctaatttttatatttttagtaaagacagggttttgccatgttggccaggctggtctcgaaatcctgacctcaggtgatccgcccgcctcgccttcccaaaatactgggattacaggcgtgggccaccacgcccggccaattttttgtatttttagtagagacggggttttgccatgttggccaggctagtctagaactcctggactcaagcaatcctcctgccttggcctcccaaagtgctgggattacaggtgtgagccaccatgcccagcctggccctaatacattttcaagtgagagacagatggagaaagagagagaatctgtaggtgcatttaaaaaaaaaaaaaaaaaagacacaagttctgattctgggagacaggaaatgtgcgccacccgccttgtcaaccccactgaaagtagctgtaatacattcataaaacacacagggcagctattcgaggactcagaaagttacccagtagtaggcaagttgggggaaaagactagaatccaaaataccaccaaaccagtatctcctggcctggccttaaggcaacctgaaggctgaaagtgggaagcagatgggagaagagcgagctaggaggggagatacctctgtggggtttttcttttctctgttttctcacactcctgcctccaggcagtcctgcggtgactgtggtggcactgctgtgtcaaaggggcctgcaggtgcctgaaacactgaaagaggggacccttctccagtcccaagagaacagggcaaagccctgtcaatccttcctttctctgtcctcccaccacttgaccctggtcatgggtgcagtcccaggaagtgagtggcagagcaggataaataacctcagttttctggccaaaataccaaaaagaggagcaccagggaactaggagttatcaggagatgacagagaggggagctcagggaagtaactaaacacagtgtttgatgagatcaaaggctcacccccaagctgtgcacgtgtgggcctgaccctaaacggcatttcagagacactgagacatgaactgtggccagctcactgccaagtccccaggtgcccctgggtgatgtgcacatagcacagagctgcatggtcggtcactgcacggcactgcaaagttgctgaacacaggactgacatggaaaccacactctgagaagcctggctggaacatgcaacctgaacccaactgaatcagtcatctgctaagacaaaaataatgacatttgccataggatttaaacaagacccagagcctcataacaatatttaaaatgtccaggatacaaaattacttagcgcagggagaaccaggaacatctctactcacatgagagcagatacagatgtcaccaccacgtaactcagatactggaattagcggatgaaaactcgaaagcggctattacaagaaacttccaactggtaaaaacacagaaagatacagtctcagcaaagacacagaaggcagaaagaaccgatgcgataaaaaactcacaggacaagctcaatagtggaataaaaaaacaagggaagattcagtgaccctgacaatagttcaatacaaattatcacatgtgactgatagagagtaaaaacaataggggccaggcatggtggctcacgcctgtaatctcagcactttgggaggccaaggcgggaggattacttgaagtcaggaattccagtccagcctggccaacatggtgaaaccctgactctattaaaaatacaaaaattgggccgggcgcggtggctcatgctagtaatcccggcactttggaaggtcgaggcgggtggatcatgaggtcaggagattgagaccatcctggctaacacagtgaaacctcgtctctactaaaaaatacaaaaaattagccgggtgtggtggcacgtgcctgtaatcccagctactcgggaggatgaggcaggagaatagcttgaacctgggaagcggaggttgcagtgagctgagatcgcaccactgcactccagcctgggtgacagagcaagactccatctcaaaaaaaaaaaaaaattaggcacggtggtgtatgcctgtaactccagctaatggggaggctgaggcatgtgaattgcttgaacttgggaggcagaggttgcagtgagccgagatcatgccactgcactctggcctgggcaacagagtgagattaggtctcaaaaaaaaaaaaaaaaaaaaaaaaaagaaagaaagaaaaaatgataagaaaaaaaaagactggagcctcagggacctgtgggacaacagcaaaagggtgaatgctttgtgttattggagttgcagaaggagaggagagagagtagggtgcaggaagttacgtgaagaaataaaggctaaaaactttgcaagtttggaggaaaatacaaacctataaattcaggagctcagcaaacaccaaaaagaataagcccaaagaaattcatcccagacatgtcataattatactagtgaaacctaaaaataggccgggcacggtagctcacacctgtaatcccagcactttgggaggccaaggcgggtggatcacccgaggtcaggagttcaagatcagcctggccaacaagggggaaaccctatctctactaaaaatacaaaaataagccaggcatggtgacgcatgcctgtaatcccagctactcaggaggctgaggcaggagaatcgctcaaacctgggaggtggaggttgcagtgagccgagattatgccgctgcactcctacctgggcgacagaatgagactccgcctcaaaaaaaaaaaaaaagaaaagaaaaggaaaaaagaaaactaaaaacaaagaaaaaatcttgaaagtagtcagagaaaaaaatgatgcattatttataaaagaatttgaatgactgtggatttttcatagaaaccacagtggtcagaagtaagtggaggctgggtgtggcggctcatgcctgtaatctcaacacattgggaggccaaggcaggaggactgcttgagaccagaagttggagaccagcctgagaaatagagggagatccagtctacaaaaaattagctgggcatggtggcacacacctgcagttccagctactggggaggttgaggcgagaggatctcttgagcccagaaggtcaaggttgcagtgagcagtgatcgccactgcactccagcctgggcaacagagcaagactctgcctcaaaaaaaaaaaaaaaaaaaaaaaaagtaaacagagtgctagctttggcaagcgcatatactaaaattagaacaatacagagaatattagcatggccccttaaaaattacaaaaaaagaaaaaactgtaagtgaaacatttgtaaaatgctgaaagaaaaaaactgttaacctaggattctaaattcagaaaaaaatataggagcctaggagtttgataaccagcctgggcaacatagtgaaactctatctctacaaaaagtacaaaaattagctgggtgtggtgatgcatgcctgtagtcccagctactcaggaggctgagacaggaggatcacttgagcctgggaagttgaggctaagtgagctgtgatcatgccactggggtccagcctcggtgacagagcaagaccctgtctcaaacgtatatatacacatacatacatatatacataaaataaaataaaaagagaaaagtaatgacatgacccaatagggttcctgtgaggacacatgaatcggtgtgcaaagccctcctgtggcacccatcagtgcccagtagacaggtgctatgctgctgtcctcctgagccctcccctgccctctccaccctccttgtgccccaggaggccggcctcagtggactgctcacctggactcctgccctttgacttcactgggtctggcaggagatcaaaggataggaggcgagagtctggggtacccctaattctgcctcctgccgatgccagtccctggcgcctcaccatcacttgtcggttgccttaccctcccatgcttctgcgattgtcctgtcattaaatgctttcctgtgacccctctggatgggccagctatttcctacgggaaccctgaccgatacaacgaattccacactgttccttttcctttgacaaaagcaaaatccatgtctgtagactgaccttcacggagttcccgtttgcctgccttaccttctcttatgcctctggtcatctctggtcttggagatgaacacacgcccttcaccctcccctttatcttggcactgaaacccctagctcactggagtcttacctgcttgatgcaatcctcttcagccaggcgttcctgaatcagctggacgagcagcgcgctgggaactgtctgaaggaaaaaggacacacagaatgatggcccaaacctgcttcctgcagctcaggacacagaccagcacacacccttcaccaacgccctggcctctggaaagcaccgaccaccatcgggccccgcccttcctccacccgctgcaccctttccttgaactctcttctccccccagcatctttgagggcctccctcacacatgtactcaccttatcctgtgcccaagccccaacatgccctcgcccacctccacctgaataactccagggctccctcagagcctcagccccaagtgccagcctgcaggaagccctgccggatcctcccaggccaggctggtgctacttcccgtgctccatcatcctggatggagaactctgtcactgcactaaccaccgcacacgctaatggactgcccacgtggctgtgtccccaggaagttgtaaagctcttcaaggaaagggacagtgtcctactgactctggactccagacagtggcgggtgggaggggattggctccaagactcagcagaggcgagtgtgtccatctcttcccaagtccacagtcagtgacctcatgttggtaacaaaattggccacggtgggagtgtctacaccacagaaatgataaaggctacaataaggactccccaccctgcccccagtgctggttgttgaatattgaccagcagaccaaatggtatcaaggatataggaagccctgtcgaccataatgaaacttcaaattccttgatgcattcaacaagcagcaatcatgacggctagcatttgttgagcacgtgctatgtgccaggcactgggccaagcattccattctttgctttttgtaacaactctgtgccatctacactccacttacagtaacacgggcccccaaagaggaatcccaaagaggagtcgccctcttgcccccttctgcctgtatggtctgggtgtgctcaactctatcctcagatccagaggagggccctgactggtctaagccaatccgcataccccactcctgaccactgtgattgattcagagtgttggcccttttcatagaggaggaagctgagcctgggagaggtgaagctgcttccccagggtactccgcactctcccttctctgcaaaggactggggaggaagcaactcttctcaggggagtcgctgaggcctggcctgtgcctttccttgtagtgcacaacaggggctaaaaatctcctctacacccacccacatttctgaaaaaggacatgggaagtagaaatacattccaatcagaaagttccttgctgggggcgggggcctcctggcacagcctttcttatgcagagcagagactcggacttggcatcagggctcacctcccacctctgcccagggcaggctctctgctcctggcggctgcgatacagccagctgggcgaccctgggcaaagccttgacctctttaggcctcacacacctaaccagtagaaatcagtaatgagactgcaaatgtggcttttattttaattttccatacactccacttacagtaacatgggctcccaaagttcctttgaggagtcaccctcctgcccttctgcctgtatggtctgggtgcgctcaagtccatcctcagatccagaggagggccctgacttgtccaagccaatctgcacaccccactcccagccactgtgattgattcagaggctgcctgggacccagtcccagctagtgaaagtcaggcccaggacatcagtgcaatcattaggggcatgaacccctgctttccaccagctcagaagctgagaaaatgtaagagcgggagctgcggcagccacttcgtgggcatgacgggtgtggaacggaatgaaaccagcacaaagggaaagagagaaaccagacccagctgcagaatggcttttccagggatggggaatgggaagaaaaaggggagatagcgagagaacgagggagggggcacctctgctgggaactggatgaatatgttcactttaaagttatggggtcaccatgtttctacgaggtagacagccaaagtcaagatcgagagcaagagggagagacagaatgaatgaatgaatggatggtgcacagaggaaaaaggagaccagagaggcaagaaggaggcgagccagcatccagtccctggctccaacatctgctgagatagccctgtatccttatcctaccgcccccttcccccacctttcttccctaagccagtggttctcaatttgattgtgcaacagaatgctggcagagcttctggaaacacaaactgctgggccccagcctgggagctctgattcagtagctctgggacagagctgagaatgtgcatttctagcaagttttcaagggacgcggacgctgctggtcagggcatcacacctggagaaccactggcataagcccacctacacagggcccccggggtctgggggaagctgctagagagggagggtgtctttccgccagtgcccgtttccctcaggtctccaggggagcttccccaggctggcaagggaaggggtggacaggaagcagccctgtcccttccctctgcatcccccctccgtctcatcctctcccctcccatcccctttcatcctttcccagcccctcaggtcctctcctgaccccaggcacagccaatttccattctggggctgtttttcccagattcctctgccctccctgacaacacccattcaggaggcagtgttcaaacaggtacaggatgcagagaagggtgccaaccaggacgcagggggtgccagccagtcaaagagcaccggctgaaaggcggacagccccggtggggcacagcaccccctgcagcctgcacagcaggggacaggcctgcggctttgagcgcagctactcctgagcgccccccgctgctccccgccactgtgctgtctccacgccagctttgatgtgtcacgtcagcagcagggctttcagaggccgcttctagaagccctgccaaactgtcttagcaggaatcagcctccctccttgcagagcactgtgatgctctcccaccccagcccccaaagtctggcatttggggagaatcagggagaagctgacagtgcagtgaggccgctcctggccacagagaaggctcagccccgactcaggcccctggccccgggtctccctgctcggtggcaccgcagcacccagttgctcccgtgctgcttccgtgcacttaagggcaggacaggctgtgtttgctgcaatttggatttttctctcttcccctccagcacccagtgcggctttggtgggtttcccggcctgggggcagactcgctgatctcctagccctccaaggtgccgcccgctgttttgctgttctgaggcagccaagtgtgcaggtgccaaccctggctctgcccctggggcgtcacttgacttctccccagtgggctttctcacactgggatggcatgagcctgcatcttcctgtcccatctccaggccccactctcagggatcctaatgtccctgtgtcaacatggtgagtgatgcctgctcagaagttgtgggcattttgagctacagtgtgatcttgggaagtagagcagggaggggaacaggtgagatgccctgatctgacccccacaccccccttctccataaaggggctcctcctggtagacgagggaaacccagtagtcggacttgagctcccctcagaactgacagaacatcctttagagacaactcccattccaaagttactgctgctcggagctgtcagagcaggttaggagacagcaggaactgcctcctagagtttgggagggggagacaggagggttgggggaccagagacaagaggagggaggagagaggagaagaggcttcaaaggaagagagcagacctcatagcgtggcacccagacaggcgcacggaaggacgtggcagcaagagaaaccctggactggatgaaggccaggaaattttcacaggagtgacggagcctggtgctccagtttccctgggtagagcagtcacctcctctaccccaagccttccaaaaaggcctgctcgacgccactgcctggagctgttgactcaggaaagggagggagagactgagggcattcccactgtgtctcagttcagcctcaagaaatgggagcagcaaggccagctggagatggagtggccagaagtgagggagacaccaggcaggactgggaagcaacatctgtgggctgtttcctagaaatcctcagaactacttggaggggactatgtttcttgtgtgcagacagaggtaggatgagggctcacgttgttttttttctttgagacagggtctcactctgtcatccaggctggagtgcagtggaaccatcatggctcactgcagcctccacctcccaggctcagcctcccaggcagcagggactacaggcgccccccaccatgcccagctaatatttttttcttttttgtagagacagagaaaaaaaagaaaggtggcgatcctcccgcctcagcctcccaaagtgctgggattacaggtgtaagccactgcacccagccagatttttttttttaaacagtagaaattgaaggctcataagtacaggatcagcacctgagagtggctcctcagtggccttccccctctcccccttctcctcccttctcctcccctaccctgtccccctccttccccgtctcctccccctcctcgacccgggtcttcctcacctgagcctttttgtggtgtttatgatgttgagtcagactgtgggcttagagacagggccagagaaagcagatgaaggaaaaaagactcggctgaaaagatgaattcaattaacttaataaatgggaagaacgggaggcaaaggtggcctcgggctggggttccaggggcagcgtttcaggggaacgggcctgtggagaaggtgttagggccactactgtgggaagaaaaggtgggggtttctgcagtattactggaaaccatgtccctttcacggtgttcggcgagaggactggggccattttgacattcatttcgatggctctgaccatgtccttgggtccctgatcccctccaggaaaagctgtggggtcagcatctagacaaaatcactcaggggagccagtcgccagccaatgaccttggctggtgtccagggacagccagcgtcttcagggcatcaaacgtctcttccagcccggcctggacccagaagcatcacatgtccctgatggtccagtgagggaggggcctgagcaggagagggcccaggagccataagaacaccatctcctcggcgagatttataactctggctggcctggtggaatcctcagtgacacttctaggtgtgataatgtgtctctatgcgtttactgaaaaagggcccttatctttgggttgcggaaataaatgaagacctcccaaatgagacaagccaaggctgtttactcagagcttgctgggcaagggagtcagccagcatcgttcacatctggcggactcgaacgcaggtagaggacagggagagttctagaggaaaagggaaggctccaggcatgcctgaaggaggctgctgctggggagctggaggtgtctctctagaggtgggcattctacaggactagacaggggagcatgtttggctttctctggctggtctcaggttggaagcaggaacaaaaactagagacactgccagttattaatcatgccctggccatttgggataggtggctatagggatgacttagttcagcttcctggactattggaagagagagcagcctggcttcctgcaagcctggcacagcaggtggcttcccgggtgggctcttgcaggtcatgggttggtctcctgggtgggctgctgcagattgtggggcagagtcttatgtttacaggaggtcttgccattgtccacactgaatattcaatctcagtagatctggactaaaacacccatggggaaggtcaaatgctgtctgggtttgctttaaaataacccagggcagggggagcaggtgagggtgcaacccaaggctagactgccatgagctgacatctgtcgaagcaggggatggatccatgggggttctcagactatcctcactgcttctagatatttttatgagatttcacaacaaacacttaaaaacaaacaaaaatccctggccactgtgaacccccagcatcctggggcaccatccccgtgggctttgtgacactgcccgattccagaccgttccatgccttagaacattacagtgtgccctttgggaaggctttgcttagtgtaactgtggttatggctccagggggtccctaaatcttgcagcctgtacccccttcccagcccagagccagtgcctaggacttagtaggtgctcaggactaacgtaaatgaattagtaaatgaattgagtcaaacaagccaccgattaattgctttattgaaggttccctggctcccataccctggcttgtgcttagttttatgggaccatcagtctcctcactggctggaagcttctggggtaaggagaagaaactcatctttgactctcccacagcactgcagaatagtgcttggcaaaaaggcagttaggaagtatttcagaaaccactgggaaatgcctaagatggagatgtcttggttaacagtggcaacgtaagagaattctgcttaggagggcaaagctaagactagcaggagaaaatcaggtatttgaaggtatcattactacttgcaaaaagagccataaagattccaaatcagcagacaatttaaagaggacatttaatgagaggccttgactggcaggcactgtctgcagacaaggccacgcatggccgagcctgccatgtgcccactcgctcttcagaacattttactctttgatgaggcctgacatccaggcctttcatcttccctccaccagagtttctgagccaaggaccccaacaagacacccttgaaagcacttcaatgtggtttgaaatatgttgataattagcaaaatgaaacccaggaggaatttccttaaactccctcctctctgttgaattttataaagctaataaaaacatttttatcctacaaaaaagccttccccaagaaagcttatcttctgcagaaaatgagataaccactttctttctaaaaccatattcccagcccgaaaggctggtgtccccgcaagctgaagccacacagtccaactcctgcaagactgcaggggcggctgggggactgacttgccgtgggggtggccgccttgctgagccaggctttccttctctatcaagctgctgtcataggcagacttggggctgggggtctgtcgaagtcacacccctttctctctctttttttttttttgttaacacagagtcttattctgtcgctcaagctggagtgcagtggtgtgatcttgactcactgcaacctcagcctcctgggtttgagcaattctcctgcctcagtctcctgggtagctgggaatataggcacccaccaccatgcgcacctaatttttttgtattttggtagaaatagggtttcaccatgttggccaggctggtctcgaactcctgacttcaagtgatctgcccaccttggcctcccaaagggctgggatcataggcgtgagtcattgcacccagcccatccatacctctcatctgtgagaactgccatcccccaccaaccaggagtcttcatagccacatctgagctctgtggcctcactgagccctcactgcacacccctcaacagagctgactgtgcctgacacgtgactagctagcccgggcagatcccccttcctgaggatttggctttgaagctgcctttgtgggtggtctgaaccgagaacacaggagacaagaatggagtggtggtcacgagtggctgggagcatggcaagaaagacagaagagaggaggaagagtccctgcctcagcctcccaagttgcagggactacaggcacgtgccaccatgcccagccagaaggaattttgaagaaatattttgagtttctatttgtattaaagagaaataatgtgatcaagccttatatttccctttagaagatgtttttcaaatatcgagctgttggtcttttagaaacaacacccacacctcctgcaatgctccccagcgtgtgtgggagggacagggggaatgggcactgcccggaccagagggtgggctgtgcagcagggtgcccaaggctatgggagggagacgcctctaaggtacagaacatgggggctttccactctggggacagctggacagctgccctttcaactgctggcgcagcccaaccctgcatctcctggcgcgggccgccaggttcagcacttgcctccatgcctttactcggctgagcctaagaagaaaaagagcaagcctggaccatcccaccaagggcttggacaaaacagcctccttcactcgacccgtgatcctttcccactgcaaaaactcacctcggtacccaacaggacgtgagcccagtaaagaattatcttcttccttccttcacaccctgcctgtatctcattttaccccagcattttcttgtactcaatcaaaaatgaaatgggaacaaaccaagcaatggtcaggtggcagtgggtgtggcagtgggcactgctgctgtgtgcctacccctgtccccggggccagtcctaccttcctttgcagataaagccttctggcttcggtggccgtataggaaaactcatttaagatcaggttctccagggtgaggagactgctgttcagatgtttgcagagccacattgcctgaagaaaggaaagaagaaaagggcattttcataaaaacaataaatacacaaatgactctattaaaatgccctggtccttccctctcctatgggaaaaggttggccatggggaagcacaattatttccagctggaggacggccaccaagggagacccacccataaagcacctgctggcctaagagccctgctcatagcatctcttcttctaccagcatagacttaaatgaagtgggaagacctacaggcaggttacattttagctgcccttggcgtgctttccaagctctgtggaccatgagtttcatctcaaggaagactcagaacaggaactttgaggacagaacctaaggatgggtaacagcccacactcagtgttcttttttttttcttaaagattgggagctggcatgtgctggccaatgggatgtttagttcattgataattactctatagtctataagggaagagtaaattttaagggaga

SEQ ID NO: 879 - DNA, 6636 bp, Homo sapiens
tacttcctgcaacaatgtgatcctagattcagcaaaacaaaacaaatcctgttgctggtttctcctgctcaggcctggaggcatccagacctcaccagaacagacacacaatatagtggaactgatgtgtagacgcagtcaacacacaagaacaaccatcacccggggagtcaaccctgaccccagggcgggggagaccagaaactctctcccatgtcctctctcccctcggcctcaggagggacccatgtgggcactggcatccaggatgaagactacacttcccagcatcccttgcagcaagcagtggccatgtgaccaggctgtggccaatggggaggcgaggcctgtgcacagcggctgcctttagaggaaggaagttttgtgccctgttgtccccttctcctctccctgctggctggcaggagacagggtggactctcagggggaagctacaccctaaggaagtcagaacagcaagatggaaggaggctaagaccctaaaaactgcatagagaagaatctcccgactgccttggactttcatgtgaagggaatgaacctctgtcttagttaagccaccgtgattcagggtccttgtcacattcaccgaggctgtaacctaattggtagaaagaacaggagcgggaggggagatggagtcagagaggcaggcagaggtcagatcacatcaggcctgcaggtcaagatggaggaagaaacaggcaacataggactcaaggaccacacctgctcccaggtgaagggattttgccgtgggtgcccctccctgtctgctggagaaagctaatttgacccacttccctttaggactttgcaagatgcacatcacagtcacaggtacttgtctcctaacagtcctttcaggggaactgccccacccctaattaacccagcctcaggtattcctttatagcaatgcaggtggactgacacatatctttagtgtcgtgagactgtgacaagagcaggaaagaatcctcgtgtgcatccctctgagcgttgggagctgttgttgtagcagctgctgttactcatcctgactgatacacagacaccgccagtagccctctctcctggaaacgccatgtaagttaggtgaggcatgacccaggaaagctctcaagctgacttccctcctaccctcagggctgcggagcaggtccctcattatctaagatcagttggacacctgtacgcctgccatggcctggagcaagtgccaggcactgtggatgatgaatatgagaacagcatcaaccctgccctcctgcaggtgactggccagaccgtgggattcctccacaaccaactctgcacacacagctcactcatgtcgagcaggaagcggagcttgggatcacctgacccgctcccctcacctgggagcagcttatatagaagcgcctgtagttcacacagggctgatggttccagcttccaagacaccccgaggcctcctgggctgcttggtaatcagaccaggtacgtgcaaagaggcatggctctttattttcacttaattgagaaaaccacatcagcaaagagagcatccaagctcagtggccctttctccccacaacagtgaccattaaccttttaaaagatgctttatgggttatttgccaaacctccttcttcatgccgaggtgtgatgaggctcataaataggccagacttgggaggggacaaatgcgagcaatgccaccaatgagaggcccaggcagagccggtctcggggctgcccagccatgtgtgcaccaaacatggatgtgtcagtggccgtgccaggagtcaagctcttggccaggggcctctgggtggccaaggccaagtcttgttcaaaaggtgagttcaactgagccaaccatggcagaaatacataagggagaccccatgcctcctctgggtaaaatcccctgctaatcccacctggctcagaggaggagccatgtcctcacagcagcctgcagtccccgcctgactcagcctcctctcggctctgattctccatgcccctctacccctctctgtctcctctcccaccccagaaaggggatcctgcaggttcatcctggtggattcaaacccatctttgccacacagatagtcatcagaatgaatgggcataatctataaagagtcctcttgaaaaagaaaaaggcaggccaggtgcggtggctcacatctgtaatcccagcactttgggaagctgaggcaggcaggtcacctgaggtcaggagttccagaccagcctggccaacatggtgaaactccacctctactaaaaatacaaaaattggctgggcatggtggctcacgcctgtaatcccagctactctggaggctgaggcaggagaatcgcttgaacccggaaggcagaggccacagtgagcgaagattgtgccattgctctccagtctggatgacagaatgagactccgtctcaaataataataataaaagaaaaaggtgccaggtgctgtggctcacgcctgtaatcccagcactttgggaggccgaggtgggcggatcacgatgtcaggagatcaagaccatcctggctaacatggtgaaaccccgtctctactaaaaatacaaaataatggtaataataataattagccaggcgtggtggcgggcgcctgtagtcccagctactctggaggctgaggcaggagaatggcatgaacccgggagacagagcttgcagtgagccgagatcgtgccacggcactccagcctgggcgacagagcaagactccatctcaaaaaaaaaaaatgaaaaaataaaaaggcaaaaattcagacaactaaacggaaactgggcaaaagagttgaaccagacctggctgggcacagtgactcacacctgtaatcccagcactttgggaggccgaggcgggcggatcacgaggttaagagttcgagaccagcctggccaatattgtgaaaccctctctctactaaaaatacaaaaaattagctgggcgtggtggtgcatgcctgtagtcccagctactcaggaggctgaggaagaaaaattgcttgaacccaggaggtggagcttgcagtgagccaagattgtgccactgcactccagcctaggtgacagagtcagactccgtctcaaaaaaaaaagagttgaaccagcccttcacagaaaaggaaatgtgaaggaaagggcaataaaaacatgaagagggtctcagctaacaggatgaggatcacgtgtcacccaccagacagcaaaaatcccacagcccaatcaatgcaaggattgggaagaatggagagcaataggaaccctcagccactgctaagaatgatgtgaaattgtttttggtatccctgcatatgaaagggtgtgttttgtgggttatgaggaaaattacatttcttacctgggatgaaattgtaaaaactgaaagctactgaccaggagaaatgtgcacctgtgtacaaaagaaaggcccaagagcattcccagcagcacagtcctcagggccccagcctggctgaactctcgtccacaggaagatgaagacatttcccatgctcccctcagacggcgggagatcgtgcagcaatgaaaaagactcatgttagtgtgggtgggtctcaggaagagaatggagacgggagatcacgcagcaatgaaaatgaaccatgtcaatgtgggtgggtctcagggagagaatggaggacagaaatagacatcaagcagatactcagacccaacgcagtgtaggagcagccacccaggagaattccttcacatcaaagttcaaaactacagccgaggcaacagagccctgtctcaaaaagacaacagaaagttgaaacagaaactagaacgagtctgagggtcatggagctggagacccggggaggagtcagtgctgctgttccagtttgcgggtcgtggatctggagacccagggtggagctggtgctgctgttgtagtttgacggtcatggagctggagacctcgggagggtccatttgaagagcagcaccggctcctccctgggcctcaggctccacgaccttcagactttaaaagcggtaataccggcttctccctgggtttccagctatataaccctcagacatgaagcgcaacagcaccggctcctccccgcctccagttccatgaccctcaaactacaacagcagcaccagcctctccccaggtctccagctccaccaccttcaaactagaacaacaccaccagcttctccctgggtctccagttccacaacgctcaaactagaacaacaccagcttctccccaggtctccagctccacagccctcaaactagaacaacgctggcacctccctgattctccagttccatgaccctataattagaacaacaccagctccttctctggtctccagctccacaaccctcaaactagaataacaccagctcctctccaagtctccagttccatgactctcaaactagaacaacaccagctcctcctcagttctccagctccacgaccctcaaactagaacaacactggctcctccccaggcctccagctccatgacccttaaactagaacaccaccaccagcttctcccctggtctccagctccataaccctcaaactagaaaacactggcaccaccccgattctccagctccactaacctcaaactagaacaacaccagctcctcctcaaatctccaggtccaggaccctcaaactagaaaaacactggctcctccccaggcctccagctctgcaatcctcaaactagaacaacaccatctcctccccaggtctccagctctgtgaacctcaaactagaacaacaccaccagctcctcccaggtctccagctccccaaccctcaaactggatcaacaccagctcctccagggtctccagctccccgaccctcaaactggatcaacaccggctcctccagggtttccagctccccaaccctcaaactggatcaacaccggctcctcctcagtctccagctccgtgaccctcaaactggatcaacaccggctcctcctcagtctccagctccccgaccctcaaactggatcaacaccagctcctccagggtctccagttccccgaccctcaaactggatcaacaccaggtcctccagagtctccagctccccgaccctcaaactggatcaacaccagctcctccagggtctccagctccccaactctcaaactggatcaacaccggctcctccagggtctccagctccccgaccctcaaactggatcaacactggctcctccagggtctccagctccccgaccctcaaactggatcaacactggctcctcctcagtctccagctccgtgaccctccaactggatcaacaccagctcctccagggtctccagctccccgaccctcaaactggatcaacactggctcctccccaggcctccagctccgtgaccctcaaactagatcaacaccagctcctccagggtctccagctccccaacgctcaaactagatcaacactggctcctccagggtctccagctccccaatgctcaaactagatcaacaccagctcctccagggtctccagctccccaaccctcaaactagatcaacaccggctcctcctcaggtctccagctccccgaccctcaaactggatcaacaccagctcctccagggtctccagctccccaatgctcaaactagatcaacaccggctcctcctcaggtctccagctctgcgaccctcaaactagaacaacaacaccatctcctccccgtctctcctacttgcatgtccatttataggctctctgcaagaagaaaaatatggctttttttgcccgaacctgcaggcagtcagaccttatggttgtcttcccttgttccctaaacattgctgttattctgttctttttcaaggtgcactgatttcatattgttcaaacatacatgttttacaatcaatttgtacagttaacacaattatcacagtggtcctgaggtgacttacatcctcagtttacaaagataacaggagtaagtgactaaagtaaagacaggcataagaaattgtaaaagtattatttgggaactgacaaatgtccatgaaatcttcacaatttgtgttcttctgctgcggctccagctggtccctccattcggggtccctgacttcctgcaacatgctggcatgcacctgtagtcccagctactcaggaggctgaggcagagaattgtttgaacctgggaggtagaggttgcagtgagccaagatcgctgccactacactccagcctgggccacagagcgagactccgtctcaaaaaaaaaagaaagaactggaggctgacacaggccaaagaagcagctcaggctgaaattgaacagtaccacctgcagagggagaaagagttgaaagccaaggaagctgcggcactggaatccatggcactggcagcaccaaagtggagaaggagacccaggagaagatgaccatcctccagacctactttcctcacaacagggatgaagtctgggataacctcttggcttttgtctgtgacattcagccagaaatgcatgaaaactaccgcataaatgg

SEQ ID NO: 880 - DNA, 9556 bp, Homo sapiens
ccaggattggaaaaagagatcgtcaacgttttattctggtgataatcctccaaataaaatcattaccaagtcacgaattctccctgaatcatcatctataaacttttttatctttatttattttttaaatttttctggagacagagtctcactctgtcacccaggctggagtgcagtggtgcgatctcggctcactgcaacctccgcctcccgggttcaagggattctcctgcctcagcctcccgagtagctgggattacaggcgcgtgccacctggctaatttttgtatttttagtagagacggtgtttcaccatgttgcccaggctgatctcgaactcctgaccttaagtgatccgcctgcctcggcctcccaaagtgctgagatgacaggtgtgagtcaccgtgctcagcttatttctttactttcttaataaacttgctttcactttgtggacttgccccaacttctttcttgcacaaggtccaagaacccctctcttagcgtctggatcaggaccccaagaatgagagaatgggaaggcgcagggcgtccaacaggactttccgggagcatgtttgcctgactccaggtgggccctgtcggaagctgggtcaaaatgaaagacagctgccagttactacccacgtcctgggcacgggggccattgctccgggcttgctgtgggcttcccgctggctgctggaatcagagctctgtcctggtagggtctgctcattgtccatttgcatattcccgtctcccaccatccagaaaacaatgtaacaggaagggcacagtggctgacgcctgtaatcccagcactttgggaggccaaggtgggcagatcacctgaggtcaggaggtcgagaccagcctgaccaacatggagaaaccccgtctctactaaaaagatacaaaaaaattagccaggcgtggtggcttacgcctgtaatcccagcactttgggatcaggagttcgagaccagcctgaccaacatggtgaaacctcgtctctactaaaaacatataaaaaaattagctggacatagtagtgggcacctgtaatcccagctactggggaggctgaggcaagagaatcacttgaacccaggcggcggaggttgcagtgagccaagatagtgccaactgcactctccagcctgggtgacagagcaagactctgtgtcaaaaaaaaagaaaaaagaaaaaaaaaaaagaaaacagtgtagcaggcaaaggtttgatttccacaccaaagcctaactctgagagcatggttttcttccagattctctctaaatactaatttcagggaagacaggcccattcccagcctcctggaaatccttctcaacacagttcttgagtctgtggtccctcccatggtcctccccaccagcactctgctgtagctctcaggctgctctgccacctcccctccccatctacctgctcaaggactggcccgtttgctgtcttgggtggaaggggcagtcctgaactctcttcttcaaagtgacagtttaattctccaccccttaaatcttggcgggaggggcaccttgtgactgcttttgtaaccgaacacacattcagctgctcaaaagccaaaactcaagagacaggagttggtgggaagaaagcaatttattcagacagccagcaaaccaagaagatggtggactagagtcctaatgtgccatctcaggtgggtacaaatttcaagctctttttatgttaagggcagagaaagagaaggtggttaggatcaagaagtgatctacagtcgggtgcggtggctcacgcctgtaatcccaacactcccactttgggaggccgaggcgagcagatcatctgaggtcgggagttcgagaccagcctgaccaacatggagaaacaccgtctctactaaaaatacaaaattagccgggcatagtggcgcatgcctgtattcccagctactctggaggctgaggcaggagtatcacttgaacacaggaggcagaggttgcagtgagctgagatggtgccattgcactccagcctgggtgacagagcaagactccgtctcaaaaagaggtgacctacatctgggtggggtggctcaaacctgtaatcccagcactttgggaggccagggcaggtggaccacttgagctcacaagttcgagaccagcctgggcaacatggtaaaaccctgtctctacaaaaaatacaaaaattagcctagcatggtggtgtgcacctgtagtcccagctactcagaaggctgaggttggaggatgacttgagcccaggaggtggaggttgcagtgagccgagatggcaccactgcactccagcctgggtgatagaccttgtcaaaaaaaaaaaaaaaaaaaaaagaagtggcctatgagcacagacatctcagacatctgggcaccagcaagtctgaggaggttgggaacttctttgtccttagtcaggtcgcaatgcttttacacatatttaataaaatattgttagttgtttatatactttcaacctcagagttagtttttaaaactacatgattactgtttttccatattatctcagtgctccgaaattatcctagcctacgtgcaggatgggtaaaggccccttgaacacaaacggagtgagttatgttagttctactgttttactgttatactttggccaattgaatacagtggaagggatgctgtgccagttcgggagtggcctggaaactgctggaaactgctaaactggcctggagactgctacttcctgtgtcttcgaagtccactggcacatgagaagtacaactgctcagaggcagccatgttgaaaggaagcccaagcagccacatgaacaccctggtttacaggccagcagatcccccagcaacagccatcattagctgccagctacttcctgcaacaatgtgatcctagattcagcaaaacaaaacaaatcctgttgctggtttctcctgctcaggcctggaggcatccagacctcaccagaacagacacacaatatagtggaactgatgtgtagacgcagtcaacacacaagaacaaccatcacccggggagtcaaccctgaccccagggcgggggagaccagaaactctctcccatgtcctctctcccctcggcctcaggagggacccatgtgggcactggcatccaggatgaagactacacttcccagcatcccttgcagcaagcagtggccatgtgaccaggctgtggccaatggggaggcgaggcctgtgcacagcggctgcctttagaggaaggaagttttgtgccctgttgtccccttctcctctccctgctggctggcaggagacagggtggactctcagggggaagctacaccctaaggaagtcagaacagcaagatggaaggaggctaagaccctaaaaactgcatagagaagaatctcccgactgccttggactttcatgtgaagggaatgaacctctgtcttagttaagccaccgtgattcagggtccttgtcacattcaccgaggctgtaacctaattggtagaaagaacaggagcgggaggggagatggagtcagagaggcaggcagaggtcagatcacatcaggcctgcaggtcaagatggaggaagaaacaggcaacataggactcaaggaccacacctgctcccaggtgaagggattttgccgtgggtgcccctccctgtctgctggagaaagctaatttgacccacttccctttaggactttgcaagatgcacatcacagtcacaggtacttgtctcctaacagtcctttcaggggaactgccccacccctaattaacccagcctcaggtattcctttatagcaatgcaggtggactgacacatatctttagtgtcgtgagactgtgacaagagcaggaaagaatcctcgtgtgcatccctctgagcgttgggagctgttgttgtagcagctgctgttactcatcctgactgatacacagacaccgccagtagccctctctcctggaaacgccatgtaagttaggtgaggcatgacccaggaaagctctcaagctgacttccctcctaccctcagggctgcggagcaggtccctcattatctaagatcagttggacacctgtacgcctgccatggcctggagcaagtgccaggcactgtggatgatgaatatgagaacagcatcaaccctgccctcctgcaggtgactggccagaccgtgggattcctccacaaccaactctgcacacacagctcactcatgtcgagcaggaagcggagcttgggatcacctgacccgctcccctcacctgggagcagcttatatagaagcgcctgtagttcacacagggctgatggttccagcttccaagacaccccgaggcctcctgggctgcttggtaatcagaccaggtacgtgcaaagaggcatggctctttattttcacttaattgagaaaaccacatcagcaaagagagcatccaagctcagtggccctttctccccacaacagtgaccattaaccttttaaaagatgctttatgggttatttgccaaacctccttcttcatgccgaggtgtgatgaggctcataaataggccagacttgggaggggacaaatgcgagcaatgccaccaatgagaggcccaggcagagccggtctcggggctgcccagccatgtgtgcaccaaacatggatgtgtcagtggccgtgccaggagtcaagctcttggccaggggcctctgggtggccaaggccaagtcttgttcaaaaggtgagttcaactgagccaaccatggcagaaatacataagggagaccccatgcctcctctgggtaaaatcccctgctaatcccacctggctcagaggaggagccatgtcctcacagcagcctgcagtccccgcctgactcagcctcctctcggctctgattctccatgcccctctacccctctctgtctcctctcccaccccagaaaggggatcctgcaggttcatcctggtggattcaaacccatctttgccacacagatagtcatcagaatgaatgggcataatctataaagagtcctcttgaaaaagaaaaaggcaggccaggtgcggtggctcacatctgtaatcccagcactttgggaagctgaggcaggcaggtcacctgaggtcaggagttccagaccagcctggccaacatggtgaaactccacctctactaaaaatacaaaaattggctgggcatggtggctcacgcctgtaatcccagctactctggaggctgaggcaggagaatcgcttgaacccggaaggcagaggccacagtgagcgaagattgtgccattgctctccagtctggatgacagaatgagactccgtctcaaataataataataaaagaaaaaggtgccaggtgctgtggctcacgcctgtaatcccagcactttgggaggccgaggtgggcggatcacgatgtcaggagatcaagaccatcctggctaacatggtgaaaccccgtctctactaaaaatacaaaataatggtaataataataattagccaggcgtggtggcgggcgcctgtagtcccagctactctggaggctgaggcaggagaatggcatgaacccgggagacagagcttgcagtgagccgagatcgtgccacggcactccagcctgggcgacagagcaagactccatctcaaaaaaaaaaaatgaaaaaataaaaaggcaaaaattcagacaactaaacggaaactgggcaaaagagttgaaccagacctggctgggcacagtgactcacacctgtaatcccagcactttgggaggccgaggcgggcggatcacgaggttaagagttcgagaccagcctggccaatattgtgaaaccctctctctactaaaaatacaaaaaattagctgggcgtggtggtgcatgcctgtagtcccagctactcaggaggctgaggaagaaaaattgcttgaacccaggaggtggagcttgcagtgagccaagattgtgccactgcactccagcctaggtgacagagtcagactccgtctcaaaaaaaaaagagttgaaccagcccttcacagaaaaggaaatgtgaaggaaagggcaataaaaacatgaagagggtctcagctaacaggatgaggatcacgtgtcacccaccagacagcaaaaatcccacagcccaatcaatgcaaggattgggaagaatggagagcaataggaaccctcagccactgctaagaatgatgtgaaattgtttttggtatccctgcatatgaaagggtgtgttttgtgggttatgaggaaaattacatttcttacctgggatgaaattgtaaaaactgaaagctactgaccaggagaaatgtgcacctgtgtacaaaagaaaggcccaagagcattcccagcagcacagtcctcagggccccagcctggctgaactctcgtccacaggaagatgaagacatttcccatgctcccctcagacggcgggagatcgtgcagcaatgaaaaagactcatgttagtgtgggtgggtctcaggaagagaatggagacgggagatcacgcagcaatgaaaatgaaccatgtcaatgtgggtgggtctcagggagagaatggaggacagaaatagacatcaagcagatactcagacccaacgcagtgtaggagcagccacccaggagaattccttcacatcaaagttcaaaactacagccgaggcaacagagccctgtctcaaaaagacaacagaaagttgaaacagaaactagaacgagtctgagggtcatggagctggagacccggggaggagtcagtgctgctgttccagtttgcgggtcgtggatctggagacccagggtggagctggtgctgctgttgtagtttgacggtcatggagctggagacctcgggagggtccatttgaagagcagcaccggctcctccctgggcctcaggctccacgaccttcagactttaaaagcggtaataccggcttctccctgggtttccagctatataaccctcagacatgaagcgcaacagcaccggctcctccccgcctccagttccatgaccctcaaactacaacagcagcaccagcctctccccaggtctccagctccaccaccttcaaactagaacaacaccaccagcttctccctgggtctccagttccacaacgctcaaactagaacaacaccagcttctccccaggtctccagctccacagccctcaaactagaacaacgctggcacctccctgattctccagttccatgaccctataattagaacaacaccagctccttctctggtctccagctccacaaccctcaaactagaataacaccagctcctctccaagtctccagttccatgactctcaaactagaacaacaccagctcctcctcagttctccagctccacgaccctcaaactagaacaacactggctcctccccaggcctccagctccatgacccttaaactagaacaccaccaccagcttctcccctggtctccagctccataaccctcaaactagaaaacactggcaccaccccgattctccagctccactaacctcaaactagaacaacaccagctcctcctcaaatctccaggtccaggaccctcaaactagaaaaacactggctcctccccaggcctccagctctgcaatcctcaaactagaacaacaccatctcctccccaggtctccagctctgtgaacctcaaactagaacaacaccaccagctcctcccaggtctccagctccccaaccctcaaactggatcaacaccagctcctccagggtctccagctccccgaccctcaaactggatcaacaccggctcctccagggtttccagctccccaaccctcaaactggatcaacaccggctcctcctcagtctccagctccgtgaccctcaaactggatcaacaccggctcctcctcagtctccagctccccgaccctcaaactggatcaacaccagctcctccagggtctccagttccccgaccctcaaactggatcaacaccaggtcctccagagtctccagctccccgaccctcaaactggatcaacaccagctcctccagggtctccagctccccaactctcaaactggatcaacaccggctcctccagggtctccagctccccgaccctcaaactggatcaacactggctcctccagggtctccagctccccgaccctcaaactggatcaacactggctcctcctcagtctccagctccgtgaccctccaactggatcaacaccagctcctccagggtctccagctccccgaccctcaaactggatcaacactggctcctccccaggcctccagctccgtgaccctcaaactagatcaacaccagctcctccagggtctccagctccccaacgctcaaactagatcaacactggctcctccagggtctccagctccccaatgctcaaactagatcaacaccagctcctccagggtctccagctccccaaccctcaaactagatcaacaccggctcctcctcaggtctccagctccccgaccctcaaactggatcaacaccagctcctccagggtctccagctccccaatgctcaaactagatcaacaccggctcctcctcaggtctccagctctgcgaccctcaaactagaacaacaacaccatctcctccccgtctctcctacttgcatgtccatttataggctctctgcaagaagaaaaatatggctttttttgcccgaacctgcaggcagtcagaccttatggttgtcttcccttgttccctaaacattgctgttattctgttctttttcaaggtgcactgatttcatattgttcaaacatacatgttttacaatcaatttgtacagttaacacaattatcacagtggtcctgaggtgacttacatcctcagtttacaaagataacaggagtaagtgactaaagtaaagacaggcataagaaattgtaaaagtattatttgggaactgacaaatgtccatgaaatcttcacaatttgtgttcttctgctgcggctccagctggtccctccattcggggtccctgacttcctgcaacatgctggcatgcacctgtagtcccagctactcaggaggctgaggcagagaattgtttgaacctgggaggtagaggttgcagtgagccaagatcgctgccactacactccagcctgggccacagagcgagactccgtctcaaaaaaaaaagaaagaactggaggctgacacaggccaaagaagcagctcaggctgaaattgaacagtaccacctgcagagggagaaagagttgaaagccaaggaagctgcggcactggaatccatggcactggcagcaccaaagtggagaaggagacccaggagaagatgaccatcctccagacctactttcctcacaacagggatgaagtctgggataacctcttggcttttgtctgtgacattcagccagaaatgcatgaaaactaccgcataaatgg

SEQ ID NO: 881 - DNA, 3345 bp, Homo sapiens
tacttcctgcaacaatgtgatcctagattcagcaaaacaaaacaaatcctgttgctggtttctcctgctcaggcctggaggcatccagacctcaccagaacagacacacaatatagtggaactgatgtgtagacgcagtcaacacacaagaacaaccatcacccggggagtcaaccctgaccccagggcgggggagaccagaaactctctcccatgtcctctctcccctcggcctcaggagggacccatgtgggcactggcatccaggatgaagactacacttcccagcatcccttgcagcaagcagtggccatgtgaccaggctgtggccaatggggaggcgaggcctgtgcacagcggctgcctttagaggaaggaagttttgtgccctgttgtccccttctcctctccctgctggctggcaggagacagggtggactctcagggggaagctacaccctaaggaagtcagaacagcaagatggaaggaggctaagaccctaaaaactgcatagagaagaatctcccgactgccttggactttcatgtgaagggaatgaacctctgtcttagttaagccaccgtgattcagggtccttgtcacattcaccgaggctgtaacctaattggtagaaagaacaggagcgggaggggagatggagtcagagaggcaggcagaggtcagatcacatcaggcctgcaggtcaagatggaggaagaaacaggcaacataggactcaaggaccacacctgctcccaggtgaagggattttgccgtgggtgcccctccctgtctgctggagaaagctaatttgacccacttccctttaggactttgcaagatgcacatcacagtcacaggtacttgtctcctaacagtcctttcaggggaactgccccacccctaattaacccagcctcaggtattcctttatagcaatgcaggtggactgacacatatctttagtgtcgtgagactgtgacaagagcaggaaagaatcctcgtgtgcatccctctgagcgttgggagctgttgttgtagcagctgctgttactcatcctgactgatacacagacaccgccagtagccctctctcctggaaacgccatgtaagttaggtgaggcatgacccaggaaagctctcaagctgacttccctcctaccctcagggctgcggagcaggtccctcattatctaagatcagttggacacctgtacgcctgccatggcctggagcaagtgccaggcactgtggatgatgaatatgagaacagcatcaaccctgccctcctgcaggtgactggccagaccgtgggattcctccacaaccaactctgcacacacagctcactcatgtcgagcaggaagcggagcttgggatcacctgacccgctcccctcacctgggagcagcttatatagaagcgcctgtagttcacacagggctgatggttccagcttccaagacaccccgaggcctcctgggctgcttggtaatcagaccaggtacgtgcaaagaggcatggctctttattttcacttaattgagaaaaccacatcagcaaagagagcatccaagctcagtggccctttctccccacaacagtgaccattaaccttttaaaagatgctttatgggttatttgccaaacctccttcttcatgccgaggtgtgatgaggctcataaataggccagacttgggaggggacaaatgcgagcaatgccaccaatgagaggcccaggcagagccggtctcggggctgcccagccatgtgtgcaccaaacatggatgtgtcagtggccgtgccaggagtcaagctcttggccaggggcctctgggtggccaaggccaagtcttgttcaaaaggtgagttcaactgagccaaccatggcagaaatacataagggagaccccatgcctcctctgggtaaaatcccctgctaatcccacctggctcagaggaggagccatgtcctcacagcagcctgcagtccccgcctgactcagcctcctctcggctctgattctccatgcccctctacccctctctgtctcctctcccaccccagaaaggggatcctgcaggttcatcctggtggattcaaacccatctttgccacacagatagtcatcagaatgaatgggcataatctataaagagtcctcttgaaaaagaaaaaggcaggccaggtgcggtggctcacatctgtaatcccagcactttgggaagctgaggcaggcaggtcacctgaggtcaggagttccagaccagcctggccaacatggtgaaactccacctctactaaaaatacaaaaattggctgggcatggtggctcacgcctgtaatcccagctactctggaggctgaggcaggagaatcgcttgaacccggaaggcagaggccacagtgagcgaagattgtgccattgctctccagtctggatgacagaatgagactccgtctcaaataataataataaaagaaaaaggtgccaggtgctgtggctcacgcctgtaatcccagcactttgggaggccgaggtgggcggatcacgatgtcaggagatcaagaccatcctggctaacatggtgaaaccccgtctctactaaaaatacaaaataatggtaataataataattagccaggcgtggtggcgggcgcctgtagtcccagctactctggaggctgaggcaggagaatggcatgaacccgggagacagagcttgcagtgagccgagatcgtgccacggcactccagcctgggcgacagagcaagactccatctcaaaaaaaaaaaatgaaaaaataaaaaggcaaaaattcagacaactaaacggaaactgggcaaaagagttgaaccagacctggctgggcacagtgactcacacctgtaatcccagcactttgggaggccgaggcgggcggatcacgaggttaagagttcgagaccagcctggccaatattgtgaaaccctctctctactaaaaatacaaaaaattagctgggcgtggtggtgcatgcctgtagtcccagctactcaggaggctgaggaagaaaaattgcttgaacccaggaggtggagcttgcagtgagccaagattgtgccactgcactccagcctaggtgacagagtcagactccgtctcaaaaaaaaaagagttgaaccagcccttcacagaaaaggaaatgtgaaggaaagggcaataaaaacatgaagagggtctcagctaacaggatgaggatcacgtgtcacccaccagacagcaaaaatcccacagcccaatcaatgcaaggattgggaagaatggagagcaataggaaccctcagccactgctaag

SEQ ID NO: 882 - DNA, 112733 bp, Homo sapiens
agaatcatgaccagttgaatgtgagagataagaattatgaaggaatcaaggacagtctcaaatttatggcttgatgatttaattaatgattatttcagtgatgaaaataaagaacacaaaatatatggtttgggtgagcaaaattattagttgagttatagacatgatgaaattaaaatattgcagcaaatctatgttgagatacacagatatcagaaacaaaatctggggaagaaaaatagatttttagagtcattgacatagagagctatagattgttgttgaaacagggtgatggattcagtaccaggaggtgaaacgacatgagagagagagagagagagagagagacagagacagagagagacagagagagagaaattaaaaaaggtaatccttgtggctcacacctgtaaacccagcactttgggaggtcaaggtgggcagatcacctcaggtcaagagttcgagaccagcctggccaacatggcgaaactccatctatactaaaaatgcaaaaagtagctaggcatggtggtgtgcacctgtaatcccagctactcaggaagcagaggcaggggagtcgcttgaaccccggaggcagagattgcaatgagccgagatcacgccactgcactccagcctggtcaacagagcaagactctgtctcaaaaaaaaaaaaaaaaagtaattccagtattcatgaatgtagacaaataaagaaatgcatccaaaaggaaatgctcagagtagtaataatctcaacaagaagatcatggtcaataggatcaaatactgaagactagtcaaataagacaaagaaataggggttcctaaattttggtacttatgcagatactaatgcctttaacagagaagttaaaggtagaaaacctacaacagtagcctgaaagtaacatgatgagaaaaaaatggatgatagagtagattatttgtaattgaacctaagtttatttcataggtacttattcttcattgagcgttgcactaaattatacactgtagttctttgtacctctctctttctctctgtcaaactctctctcttctattatacaactgggtatataggaaggaattttatgtatcctaaaatgtttaaagtgacatttatgcggtgaaaataagcttcactcttctgggtcaactgtgaaatagcataaaaagtccgaggttaaattagaagcaaagcattttctgtcaaacacagtttttactgaaaaaaaaaaagacttacataaaatatataactatgggtggctcatttagttgtatatggcagaattttttctgtcctctttccaaataactcgagtggtttcttcagtttgacaaatagttataaaaacaagtttgcagcataaaagaaaaggtggcaatcagctcctgcacaaaaactgattattaacttaaacaagtcatagaaactaatggtcaggattgcaattacagtcacaaagaccagaccacatctttatgtcagagggcatagagttcactcacattcaaggttcaatatgtttgaatacaaacacaagatgggtgattacacagaacccagtccatgaggtgacttcattcattaaccttggaaaatcctccattgaaattagacttttcttagtttatcgatgtttatgtgagataaactcaaggcaaacttgtatgacctcaaccatttcccttgtcactcaaggaaagggaattatttatttattaaattataaatgtatttataataattataaataaattgttataattttatttttaatttatattttatattgttataaataaattataacaatgaaaacattcacaatgctttaagaatggagtcttagccaggtgcagtgctcacccctacagccttaatactttgggaagccaaggctggaggatcacttgagaccaggatttgagaccagcctgggcaatatagtgagacccccatccatatgaatttttttaaaaaacttctctgtgaagttactaaaatcagcaaaaatgggttaatattctcctcaaagcagaaaaaaaaagatctccatagttcccaggtttttctttaagaacttttactatattgaaaggataaaagatctgtcattcctcagagcatatcacaaagttatcttccaaaaacaccctccacaccatcactacatggcataacttccctatcatgaagtagtaaagaatcaatcatagatattttcttaacattggataacacactgtttctcagggactgtctgcttaagggttttctaagacactatggcctcattgcctgaaaacaaccagttcctcactggctactctttaataacacaattttttattttcctttttccctccctcttcatttaattgatgtgcacaggagagcagataagggtgatgttcggctagtgatcaaaaaaatatttttgtcataaaaatcaacagaagcctctattctagcattttcaggtggtggtttcagagtctttcgggtaattggttttcttggactcagcaaaggcagacttgctttttctggggaagatatatttccagaggttagtgcttgtaaatctgctgttaggtgctggtatatttagtgactttggatctatggaatttgaacttgagaagtccttcctgtggcaaatttaaaaatagagcagcgttgcaacaaacataaccaaaaagaaagtgcttgcctttctgacagttcagcttgagtgcttccagagcagatagatacgtgactctcctgaatcaggcatttgagactttactgacgaaccttttaaataattatcaaaaggtcacttacatatgctgttagatagactaaccattgaaagcatgagaaaaactgctgattttaagtagtctgttgataggaactgctgtggatttaaagaaaagataaatgtcttctgtcacaatactgtcttattgtaaacaaattctatcctagctagagattcactgaacagaaaaggagcatttttagagacagttaatgtatcaggtttaactgattttcataatggtgtttttaaaaaattttccctagctttattattttatgattttctaacttatcagtatcatttgttcacacattaccatctatcttacctaacctgtagaacttccgttcaagtaatatggtgtatgttaaatgactattgttgtcatcattgctgttattgtcataattatattactcatagagttgtttaaaaccttgttgttcaaagtgtcatctgctgactaatacgacattggaaatgagtctcaatcatcaaggtttattagccagctatagtgtacatccggaaaaataggagccacagacacttttgtttttccaaagaggctttatgtgggtatttataaatttccttgaagtgggagagggcaggtagaaagaggggcaggtgagcaggaaggcaaatggctacattcccatgagacttgggttagtgcccagtaaatctacatttacataagattaatgaatgtttgaagagaaaaagagagtaaaggaagaagaaattatgcagatgtctctgggtaggtggaggaatgagtcttgacattgttctgcacctgggaagataagctcatactggtctttatcagtgtgaaatccaacagactttagttttaagagctagacttacattgtagccctgaagttacaattggcattcccttgtttatatgagaggccagcaaaaattttacttttgaatgatctatagggacagtccttttagatgcttgaggccttttaccttcccatggggatctggctaaagaataatgttagtgacagctattcatttggaagagggtgtggcaggacaggcttcattctcctttttgcataagaagtttagggttcctgagattttaaattttttcctttacaaaaaacatcagcatcacctgggagcttgttagacatgcagaatctcaggttctaccccagacctactgaatcagagcctgcattatagaagaaccccaggttattcataggcacattaaatatttaaaagtactaccttaaagggataaaattacttaggtaaaatacctataatagtcctggtcaatgtttgttaaatgttgtcttccctccctaactcagaaaatggattaactcattttctgtctatcttagaaagctgaccttcttttgtttgttatcaccaaacattatcatcataaataacaataataagaagaggtattacatccttactgttataaacattgggaatataagtacaagctatgatccctgaaatagaatatataatctatttaggatggcaggacattttatagaaagtacttaaatatgaggtatctatgtagaaaaactaattctctgtctatgaaaaatagcatcccaacaaaatgactagatagctggaacagtctcacttgaaatacaggcaatttgttgtacatgaaattcactttggaagtttctagtttagacgagttaacttctcagaaagttagatggttatctgtgagatgagcagaaactgagggacagtacaggaggaccacttggccactgattgagagagacttgccacatgtatctgctatcttggacagaaaagaaacaaaacagtttctgtaatgagtcaaaaactgaaagctcttagcctggatgtcctgaagtgcagaaataaagttgagccgttttttcatgtaaactgccataaacgtgagcataaaaagcagtatctttaggtcccctcccctcccctcccttcccttcccttcctctttctcttcctttctccctttcttcctttcttcctttcttcctttctagtacagagccaggcacctagtttaaggttatcagaaatttgggagagccagggttgggtctaggtgagggctgacaaaagaaccgctgcattccaagttctagtccatgaattgataagcctgtatctaccttttacagagctttcaagactgtatgaaattagatgttattccctctcaggctttatcttttaaaagggatggtcttcatgtgtgaattcttccaactcattatattccttaactttacgtaagtcttttccatatccactataaaaaaagtcaaagtatagcaatcagatctacatggaatatttgcggaatctgataacctgctttgagtttttttctctcaaaaagaaaaaaacctgttaataataatcaactattttagcccatttgtctgcatcaatttggtgatttcaatggagaatctacagggatgctcaggtgcctccttattgttatcccctgttcaaatctcatcattgtataggtgtggcttcaattattttctcttaagccaacattgtatttataccaaaggaatctgacttgtttcatttctgctcagtcttccagagctctaaatacttcctcaaatttaattacatcaatttggcatctccctggtgttttcattctgcactttctcttctggatcatttgcaagaatattcgtgtattagaaactcaacaattttttttctgtcaagtaaagtcctgattagccttccattgcttcccttcatctgagctacttccatatatgattaaaatctttctcagtataagaagtaaagttcctatattgaatgcatttctcaccaattcctttactaatctattaaaggattttaatgtattgttaggtaaaatgttctacagaaatcatccaagcttttctctataatgcatgtttctttagatattgtatgatactaaaacttgaaagtggtctggtcttgacattctacaaagtcaaaatttattttttctaatagataaactcttagattgtgaaacatgcacttaccccaagagagaagtctcctcattcttccccttactactcagtggattctaactttacaacacgtaagagatttatactattaaatagctgttaaagactaatttaagaaacttccatatgtctgtaaagtgtttttgcaatgcgtatttaaaacttgaaatttgcataaactaaagagcttttgcacagcaaaagaaactaccatcagagtgaacaggcaacctacaaaatgggagaaaatttttgcaatctgcttatctgacaaagagctaatatccagaatccacaaagagctcaaacaaatttacaagaaaaaaacaaacaaccccatcaaaaaatgggcaaaggacatgaacagacacttctcaaaagaagacatttatgcagccaaaagacacatgaaaaaatgctcatcatcactggccatgagagaaatgcaaatcaaaaccacaatgagataccatctcacaccagttagaatggcaatcattaaaaaatcaggaaacaacaggtgctggagaggatgtggagaaataggaacacttttacactgttggtgggactgtaaactagttcaaccattgtggaagacagtgtggtgattcctcaggggtctagaactagaaataccatttgacccagccatcccattactgggtatatacccaaaggaatataaatcatgctgctgtaaagacgcatccacacatatgtttattgtggcactactcacaatagcaaagacttggaaccaacccaaatgtccaacaatgatagactggattaagaaaatgtggcacatatacaccatggaatacaatgcagccataaaaatgatgagttcatgtcctttgtatggacatggatgaagctggaaaccatcattctcagcaaactatcacaaggacaaaaaaccaaacaccgcatgttctcactcataggtgggaattgaacaatgagaacacttggacacaggaaggggaacatcacacatcagggcctgttgtggggttgggggaggggggagggatagcattaggagatatacctaatgtaaatgatgagttaatgggtgcagcacaccaacatggcacatgtatacatatgtaacaagcctgcacgttgtgcacatgtaccctagaacttaaagtataataaaaatatatacattaaaaaaataaaataaaacttgaaatttgcagactttaaaatagaaattctacttttagaaatgtattctaatgaaataactaaggtaaacattgaaatttagcttaaaaaggctacagtattttttaataaataaacaccatatagtaaattaccaaaatgtatatccactaagtaagttagagtgcagaattttgtttgtttgtttgttttttcttgctgtgctgcccaggctagagttcaatggcgcaatctcggctcactgcaatcaatccctgcctcccaggttcaagcaattctcctgtctcagcctcccgagtagctgggattacaggtctctgccactgagcccggctaatttttgtatttttagaagagacaggtttcaccatcttggccaggctggtctcaaactcctgacctcgtgatccacccacctcagcctcccaaagtgctgggattacaggcgtgagctactgcacccgcccagaatgcaggtttttaataaaatgctatgcagccatgaaaaattacattaaacaatatttaataacatggaaaggggtttaagttattttaagtgaagaaaaaaataaattaaaaatatatgtgatacattttatagagacaactacctacacagaagaagctgaaaggttatacaccaaatattattcatcatgatttctggtagagaaattacaagaaatttctactttaaaatttttgtattttttaatgaattacatttctaaagatagtagaaaaaatgaagctctcttagagctgattcaaaatctttcctattagaacctctgttcatctctgaatcttatttcaattataaggaaagctgtgaatagcttgtaacaacatccaattcaccattgtgagttaattttttaaagtttcttctcccactgtatatggtgaaataggtgaatgtattaaaattgctaaattttgctttttctgaatttagctaatccttcttgagatgtgtgtgtgtgtatatatatatatatatatatatatatatatatatatatatatttgttcttcagcatttttctttattttattctatctccttttgagctaaatggatgacctatctgccagctccattagtaattttatttactgcttcagcctttgaaacaagttaatgcagaagattgaatagtattttagaatttacttcacacagtaatgtgactcaaggcttcattggctattatgtcccctttggcattaaatattttaatctgctaactatgacagatacaggatggccaatttcccagtaaatgtattagcctcctagtaaattaccctttcccaccttataccatgcagcctattaacctataaaatcccttctcttccaatataggcaagatgtcttaactgaagacttaatgttgaacacatcctaaagcttgagaagaccttatttcagagggttgggaaaggaaaactaatcattgcaagcaaactttaagttgctgagactacagatgtcactttggttcatttcctattaccatcgtttgatgaggatatagcccaaaaaccaagctagatgagtattttaataaatgtggactgagattgctttaacagaaaatataagaaatttctgtgtttttagtaatatatcctaggttcaaattaataaatctcttgattattctgtgccttaaacttgtatgaccatctagtcgtaccatttgagcaaataagttaccacctcaggaaaaatgaagtcagcactcaatttatatctataggataattgtgttttgttttgcttttatcttaagcccacactctagtaaacaaaagctatcagaagaaagctttgtaaaatattacagattgtgttgttaaataatactaagaactttcttgcatttcatggaaaagataatgcatattgtgtacttttcattattttaaatgtgtctaggaccaaataaaccaacggtgttctctgtccttctactggtttgggaaaagatttatgtaacaaaccattatcttctagttagaaatcatgaaagatgaggactgttgttcctgtaattaatcaccctatagtagaactctctcacagtgacttaacaaaatacacttatgtatgaatcttaaatatgcagaaggaatactaaagttgaacgggtaggatattttatcttcttttaagctttcatatggttaaataaaacaaaaattaaaagtctataaaacagaatgtatagctttacaaataattataaccaatacccaagttgtggaaaagaatattatcataaattacacacccttatatgctaatttttctttttaatgttaccgcataaacgtccctttctaaacagtataattttatttctttctgaaatttacaaaaacagcagctttatttcttgcttattttagtcaatactacacttgtgagattcatccagattgctatatgtacctataaatcatttattttgttgttccttttttcattatataaatataacacaaatccattctactgtcaaacatttggattgcttctaggaaattacaattaatgctgctattaatattttctcattcctatatgcatcagtgtcttcagattatgtgtctgggagtggaatggttgggtcacagagtgtattaacttttcatttcagaagacaatgctaaacatgtttctaaggtgtccatactgatgtagtctcccagcaacatatgagtatttttgatatttcacatcttcaccacttgatattgtcaatcttttaaattatagccattctggagagaatacagttgtgttttttattcggagttaccaataactaaagagattattctgttttctatatgttcattagatatttgggttttgtcatttgttattagtatatttaagtcacttgcccattcccaagtggttagcttctgtctttgtatattttgtatatctatatctacaaacatatacgtatgttttatctacataaaattatgtatgtacattatatattatatatttaaatataatatatttatcttctggatataaactcattgtcagttaagtattttgcaaatatatttttccatgtgaaggcttatactttcactctcttatggatgtattttgataaacacaggtccttagttttcatgcagtataattatctcctgtttatttttatgtttactactcttatttcctattaaaactttttcatatcccaagcttatgaagatattctacactatcttctaaaaacatatgtttttgctttcacttttaagttactaatccacatggaattggtttacatgaaagatatgagggagaactcaaatttcatttactttcacatgcatgtaattgtcacagcatcatttactgaaaagaatatattttccccacttttgtagcatcaaatcatcatcataataatcataataataaatgtatatttctgtatttttattccatttgtttatccttgattcagtacaacatggttggatcagtctgttttcatactggtataaataactgcccaagactgggtaatttataaaggaaagaggtttaattgactcactgtttagcatggttggggaagcctcgagaaacttacaaatatggtggaaggtgaaggggaagcaaggcaccttcttcacaaggcatcaggcggtagatgtgagtaagtgaaagcaggggaaatgccagatgcttataaaaccatcagatcttgtgaaatcactcactatcatgaggacagcatgggggaagccaccctcatgatacaattacctctacctggtcccactcttgacacgtggaaattatggggatcatggggattacaattcaacatgagattttgggtggggacacagccaaaccatagtcatggtcttaattactttatttttatcagatttgatatgtcccatggagtaattccttccatgttacactttgtttctgtcagagtagattatactgcaataacaaagaattttaaattgcagtgacttataacaacagagctttttgttttgtttttcttgctctctctagttgtccattttgggttgtctggagaatatacttgatttcttctaattctggagcccacactgattgaacagctactctcttgcacatattgctaattaccttagcagaaggaagtagatagagtgtggtgaattattaattggctcttaaatcttctagccaggagtcacaaatgtcactttcacatttcattaacaaaacacgtcacacgaccactcatcacctcaaccaagaggagaaaataaaatattggatagacagcactaatgattaacctaatcttttaaatgagtatataacttattcttgttcctttgatttttctttctttcttttttttttttttgagatagagtctgctctgttgcccaggctggagtccagtggcccattcttggctcactgcaagctccacctcccgggttgatgccattctcctgcctcagcctcccaagtagctgggactacaggcgcccgccaccacgcccagttaattttttgtatttttagtagagacggggtttcaccatgttagccaggatggtctcgatctcctgacctcgtaatccaccctcctcggcctcccaaagtgctgggattacaggcatgagccactgcacccagcctgatttttctatatgaaacttcttattaatttgtgaagttcataaataaatattttaaagattttggttggtattgcattaaatttataggtcagcctaaggttatttgcaagctttaaaatatttggtcttacaatccataaacatgaccatagttagattgagaaatacagatatagatttcggtcttcacacatgtttctttcaattatgatttttggttttctgcatacaggtcttgcataactttttgttacatcatttcttagtatctgatttttttttttttttaagatggagtttcactcttgttgctcaggctggagtgcaatggtgcaatcttggctcaccacaacctccacctcctaggttcaagtgattctcctgcctcagcctccccagtagttgggattacaggcatgtgccaccatgtccggctcccattttgtatttttagtagagatggggtttctccatgttggtcaggctggtctcaaactccgaacctcaggtgatccgtccacctcggcctcccaaagtgctgggattacaggtgtgagacaccgtgcctggctgtatttgatatttttgatattattgaatatattatattttataaaacttcattgcttatatcttttttctagtacatagaattgcaattgattttttaaaatactgacactgtatccagaaactggctaactcacttattaagtattataatttgtctttgcattgtattttctctacattaaattatttccaattcttcctctttctgttctttttctcatatttcatcctcaattagaatctctaggacaatagaaaagtgtgattgtaaacatctttattttatttccaattccaaaggaaagctttcaagtatcattattccattagatgttatagatttttttgtcagatgtcatttatcagctgtgaacattttccattgattcctaattggctaaaattctgattttgtcagatatttttctgcatgtattcaagtgatcatccaatattttagtattttgtaaattcatatgtttaattaaatcaattaaaaatcaattacaacaattgatttttgagtcttacagcaactttgcacttcctgaaaaatatgtatctttcttataatacatttttaaatgtttctagttggtcataacatattatccttttatatactattggatttttttgctaatatttattaaggatttttttgcattcatattcacgaagaatatttctctgtaatttttataatggaaaggttttgctattaaaattattctggcttaaaatatgacttgcctttctccatttttttttttttttttttttttgtttgagacggagtcttgctctgttgcccagcctggagcacagtggcgcaatctccgctcactgcaagctccggttcccgggttgacgccattctcctacctcagcctcccaagtaggtgggactacagtacaggcgcccgccaccacgcccagctaattttttgtattttttagtagagatagggtttcaccttgttagccaggatgctctccatctcctgacctcgtgatctgcccgcctctgtctccaccaaagtgctgggattacaggcgtgagccaccacgcccggccgcctttcttctttgaatgtctaattgaattaaccagtgaaatcatcaccactatgagattttttgtaataaccccttttctatttctgatattgattatcgtttttattattgatctgaatagttagaattttgtcagttttgttggtctcttcaaagtgagctgttccctttctcatctgttttctatttcattgatttctacttttgtcttcactgttttcttttacctgcttacttgctcacttactttcaccttgttaaggtgaaatcttaggactttagttttagattgttctccttttcttatataagcatttaaagctatgaatttgctgctaagcattaccttagcttttcctacaaattgtaatattttatattttccatgtcattcagtttgaaacattttctaattatcttgtaattttgttttaattcatgaattatttagaagtgtgctgtttaatttatagatattgggtgttttcttagatatctactttgatttctactttaattatgttgtggtcagagtgcacacctcgtatgattcttttttaatttattgagacttatttatggcctggcataggatctaatttggtttatgcactatgcacatgtgcaagaatgtatattttccagttgcatatactactctattatactaataagataaagacgtatctttaatgtcttcattgatttttgtctaaatgttctatttattgctgacgtagaggtgttaaatttactacaattatgaaattgtctatctcttaaattctatcaatttatgctccataaattgaggcctattatcaggcacatatacctttataaatgttatgtcttcctgatgaatgcctattttatcatgataaaatttttacaatctctcattatacacattgtcttgaagtctactttaactgataaactatcccctcaattctttttatgtttacagattccatgatatatcattttctttttacttaccttcagtctgtctttatagatctgtatctttatacttgaagtagcttagagtaaaatcttattttattttatccactttggcattctctatcctttaattggaatgcttaggcaagggatatgcaaaataggctcacaggccagccacctaatttagcaaaaatcgttttaaattggacacaaccgtgaccattcatttacatattttctatgactgctttcatgcaaaggtgattagctgagacagacaccatatggcctgcaagatgaaaatatttactctttggccctctaagagaaagtttgccaactgctagtttacatcattagcactcactgtaattactgatgtggataattttagatctaccgttttattattattttgttgttcctctattcccacttctttgttttctttttgattatttgaatatttttattatctcattgtaatttctgtctactggctgacttttttttaatctgttgattttctgcttataaatctctgatttttttttcagtttgttctagagattacaatatgcatatctaagctgtcatggtttactaagagttaatattgtattagttaatataaaacgtagaaatgctgctactttataaatccttttgccccattgaattttaggttatactttattgcttttatatacattgaaaaccccaccagataattattttttctttattaagtgaatttaaagagaaaaataactgttttctgcaattactctaatatttaccctttccaattgttctcaagacatgacggaaggtccagatatcactttggcatcattccctttcctttagccttttgttagccaatgttcggggcagatctggaaggtaataatttttctcaatttttattttacctcccttcctgaatgatatttttagtggatataaaattacggcttgacagttctattctttaaaatgttgtttccctgtcttctgaccttcattttttctgatgagacattctcatcagaaaaatcttattcaaatcactgcattcctgtaagtaatatacgtatcagtttcctctagctgttttgaaggtttttcttcatcttagagttttaggggtttatgatgtgtctatggttttctttggttatactgtttggggtttgctgagcttcttgatgctataaacttaagacttccatcaattcaaaaaaatttaagaccactgtttcctcaacttctgctccagtcactctcttgtttcttgtattgttacattagtaattccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctgagtaggagtctggctaatcatccaaaaatgtcaaaagagaaaccaaggtgaatttctttcccaagctgagatttgaaataaactgctagaagttgtcactgaatgtggatattagcaaataactttaagctacagaaacatcacagatttctgctttactacttttctgaatttgtaaaacacaaagagagggagagaaaaagagaggtggagaggtgggagggagtgggctagggtgagggcaagagcagggagcggggagaagaggatggtagggggagggggagagagaggaagtgggagaaaagggacaaagggaaggggagggggtagggagaaagaggggaagggggagggagggagggaggagtggggaggggtttaggtggcttttgaagtctaaagttcatttttcaatatcactatcactcaatattatgaacagggaactcacaggcagttgacagacacaggcaaggaatcatatgattagactaatcagtggaaggtgcaatgacagaggatggcatgggagcctatgaagaaagagatgatgtttctgtatattatacattctccagaaactaagagctccaatagtctatcgagacttcatttccctggcctggcgaggtggatcacagatgtaattccagcaatttgggggccaaggcaggagaattgcttgagcccaggagtttaagaccagcctgggcaacatagtgagaccctgtctctgtgaaaaataagataattagctgggcatggtggtacatgcctgtagtcctagctattcaggaggctgaggcaggaggatcatttaagcccaggaagtagagactgcggtgaatcattattgcatctctgcactctagcctgcgtgacagagcaagtctctgtctcggggaaaaaataaaataaaaataaacgagagagagaggaaaatttcatttcccttaacagcgaagggcttcactaaaaacaaatttatcatcctgccattttactaagatattgttttcacacatccccctttcaggtcattgccactcaaccatgttcaatctttaccctcctcatctctgagctggcatccatccatcttggttgatgattttttccagctcagagactcagtgccccagcacagcagttctccaagttacaataataaacttcatttgctcttctgactactctgggtcctgaaaatgttataactgacacagttgcagagccatccattggaacaactacactaaaatatagagattgtgttcaaacatgtatacttcacatttacagtaattactatggctttactttcatttgcttctctcagttttccttcatcttgcaacaagacaatcaagaaaaagcaggtagtaggtagcttctaacagaagaacagacaaaagagagcataaagaagatattagccaagaagtgatgcttgacatttttttcaaatagaaatctattaaggaccttaaaaaatcatctattatagccaaactggtgcctaactgaagtagtagctgagagtgcttcattgaaaatcaattagagtccaacctgattgtagacagtgtcccttcaacaaaactgacaagcattctatctctactttgataacatttgtatccaaaatgagaaaacactagagaaatatgaaaataaggcaatttcaatgtatgagttatatcccttaagttcatggatgacattaactaagttctgacaccaatacccctagggtgtctttatttcactcccccttctggaaatgattgaataatttataaaggatatatcttgggggtggccacttctacttcctgagctgcatacagaacataacatttttagagctcagaattgggttcaccaccttccattgcacagttaaagagactgcagtccaagaagggtaaggggtttgcctgctgtcacaaagctagggagcaatagaaccaaagttcaaatccagcaatgctggctgcaactctggtatcttctttgcattcttctgcttgtaccaaatcagatgttagcagaaacgcatggaatcctaggaatagtaaacaaagagaaactgataacaggacaatttacatacatggggcagaatgacaaaggaaaccaacctgggaagcgaagtctgccagggctggcagcagagaaagcctttgcttcctatctctacatcctaaaggaatgaggaggaggaagagagaagtaactgaaatccagaaagtactctgactatagcaaaggatctgcaggagctgtggccttggaaaggaacatgccctctgataaactgtggctttgtcaggaagaagctagagaataaaagctagacatcattttgctcctggcctctaatcacctcctagtgcctctcattagccttgcccaaccagaagccagagaacaaaggaggctgccccatcgatgttctcctaggaccataggaggagagaaaggggatgtggagggacaaatggaaaatattcagccaatatttcttagctgcgccagccttttgctttgcaatttagtcttccttaccctcctctattttctttcattgggacaaacattatcaaggttaataagagataatggcccatgtaaaaagagtattgtattcttttatggactttatctaaaatttactcaaatataacagaatcctgtagatgaagcataatatgcaacagatatactttgcaatatttaaaaatgattaatctcaaaagtaatcatctcagtactatgactcattagctggaagaaaacagtaataacatgttttgtgcacagaacaattttaattaataagcaggacatatttattcaaaaattataataagacattattattctcagaacatgaactttgatggtaggtgttagcatcctgttgggtcccagagaatgcacttctggatattaaacatgatggctttgagacctcaaatatatcagcttgtacagtcagctattatctacactgacaattgtttatggctacaaatcacccacgcttgatgtgatatctgaaagtacctcagtaagatattatgagcaatatcaggagtgggtggtgtaaaagtcatttcagtaataaaacagtattcaaagagttgattcaaaaggcagagccattactaataaaaataatataggtagatatttgttaaatgttttctttcttttgaagggcaatactatgaaaggagagtgagcatagggaagttgtctgcaacctctgagccacacacctttctttggtctaccacatatctgtgcagccattaagaatgactctcatctcttgcctttccaaaatgaggtgtaagagaagtcattctggtatagacaggagatatgttaccaaaacagtccaatggacccttttagggatacttcagttagaagttttagctctgtgtgggttcagtgtctctccacattacccctgagacctaaatcccacagaaaatcttaaaggcaatagatgctagttttccttatacctttcaaaaatatgatttgttttgttttgttttgttttgttttgttttgacagagtctcgctctgtcgcccaggctggagtgcagtggtgcaatctcagctcactgcaacctctgcctcccgggttcaagcgattctcctacttcagccttcccagtagatgggattacaggcacatgccaccacgcacagctaatttttttatttttagtagagtcggggtttcatcatgttggccaagatggtcttgatctcttgacctcgtgatccacccacctcggcctcccaaggtgctgggattacaggcgtgagccaccgcacccagccgacaaaatatgaatttttaaagaccaaacacatcagaacaaaccagctaacttgacttttaaaaaccacttgatttcacacaggtctcagatggagcaaaagtaaaaaaaaaaaaattaaaaaataaagacatcccacttgaattctagacaaaattttatattatctaatggaaatgttttttaaaccacataaactgatgagacatatcctttatcctctgaaagaaagaagaaaaaaacaatatttactagctgaacaaaatgccttgagtgaaatatctgtgagcatacatttttaatttcctaagatgaaaacagttttgagcaaggagctctcaaaaaaatgtcctgatgttctcctaatacaccaagaaataaaatctgtcaaagtgctgagattcttataggttttggtacatgttcccagttgatttgatctggctccagatgaaacatattatttaagcaagatagtaatcaaggtaactaacaattttaaaaattacttcaaagcatatactaaggcttgactagtgtgtatttattctctttccattatttctagacggagaaacaatttcattatattttaagttgtatcgaagcatttgttctggaactttctgatgcattagcagattctacctttaatatagtcatatgtgtaggtgtattatcatgcctgctagaccagaagaagtgaaagcctgaattggttatcgcattcccttttggagattaaaaaatagcattacaactatctgtgttgcatttcaagctaaacccatactttcatataaattgtttcacttggtctacataataatcctgtgaggaaaacagggcagcaattactgccccatttcatggatgaggaaattggcttagaagagttaagtggcttactcaaaggcacatggctgagcagttatggacctctgactcataactaagcccagttcaagaaaacacgtatttattcagtgttttaaaattatcaccctaagtcttttgggttcaaggtagtatacatatggcagactaatgaacaaaaagaaaagtaacatttatacagtatttattatacaagagtccctctcataagaactttatagataatagggtcattatagatttatctcatttaaccccatagcgaccttgttaacagtgagataaatctgtaatgacccataacaaccttgttatgcagttaaataagataaatctataatgaccctatgtcattgtcacgtcacagatgaagccgccgaggcacaatgcagatgattaatttgtatagaatcactgacgcattttttaaagaaattaaacaattaattagtgtgtattcatactagttgtacatatttatgaggcaattttgattttagagtccatgttcttaaccactatacatatttgcctccagagattccaaaacttacggacatcttttcattatgctacacagtctcccatgagcagagtatgaaaaaaatccagatatgaggccgggagtggtggcttatgcctgtaatctcagcactatgaggggttggggcaggtggatcacttgaggtcaggagttcaagaccagcctagccaacaaggtgaaaccccgtctctactaaaaatacaaaaaatagctgggtgtgggggcacgtgcctgtaatcccatctactagggaggctgaagcaggagaatcgcttaaacccgggaggcggaggttacagtgagccaagatcgcaccactgcactccagcctggttgacagaggagactctgtcttaaaaaaaaaaaaaaatctgaatatgaatctaagcaaacatatacacacaaacaggcatacatacctagacaaactatatgtctatctctacatctacctatctatacatacaccttatgctgagggtcttgaatatgattgataatcacattctgtgtggctaattgcatttaggccaggactcaaaaaaaaaaacaaaacatgaaataaaccaaaataacctagatgagtgagaaattctaagtttgaattttaactggggaggaaaaaagataaagaaaacttcacagattggaggccacttatctccacatttaactttcaaaacctttctcaaaatatctttgtatttaaaagaatccatcagtctttgcaaagagaggagagaaaatagacttgaggaagatgtttccttctgtgtgctgtgtgactcaggacacatgcttcttctgtgcaatgctttaccatcatctgccaaagacgtgtgtgcaaatatcagtcttgcaaacagacaatatttgcactacattgaggctaacctgccatctgcttatcagatgttcggagtccaaattgtacagttttccttgtgtttcccctaatgaaaaatggaatgctggggctctgattacaagtgtctgtgcacaggactaatactacatccctaggtagagtaatggaaacagtgcatctaggggaaatggcttatatattgacattgtttaaagaaaacagaattattttctgtggctcaggttcacatgaaatataaacctcctagttcactaaagtgtgatatatttttctcaaaatttggagaaccactgatgttctggacaactgtatttcagtgttaggcctagccgaatatatcaactaaaaatgcaatcacagtgaaaaattctaatgatatgcattatttctgaataagcaaatgccagaagcacaatcccaacatattatgaatgatgtgattgactaccagggttgctcgcagcccatagcttcaggtaacacagctgtctcctcccattaatgagaaaagagatagcattttctgtttaaaattaataactgtaacactccaggattataggaaaaattctaagtgtttcacacaaagtgcttcacaaaattttactgaagttcaacaaaatcattatataacaaatacatatgagaaattcttctttatggcttattctattgaattgcctattcatttttgccttcccagaatccacaattttcagcaagatgaatatgagcagaaataaaaatgccctttctatttaataccccctgctttcaattaaaagaaaactggttagtcatttagtatcttagaatatttcttacttataatgaattaggcattaattatattcttctatataaccaaaacaattttttagcaatggacaacactattattttctaattcatgttactttttttaagcatgcctttgggcattggatcactatcagcaatgtgcagagaatatcatcatcctttgaaaagctgtactactgatgtactttacagataaatagtaaaaatgtttaatgtacacctaaaacacaattgaaataaatgccatttcaggaatttgaaagtgtgttgaggttaccaagattatctgtgatccttttcaaacagcaataatttactcaaaaggctgtcatgtctgcttacaagactgtgcagatagttgacatagatgaaattagtattaatatattcattttaatttctacccatttactgtcttactaagggtaatttaactcagaaatgccgtcataatagggtgataatctgataatccggggtgcagtggaggcagggaagaaaggaagaaaaaaggaaaaacaatgacaataaatggcacaggcaagaagaaagcaataatgtaataattactaccatgttttgttcaattatcaccgaaaaatccagaaagatatgaaaggtgagcaaaggttctaccatgtttttgtaaagaaataaaagctcactgaaatattagggagaaatggaatcaaaagtaccaatgaaaaaagcaaaaataagataatttaaaaagaaattagaataagaaaaaactaggaaataacgttctttacatgtgaataatttctttttggttgagttgtaaatcacatatctgttattcaaaaatatttcctgattcatttgaaaagaaaacatattgaaaagggatctaaacaaaggttgtttttttttcccctctttaaatgttgctacctcaaacaagctgtaatctgagtattaaagtacaaaacacttaggaaatataattttccatgattactttgagcttcctgtaagtgtaacagtttttttactacagttttcctctctaaagacagaaatgcaccgtatgggcgcaaggatgctcatgccatagcctatgctcaaaagaggattcttagtctacattccagattcagctggagtctatattaactgcatccattcttttaatgttggccatcttgtatgggttggatgtcccaagaagccacttaactatgggtgtgattgtctattcaagaacctagaaaaaatggtaaactggttacataacaaataacacatcttgatctaagttgagaggactggagtcttctagctatattatttgaaaaaatgcaatcatgatttagtgacaaattgaatagcaacttcattaaccagaatttgactgtaaacccatgcaccgtcctagccagtatctcttttctccggaagagaggcatgggaggaggggagagaaaaaggtgagctatactactttagagtcttatgctagttctgtgaggtaaatgtaactactatttcctttatttaacaaacaaaaaatgaggctcaaaaatttaaacaacttgtgccaaagtcacagaggtaagaaatactagggcaggaattgctcccatgtctgtgtacctttaaaattcactttgcagctgcacagctgataagtctgctcagaagatttaaattataagaggaaaaaatgccttgcatccctggcactgtgcctagttctttccccaaactgaaaatgatacttgcaattttttgagccctcaccatgtatctggatcatttcaattaatcttgacaatgctggtcaagggactattattagtctcattttgaagatgaagcttagagaggtaaaataacttgccccatatcctacagctggtgggagacagagatggcattctcaccagctctctctaaactccaaagcctgtgctcttcccatttattccattctgctttctctccaggagtcttcataataactctgagttcagcagctgttttcaatgaggatataggctcaaagcaaatacaacataaccggtacatggttagatttctaagcctcttgccattccgccttgtggacaaggacatcaaatacaatgaaaaatgggtgccccgcaaatcaatacatctgttctttaatacctgtgatcacagctgtgaaataggcttaatacacagcctgaaaatattgttgtgaaaataactgtgtgtttggctgttaagtaaagttcagctggacacatgatctagtaagaggtgctaggctgctgcatgcaaaggaattccattagaaaagacagagaggtatgggaggaaaccgagcacaaagcagtgtgtccattgatgagagaagtcactcccacttcgcccacagatggtggcattaataaagatatcttgtacaatccaatgatgtgaatctcaatcttcagcatggataagaatcactggggagcttgttaagaatacagttttagtgtcatctcacctaagattctgattcaattaagtctggggtggtgcccaggaacctgaattttataaacatcccagctggttttttaattattattactattggtttctactttattctaggtttagtggttacacatacaggcttgttacatgggcaaattgcgtgtcactaaggcttgatgtatgaatgagcccatcaccaaggtagtgagcatagtacataacaggtagccttccaatccatgcccccccaccaccctccccaatgaagcagtctccagagtctttgttcctatctttgtgtccatttatattcaatgttgagcttccaattataagcgaaaacatgtggaatgtggttgtctgttcctgcactagtttgcttaggataatgacctccagctacatttcatgttgctgcaaagaacatgatttcattcttttttatggctgtgcagtattccgtggtctatatgtaccacaatttctttatctggtccactgtcaatgggcatcttggttgatgccatgtctttgctattgtgaatagcattgtgatgaacatatgagtgcatgcatctttttggtagaatgatttattttcctttgggtgtatacccaatagtggaattgttgggccaaatgatagttctgtttcaagttctttgagaaatctccacactgctttccacagtggctgaactaacttatattcctaccagcagtgtataagcgttcccttttctctgcagcttaaacagcatctgttgtttcttaactttttaataatagctattctgactgatgtgagatagtatctcatagtttgaaatttaatttctctagtgattagtcataatgaacattttttcacgtatttgttggccacatgtatgtctttttttgagaagtgtctcttcttgtcctttgcccacttttaaatgcaattaatatatttttgcttactgatttaagttccttacagattctggataataggcctttgtcagatgcacagtttgctaatattttctcccattcagaaggttgtctgtttattctattgatagtttcttttattgtgcaaaagctctttaagttaattaggtccttcttgtcaatttttgtttttgttgcaattacttttgggaacttagtcataaattctttgcaaaggcccatgtccagaatggtatttcctaagttttcttctagggtttttattgttttagttctacttttaagtttttaacccatcttgagttaatttgggtatatggtgaaaggaaggggttcagtttcaatcttttgcatatggctagccagtgatcccagcaccatttattgactagagggtcccttccccattgcttgttatcgtcaactctgctaaaggacaggtggttgtaggtttgtggctttatctcagggttctctaacctgttctatcagtctgcctgtttttgtacctgaatcatgctgttttggttactgcagccttgtagtatagttttaagtcaggtagtgtaacgcctctggctttgttctttttgcttaggcttgctttggtgattcagtcttttctttgattccatatgaattttagaataactttttctaattctgtgaaaaatgtattggtactttgataggaatagcatctaatatgtaagttgcttttggcagtatggtcactttaacaattctgattcttcctatccatggaataggaagaatatttttccatgtgtttgcattgtctctgatttctctcagcattgttttgtaattctctttgcaaggttctttaaggtccttagtaagctgtattcctaggtattttattctttttgtagcttttgtaagtgacactgtgttcataatttcgttctgagcttggacattattggtgtatagaaatgctactgatttttactcatagattttatactctgaaactttactaaggtcatttatcagttctagaagccttctggcagaatctatggggttttctaagcagagtcatgttgtcttccaagagtgagttagacttcctctctatttggatgccttttatttctttgtcttacctgattactttggctaggatctcctttactatattgaataggaatggtgagtgtgggcatccttgtcttatttcacttctcaaggggaatgcttccagctttcacctaattgctatgatgttggctatgggtttgtcataaatagctcttaaaatttagagatatgttctattgatgcctaatttcttgagggttttcagcacgaaggaatgttcaactgtatcaaaggctatttctttgcctattgagataatgatgtggtttttgttggtaattctatttatatggtgaatcacatgtattgatttgcctatgttaaaccaacattgcatcccaggaataaaccctacttgatcaccgtaaattaactttttgatgtgctgttagattcagtttactagtacttcattgagaaaattttgcatctctgttcattggggatattggcctgatatttttctttctttttttttttttgtttgttgttgttgttgtgtctctgtcacattttggtatcagaatgatgctggcttcaaagaataagctagagaatcccttctcaaattttggaataatttcagtaggattagtactagctgttttttgtatgtctggtagaattcagctgtgaatccatctgctctaggcctttttttttttttggttggtaggctttttattactgattcaatttcagaactgattattggtctgttcaggattttaatttcttcccagttcttgggagggtgaatttccaggaatttatcaatttctttcagtttttctagtttgtgtgcatacagctgttcataatagtctctgaggattttttgtatttctttgagatcacctgtaaagtcacgtttttcatttctgattgtatttatttggttcttctccttttattaatctagttattaatttattatttccctaaatagtcacaaacctaatttgtcaagttatagctcagttgcattacaaaagaagttcttacatcaagtattacagaagaatcagtagtatttgcttgggcagtacatgccatcagattatgaatggattataaatgcaaactgacgtgtgacttttaaaataccatgatctatccaatttgaaagagaccattaaagtggagatttcaactcctaccactataactctaaagtatgatctttactttggcagaatattacagacttagaggtattgtttttatcacttggttttgtttttatccatagcaaagccttcaataatatttcaggccacagagaaaataatacaagtttttgcattgttgatacttcaaccaagatagtcattcttttaatgtaggtctgctggtgtcaaattattttattgttccttcatctccgagaatttcttgatttctcctttatttctgaagagtatttattactggatataggatcctgagttgacaaaattttttctttcagcacttcaaaactattgtaatttttgctggcttccctggtttccgatgagagatccagtgtcatctgaacgttcttttttccacagagaatgtgatatttatttctgactgctttaaacatttgtctttaattttcagaagtttgtctatggtgtgatttcatgtggatttctttgggcttatcatgtttggggtttgcattatagtcccatacatttctgaggttgtgttttgtttttgttttctttaaagtctattttgtccctgttgtttacattgtgtaatttctatttgtattatttttcaatggactggttcttttctctgtctcctctgttcagctattgagcccatatgttgactttttaaattattattttattggttaatatttttagttctaacatttctatttcattcttctttgatttctttgctgtaacattctatttttttattctcctttggtgacattcttcccctttgcttatttttatttttaatttttatggctacataattgtacatattaatggggtacatgtgctatcttgatatgagcatacaatgtataataaaatctaggtaatttgaatatcgattatctcaaacatttatcatttctttgtgttgggaacattccaaatcttctcttcaaccaattttgaaataggtgatattttttcatttgttcaaggatgtttatgattgttcattcatttttatgatggctactttgaaatctttgtaagataattctaacatcgctgtcatctattaaatgtatttttttattcagcttgagatcttcctggttcttgatatgacaagtgatgtttgaatgagatggagacattttggttattatgttaaaagactatggatcatatttaaaattctggatcacatttctgctttagttggcttcttctgaaactgctttggcagaggaagaagagggttgcctcattactgcctggtgagggtaatctttaggggtaaaagtggttctcagttacatggatgaattgtataatggtgaagtctaggatattagtgcatgcattatctgaatagtgcatattgtactcaataggtagtttttcatttttaccccctcaccccttttaagtcttcgatgtctattataccacttggtatgcctttgcatacccatagcttagctcccacttataagagagaaccttcagtatctcgttttcaattcctgagttacttcacttagaataatggcctctagttccaaccaagttgccacaaaatacattattccattctttttatggctgagtagtattccatgataacatacatcacattttctttatccactcatcagttaatggacatttaggttgactgcatatctttgcaattgtgaattgtgctgcaataaacatatgcacacaggcatctctttgatatattcattccttttcttttgggtagatacccagtagtgagattcctggatcaaatggtagatctacttttagctttgagaaatctccatactcttttccatagaggttgtactaatgtgtatttccaccagcagcatataagtgttcctctttcaccacgtccacccgagcatcttttggggatttttttttttgactttttaataatggttattctggctcgggtaaggtggtatacattgtggttttaatttgcatttccttgacaattagtgatgttgagcatttattcatatgtttttgaccatttgtatattttttgagaaatatctattcatgtcttttgtccacatttcagtttttaagttgtctgtttactgtaatgattatttattttgctgtgaagaagctttttagtttgagtcctattcattatttttgttttgttggatttgcttttaggggtcttagttataaattatttgcctatgctggtgtccagaagagtttttcctaggtactcttctagatcttttatggtttcaggtcttagcttcaggtctttaggtctttagtcaaggtaaagttaatttttgtatctagtgagagacagagatccactgtctttcttctacatgtgactatgcaatttttctagcaccctttattgaacagaatgtcctttccccgatttatgtttttgtatgttttatcaaagatcagttggttttaagtatttggctttatttctgagatctctattatattccattgatctacttttataccagtaccatgctgatttggttacgttagccttgtagtaaaatttcaagttaggtaatgtgatgcctccagatttgttcttttcgtttaggttgctttgactatttgggctattttttggttccatgtgaattttaggattgatttttctaattctgtaaaaaatagtgttggtaatttgatagaaattgcattgaatctgtagattgctttggagtgtatggtcattttcatgatattgattgttctaacccatgagcaaagaatgtatttccatttgcttttgtcatctacaatttctttcagccgtgttttatttttcttgtagagatactacacctccttggttaagtatgttctagcatattttatctttttgtagctactgtaaaagggattgagttttttatttgattttcagcttggttgttgttgatgtatagcagtgatactgatttatgcacactggttttgtaatgagattttgctgaattcatttatcagatctaggagtcttttggaagaatccttagggctttctagatataagattatatcattggcaaacaaagataatttgactccatgttttacaaatcgaatgccctttatttatttctcttgtctgattgctctggctaggattccctgtactatgttgaatagaagggataaaagtcagcatccttgtcttatttcagttaataggggaaatactttgaactttttctcattcagtatgatgttggctatgggtttggaatatacagctttaattatttagaggtatgtttcttctatgtctagtttgttgagggtttttatcataaagtcatgctggattttattgaatgctttttctgcatctatagaaatgatcatatatttatttaaaaaaattctgtttatctgatgaatcacatttattcccttgaatttgttaaaccatctctgcatccctaaagtgaaatccatgtgaatatagtggattatttttttgatgcgctgttggatttggtttgctactattttgttgagcatttttgcatctatattcatcagagatttggtctgtagttttctcttttttgttaagtctttcctttgctttggtaccagggtgatactgggcttgtagaatgtattagggaggattctcttcttctcaatcttttggaatagattcaatcgaattagtaccaattctttggatgtctggtagaatttggctgtgaattcatttggccttggactgtttttgtttgtttgcagtgttttggtttttgttgttgttgttgttgttgttgttgttgtttttctaaattactgattaaatctcactgcttcttattggcctcttcaggatttctagttcttcctgattcaagctagcgggggttgtatgtttccaggaattaattcatttcctctaaattttctagtttgtgtgcatagagctcttcacagtagtcccaaataatcttttgtatatctgtagtatcagttgtaatatctccattttcatttataattagtcttatttggatcttctctcttcttgtcttggttttaatctacctagtgttctaacaattttatctttttgaaggagctattttttgtttcattggtcctttggattttttttgtttcaattttatttagctctgctctgatctttattattccttttcttctgctagctttaggtatgtttttttcttatttctctggttccttcagatgtattgttaggctgtcaatttgtgatctttcagaattattgatgttggcattttgcactataaactttcctcttagctttgcttttgctgtatcccagaggttttgataacttgtgtcactgttgttattcatttcaaaaattttttaaatttccaccttaatgtcattgttaacccaaaaatcattcaggagtagattgtttaatttctatgtatttgcatagttttgagggttccttttggaatcgattcctagttttattttaccgtggtctgacaagaaacttaatatgattttgatttttaaaaatttattgaacttatttagtgacctatcatataatctatcttggagaatcttccatgtgctgatgagaagaatgtatattctgtagttcttgggtagaatgttctgtaaatatctgttaggctcattttttctagactgaaatttaagtctagtgtttctttgttgactttctgctttgatgatctctctagtgctgttagaggagtgttgatgactcccactattattgtgttactatgtattttcttttttagacctggtaggaattgccttatgaatctgtgagctctagagttcggtgcatataaatttagacatgttatatcttcttgttgaatttatcctattttaattacataatgaccttctttgtccttttttaatattgttgctctaaagtctattttatttgttttaagaatagctactcctgcttgcttttggtttccatttgcaagaaatgtcttttttcaccccattagcttgaatctataagaatctttacatgtgaggtatgtcttctgaagatagcaggtatctatttggcttgcaaatttttaaaatccattctgtcagtgtgcatctttttaaagtggagcatttagaccagttacattaaacattgagatgtgaggtgctgttctagtcatcatattgattgttacttagtgactttgttttcttcatattgttattgttttataagccctgtgaattttatgctttcaggagtatttattctggtgagtaacaacaacttgtttcaagatttagtattctatttagcacttctcatagagctggtttagtattgacaaattccttcaccatttacttgtctgagaaaaactatttctcctttatctatgaaagagttttgctggacacaaaattcttgaccaacagtcattctgttcaggagactaaagataggaccccaattccatctggcttataaggtttctgctgagaagtctgcagttagtttgattggttttctgttataggttacctgatgcttttattttactgctcttagaattttttccttcatgttgactttagatagcctgatgagtatatgccttagtgatgttttgtttttgcaatgagtctctcaggagttctttgaccttcttatatttggatatctatgtcactagcaagtccagggaagttttcctccctggaaattttcctcaaatagacttttgaaatttttgctacgtttttctccctcaggaatatctacaattcttatgtttggccattttatataatccacatatttcttgagactttccttcttcttttaattcttttttgtttacttttgctgtgctgattgggttaatttgaaagccttgtttttgagttctgaaattctttcttctgcttggtctaatctattttaaaagcttttcactgcattttgtagttgccgaaatgtgtagtctttcatagaagttctgattggctttcctttaaaatatccatctctttagaaaagttttcattcatgtcctgaattaaaaaaaattatgttggttttcaactttatgttaacttaataatcaacttttttgaattatttatctggtattttatgttggttttcaactttctcttatgtctccttgattaacataataatcaactttttgaactctttatctggtatttcaaagatttcatcttgatttggatccactgctggagagtcagtgtgattgatttttttgagttgtcatagaacaactcaaatgttttttatgtttccagaattgtttttatggttccttctcatttgtgtaggctatttcttctaattattttaaaattagtttttgattcaattgggtttaaaaaaattttcctccttgaagatgtgactttaacatttatagtttatttacacttagtttcagctctgggtggtttcaagtggcaaagactgtatgagtttcttggttatagagaatcattgtgaagtgtctttctcagatgccggttgtagtggcagtgggctgggtgtgtgagtaggttcactgtctcctaaggggctggaatggcagaggtctcatgaagcttattttgttccccagtggtgtgcacctttaaaagtttttcttccagcattttattcaacgggttgagtagttcaggcttcaggccagtaggaggtgcccacagataaacacaggttgtggctaaagcgggtgggtaaatgtaatatccaacgattggatgaagtcccagctttgacagaggcagctggcaaagctctccgtgaaatacactgaggtcttttcatggggaagtgaaggagccaccccagctctccttccaggcaaagcaggaaagcaatccacctcccagtcacactgctgacctggtgttctagcttttcagatcaaacaggtatctctttctatctgcaagaatgctgatgttccctctaaagaagggttgtagctctacctcttgtgtaagtctgaacctgtatggcacacttcctgtggatagttaccttggagtgttccagaaagtctgtctacagatgcatccatgctgagctcccatgagagaagccccagctctctgcagtgttgggtgaggggaaaaagaaatcaccttctcaaacctttcatgagcgctgtttgactgttggggtagagctgcagactttccccactgagcccagcactgcacttgtgtctctcccgaaagaaacttctcacaagtgggaagttaagggactcaaggcccatggtctgctttcttttataccatgggatgctcccttaatgtggttcactactctttccccaaaaaatagtagtccctgaaagccaggctattctgaattctactgctcctctaggtctagctgtccagtggggctgccacagttcaggctgtactggagaatatctgcaagggatccagtgatgtgaactgtcctctagtttcccagcaccaggtgccagcattacctctgatgggggtgggtggggagtgacacagactctgagattttcttggttataaatagctttagtgttttggttttctcaaatgccagctgtagtagtagtgtattgggcacatagacagactcaagacgtcctatttagctaaggtaatactggcaatggcaatagctgaggttgcataaaagtttttggcttcctgagtgctgggttattgtttatgcagatgttttaatgggctgtgccggttggcctccagccagtaggtcatggcttgtagaaaagcaccagctgtggaggtagtggtagaatttgtgcttgctttatgtcactcaggggaggtattcctgtgtctcaggtaggtaatgggtagggccatggagctcccaaacatccctgtatattgcactgtgctaccagggcaggtggaggggcaaagctgggtatgggctaggtcaggcaactccttgctctggctcctcacatgcaggcacaagcagcggccccagtgaggatcataagtcaattccttggctactggggtaatatttcagggagtagcacagctgcctctgttgcacagaagaatccgcatgggatgcaggggttagcaagcagcagtaagccccactcagctcccatgcacttggcaaggcatgtatcccactcataatgttcgctaaaagcagcaggctgggttccaggtagtctgtacgtagaactaaaaactgccccaggccataagccgtcccagtggagaccagtgaaaccacagctttcaggccgcaccccttctggtctacctgtgaagcaggagtgcccagctcctgcgcccatggctatagcaaacttactacttgcccctcatttctggccaacagggtttatcctcactcaaggttataatctcatatctcagatgggagcttctctcaacctgtgactgcagcttgagttagctggtagacttctgtgaggtcccctgtgaggtaggatcaggaatggcttccctctgtccttgctggagtgtgaaagtgcaggcaatgtgcatcctgataccgcttcttctcaccccatcactcgctaaatcagctccagcactgggtagtgttaagatctgcctccatggcctgaattgcccggctctccggtgggagtgtgtgtcacggtggcagtctctccccctctcacacactctggagactcacagttttccatctggttcacagtgtaggctgctgtttcttctttcaaagggtctgtagtttctttcagtttttctgttaagttcctgtgttgcttcttagaaagaagtgcacattgtgaatctctgcacactattttgtctttccaagtgggagaggcaggctaacaatgcctccaaaccactgggccattttaaataacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatattaaatttaaagatataaattccaacacacatagatataactacatatagccaatgaagccaccaatcttgtgacacttctttgtagaaaaagaaatttccatgttgtagcatattgcattttctaaaaatggccagactaatattatgtctcaacccacataatctccctaaaatgggtctacactctttccattgaatctgggtaagggcttgtgactgctcctaacccacagaaactataagagataataaatgattgttgtcttaagtcaccacattttgggatgatttattatgcaccattagatgacaggaacagctgtgtgttatctttgttatttgatcttttgaaatatagtttaacttggaaactgaagacaagtttattcctttatttaaaacatatttaatatgtgcttactgctctttttcattgtgataaaaaactttcattgagagagaaacatctcttaatattagtttgtcaggtgttagaatccaggacccctgccctggaattgttcatgagtccaagcagttgtaactgcatctagcaaataatggtctgctttgctgtctccttgttaaaagtacttcaaaatgtatgcaaaatatgtcttatagccagcaggcttctcattccttgctagggactctgtaaatgaaaaacaaaacaaaaaacccaaagctacagcagaacacatttgaaattatgaatacaaccataaaaatggcaattctaaggtaaggtttgagaatacagaacttatctgagcctgttgccttcttctgtgcaaaagaaccattatagataaacaggcagcagatagtcacaattcaatgccatgatatgtggataaaacgaaacaaaggtcgagaaattagcttacttccagatgttctttgggtcaggctcatctatccctaacttctcatatgaaagttaaactgccacagcctgaaataatagataattgaaattctcattttcttcagaaaattctgcaattaaaatgttgatatttctttaaaatacacacacacacacacacacacaaacacacacacacacacacacacacacaaaacctgatatcaaatcttacattccctccacccagaaaacatgactaggtcatttaaacagtacttgaatatattcacagaaaatcagcaggtcaggtagaaaattactcaccctacacaccagttgtgtgagtgttgcagagtatgaaccgctgccaagatatctgtcattggcatatctccacttttcaatttgatacaatgtgtttaacctatcactgttattcagtgtactataactgctatacaagcacctgtgtgtttaccagagctttactattcccttggctagaaatatttccaaacaaggtactaaatataaatgcccgccattttcaaaaatatatatatataataaacattctccaaatattttaaaagcctacagttaccaataagcttttgtgtacataaattagagaataaggggcaaagaaaactttattagcataccattaagtacttaatttattatttttgcagtgacatccttgcaggatttcttctttaacatgaaaaagtcaacatcttaactgttgaaggctctgctttagaatcctaggggcatttccagacaagttctagcgattattgtgaaagtacctgtttctagaccaactctttaagcagaccactaaaaagaccttttcaaatcttccatgtaaaggaaagccttgaaagggagagagctagatagatacatagatacacatatatagatagatgatggagatagatacagagaggtcagatgataacaaagatcagattataacaaacttaaatgtaggtgctccagctagctaacagagaataacaaatcatcacacagtttagtgacttaaaacaattatcacataatttacaatctaaacttgtaaatcttgtcaacagcaatcaggagtccacattatcctttaaaccaaattttatttccaagtagaaaatattttcttatttaattgtatactgatctgaattcaatgtatcttgtacatgaaaatagcaacttggctctgctgggtaactgaagaccatgtttgtgactggaagcatgttattaatctacttaaaatcttcattccttaataaaatctactccctgtcaacatttattttagaaactgaaatctttgtgagcatagctatattggcatcataagctctaaatggaagactacttaagggcatcttcttatttctagtagagttaatatcattactaaccccaactattctgatgaaataggtatctagcataaacatcaatcatcttcttttataactcattgataattccccatggtcccttgctctatttttcatctgttgtaacacataaaggggttcaacaactactttattctaagctttctctgctgcaaaccgaaggttactaattcacttcattaacaattacaagtatttgtatctgtcctcacaaattcaaaattgaccattttataaaagacatatcccttctcttcattctacctttgttaggtatatttttctatttccaaatatttattttatttccaaatcatgattcattcaaataagttttacacaaagaagaaagtacaagatgtgtaacagctctagtagagaacatttcagctgtgccacaaaaagaaaacagcaatataatggtgtgctgacaaaataggccaggcatggaggctcatgcctataatcccagcactttcagagaccaagacaggcagatcacttgagcctgggagttcgagaccagcctgggcaatatgacaagcccccgtctctgcaaaaaatacaaaaattagccaggcatggtggcacatgcctgtagtcctagctacttggcggggttaaggtgggaggattggttgagcttgggaggttgaggcttcagtaagccatgatcatgctactgcacactagcctgagtgacggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagttgtaagaaataatatagagacatcccttgcaaactttatccccgtcttacaaaatgttaccacatcatccccctgtggtaacattttgtaagactatattttcagggtcttgacactgatataactcactgatcttatttttctccagttttacttgtattaatttttcttagtgtggtatgggtgggtgtgcaataagtctatacaattttgtcacctgtgtaggttcatggattcaccaccgcagtcaagatgttgaacagttcccacaccacaagagtattcatgttgcctttttataactatatccatctccctccttcaaaatcccacatcctcctgctagctcagtgcccccacacaaccactaactattccccatttctaaattttattatttcaaaatgttttataagtggaattatatagtatgtaatcttttgggatttttttcataacataattcttggagatttattcaacctaaggtgtttatcaacagtttattcctttttattgctgagtagtattccatggtatatatgtacaatacaaatatgttctcccattctttagcttgtaattttattctcacatggttttcacaaagttagcattttacattttgatgaagtctaattcatcaattttttaaattcacacttcatgattgtggtatcaaggactctgcctagccctagatcccgaatattttttcctattttgttctaaacattttgtatttatattataattttttaatattttacctttgtctctgatccattttgagtttatttttgtgtacagtgtgagacttcgttcggaactcattttgctgcctataggtgtcaaattgctccaacaccatttgtggaaaatgctgtctttcttctattaaattggttttgcatctttgtcaaaaatgtgttgaatatacagatttttgtgtggggatatttatgggtcccctattccagggctccccaacccctgggccacagacaactaccagtctgtggcctatcagcaaccaagccacacagcaggattggtgagtgaactttactgcctgatctttgccttctgtcagatcagcggtggcattagattctcatacgagctccaaccctattgtgaacagcacatgcaagaaatctaggttgcacgtcctttatgagaatctaatgcctgatgatctgaggtggcacagtttcatcttgaaaacacccctgcctccactcactatccgtggaaaaattgtcttccatgaaactggtccctggtcccaaaaaggttggggatcgctgccctattctgttccattgatctatgtgtctatgctctggcaatgtcacaccactttgattattgcagctatagtgtaaaacttaatatcaggtagagtacttttccccactttatttacctctttttattatttaactatttttgctattcattgtaaatttagaccacatgcatttatatttccaaaaacttgccaggattttgaagaaattgcatataaatccttttgggaactataatgaaattaaagaaagaaacagaaatgttctaggataacagagcaaaggcagataaagttctggcattggaggaagactaataaactaatacaatatgaaaaaaattgatgtgaaaaaatagaatatccacttgaaccatacatgcggacgtgtggataggcatcagcattccagcacaacggatgggacagaaacaaaaaatgagattatagcacaaagagttaactttaactatgtagtcatcacagaatgttatgggagcaaaacaataactcagtcacagcaatagaagtgtcaattttattataatagtgctgaccttttttggggcaagtggaaggggtagggagtagaagactgtcaataaagacatgtctgtatggaaatacagacatcttttgttggtaatctgctaaaaccacatacttttaaaggtgaaagagagatgaaaatacattatgttattaaggtatactctaaattgccaggcaagattgagaaaagtgatgaggcttccctgatagagactccacaattagaaccaaagcagtacagagcagcaacctgagcttccatcattcactcactgggattcccatcaacatacagcatccttggcaagtcttgttcagatggaaaagcagtcacaagaggagtgctcttctaatcctgtgctaaccaatctaaaagcatttgtgactgaagtagtggaaactctgaacaaaattaccttgtaaattttagtttatagtagcccagatatgtggccatgctagattccaaaaacttcagagaaaaatgggtataattaatgacctcttattctgacactttgagagggtttgaaggctatcaataataattctgtgatctcaagcaaaaaagaaaaaaaaaaagaaaaagaatgcggctgcacctcagactccatgagaagcttatatgtaaatggacaaaattcagaagaaataagtgcctcgcacaggccttaacacacaagttgtgctcaatcatgtttggtaaaagaatgaatggacattgtaaaaccaaaaattaacatctaaagggttcatacactacaagccaggagagtcaaagtatatatcatctgttcatctaatcattccatcattaatttattatgagcttcttgctttcagggtcccatagtccagagtgaaaaagtgatatgcaaaccaaaaaatcaaaatacaggaaagtaactatgactaggtaattgtttaaaatactttgggaacaggcaggctggagttattaattaactatatttggggaaaagaagactacaaaagtcttcacaatgtagttaacatttaagtaattttgaagaatagcagagatagagagttataaaaattactcttttttttttttttcttgagacagagtcttgctctgtcgcctaggctggagtgcagtggtgtgaccttggctcactgcaagctccgcctcctgggttcaggccattctcctgcctcagcctcccgagtagctgggactacaggcacctgccaccacgcccagctaaattttttttttttttgtatttttagtagagagggcatttcaccttgttagccaggatggtctcgatcttctgacctcgtgatccacccgccttggtctccccaagtactgggattacaggcgtgagccaccgtgcccagccaaaaagaactctttatatatgtttttgaaaagaagaagaaaagagaagcatatgctatcaaaaaagaaattcagtgctggaatgataatgagctcagagcaaaagtaaagagataaactgcctatagattgtttggagagcttaagttgaaccctccctagccattcccaaagatgcaagccccctataaaaatttggagcacctaacactacaaagtttgaaagaatattatctttgatatgattcctccctgtctgttaacttccatgtttccatcccattggccctgcttttatgtatcctccattggcctaacagctctcaaccagaggttttaaaccctgacagctcattagcatcaccagaagaacttttacaaaagccttccacttgtgtcccttccccagggattctgattccactggtttggggtaagggaccctgtgttgcccacagcggctgatgcccatcaaaagggcattaggaaaatcactctgcgggaaatcactctggcccgccatggtgaatgagtgtttttaagaggattaaacaaacatcaaaaagaaaaaaattaatgtcatggagttccataccatcttaagacttaatgattcatatgccattacacagaaggaatttgcccaagatagctatgaattgtagccatgatctctaaaaaagagtcgaatatgcgaatcctacctaaagaccggggacaagtgatc

SEQ ID NO: 883 - DNA, 38015 bp, Homo sapiens
attgacatcggatcatgatagaaccaatagagactttgcctgtcctaattatatgtgctctcctttctgaaacaccccccaaacaaactatgctaaaacaaagactgaattatcttctcagtttctacatagaaagtgacattacaaaataacttgttgtcattttagaggtgatcaagagtgtgcagtgaaagacagaaaaaaagaaaagaaaaaagttttatgagggtgtatctgacacatcatttatacaaatgtattatttttctggattttgctatattttgatatttgacagcattttaaaattagtatctagttggtttttgttttctaaataaatattcactttttcttaaggccctcaaaactctgtatactttaggctccacacagcctggcctatcacaatcaatgtattatttatttattataatttttttgagacagagtttttgctcttatcaagcagactagaatgcaatggtgcgatcttggctcactgcaacctccacctcccagattcaagcaattctcctgcctcagcctcctgagtagctgagattacagatgtgtgccacagtgcccggctaattttgtttgtatttttagtagatatggggtttcaccatgttgggcaggctggtgttgaattcctgacctcaggtgatccacccgccttggcctcgcaaagtgttgggattacaggcgtgagccaccgagcccagccaaacagtgttttttttttgttttttttttttaataaaaaaacctatcttctgaaatgataaaatgaacacatattcaactgcaatatttttattctttacagagaaaaatgacttctttcccttcaccttccttttgatgtgacagtggttttcttcaaaaaagttattttgcttttactatatgtgtaaaaatggaagaatagtgtaggagttataaaaataacattactgaggacctgcaatgtgccgggcatgtttctaattacttgatttgtattgtttttcatcccctgagaaagatcttatcagtatctccaatgtgctgacaagacaatggaggcacaaagagatgaaataacttgcccaaaattatagaagaaactctagattggaagccaagaggctcaagttaaagtttcactttgctttaaactgattttatgcccataaaaaaagtcatattacctctccaggacctattttcacagaaatacatgtatgcatacactgaggtggggtgtggagacagggtttgaattagctcatgccttagaggttcttcagattttaacatttgatttaatgctgatgtatatacttctcttgaaagatttctaaaaacaattacttaaaaggtgaaaataaatctacgtaatttaatttttcccagagatagttcaatattggcattgatacaaataatcttaaaaattttacttaatataacaaaagcactttgtggattaaaaagatgatttatatgtagtatctataggtctgattacctcagtggcacggcaagtagagaaaattaaaataactagatatatgatgcctcgaatacatctaaggttgtatgtgaggtgaatttatgtaacaaccacttaaattggtaacatcatcataatttcagaattctagcaactggagtaatggcatcaaattcaatgctctaactctgttcatccttttctcagttgcttaaatgatgttctactactaccaaatatttctcactttctacgtagtttttccacatttctttattttgataactttttctattttacctgctctcatactatacttcatctatggcaaattacctttacacttcaaattacggcatgtaatacttcccaccatgaatctccatgtcagaactttatgttaaatgataaaagcatttcagagtaggggagggtgtggtgctgaggagacctaacctgccatggactccaggtttacaattaatgaaactgcattcaactttggcctcacaaccttttttgtaatcttcttactccatgaagggatgatccctgcatgatgggatcactcacacggaaacttctcacaagactctcatttgccttggataaacgtataagaaaccaagctatcctattctaggggttaaaagtattttttaagaggagaaggggacaaagtttatttctgggaggatagagctttctgtgaaagtatatgccagtataaattttcgtatctcataaaacatactgctgaagaggaaaagttcaacctaggactatttcggttatggaaaatgtaataagtgggaaaaataatgctcccgggaggtctgtaaaaggcaataattccacatgaaaatcaaaacatttattttactgtcttttacactaaatattaagattggacaaccttccaaattaaataagtaaaagaggaaaagaatataaaatgcattgcttgtgatgataaaacaaaatcaccaatacgtagggtttgtagactaataaaaatagaatttggagtgaggactcccattttaatccagctccagtacttagttttgtgtggttttagacaaattgcttactctctgagcctcaatttcctaatctgtaatgatcattaaaatgcttgttacaaaggttgttggtagaattaaattagattatggtttgttcgtttgtttgtttgtttttgtgagatggaggcttgctctgttgcccagactagagagcagtggtgcagccccaaaaattcaagcaatgctcctggctcagcctcctgagtagcttggatgacaggcacttgccaccatgcccaactaatttacaaatgattgcttctataaagataatttgaaaataaaatacaagaatgctttagggatttaaaagaatactatacacaaatatatatacacacagaatttacaattttgttgaactcaacaatcattttaatattccaatttttttaagtctgagttaaataaatataaataagaaaaattgaatctacacacaattttttagggttttcctgtaacataaaactaaaataagagaaaaattgccttaaaactatctgataccaataacacatattacagtttaaagtaataaaaatactttaactggcaatgatgaaaaaataaatataggcaacagagattttttgatccattataatttgctactcagagatttaataagtttagaatttggagtggaaaaaaattggtactatctcccaaatcatttcagttcaaatggagaaatttaaaatgaatttaatatttttgccaaatctcctttttttaaaggacttttatgtcagaaacatctacaaagtttctctttaatgtaccatccaatttcatatagacataaagtcaaaatgtaagctattcattaattgccaaagtgtgtttcatataataagaggttggcaaaagttaaaaagaaaaaacaaggcctggcgcagtggctcacacctgtaatcccagccttttaggaggctgagggaggtggatcacaaggtcaggagatcgagaccatcctggctaacatggtgaaaccccgtctctactaaaaatacaaaaaattagccgggcgtggtggtaggtgcctgaagtcccagctactggggaggctgaggcaggagaatggcatgaacctgggaggcggagcttgcagtgagctgagatcgcgccactgtactccagcctgggtgacagagcgagactccgtctcaaaaagaaaaaaaaaaaaaaggcatgtatttgaaatgcctgacagcttgggattagacatattctttgtagacttggattcagctttggttttagcactaagaagagttcacataacattaagaaatttaactttcttaattgtcaaatgatttttgctctgtgtctaccatttatctaagttagagagcataagacaggagaaactcagaaaatatttcactttaagtgttctaagggagaaaagtcacgcataaatattcaataaaggacaacacgtatatgaaatctatgtaagcaatgttttccctgagttgcaagggcatgttaagaaaatatgagtacaaggtacaaatagggtcgaaatagttagggttgacttctctttctcattcctctctcattgttcatgctcttgcatggtctccttctctctccttctgatgggttcctagaaattttattaatatccttgacctagtattttgacctccaagatactatgtccactgccacaaccccactctacacgatcattatctctcagtgacaactgaggtagctttagttctgttcctagccactctctacaaagtgatatttccaaattactaatttcacaaaattcctgcctcctcttttatcataggatcaaagtcaaagtacttaatttagcctaaggccctgaaatatttggcccctgtttatttctctagcattatttcctatcagcacccctcgatttccactcttctttgtctaggggcatttgtctatgcttttctttctgtagggatttacctcttgttaggtaactccaatttatccagcagggctcacctaaagcattattttctcacgaaaactttattaaatctaggtcagtttcctagattgtcacggttgagcatttatcacactacctcaaatatatcaaatctaggtcaggttcctggattgtcgtgggtatttatctcaatatctcaaactttatcaaatccaggtcaggttccatctagggtgagtattgatctcactatctcttctcattaacgagatgttcattagagtgatcatctgatgaatgactaatctctactttccattgttataaaaaagcagtgatcttaatgtctttatgttattttcccagggtacgtggaaagtgccaaatagaatccctcttcccatgtaaccagggctccagtctaaggctccttctactttgcaagcctactaatttattaaaggcttttcccaagtgatcaagtctatccctacagcgaactcttataccagtagctatggtgatgaaaatatgtctatatggtcaggtatggaggttcacgcctataatcctagtgctttgggaggtccaggtggaaaaatggcttgaggacaggagttcaagaccagcctgggcaacatagcaagaccccatccttacaaaagagttaaaaaattttttaatgtacgtatcattttattttatttataactctgcagtcacaaaaaatagggccactactaaagtgcatattcaacagcaaagtgttcatcaaatatccatattaagctattctaaagattattccaagtgaatcaccaggctttccttgttgatccatcctgtgctcaactctagtgagtctcgagttagcaaaaggtaaacattaaagtgtgatttcccccatggaactgttatgctcaaaaactgaccattttgctatttcttcagattttaattatattacttggttagctagaggtcagaacaggaaaataagaatgaattcaagctggaaaggccatttagaaatactgtagcaattttaccacacatttaaggtaagaaaagctctataatctatttaaattgacctgaaacaaagttctttattaccagtataggtggtagattaaaaatagagtataataaaaatagtcagatgctactattaaaagagaatattggattttcccaactaggataggattttataaaaatcatatatatatatatatatatatatatatatatgtatatatatgatttttatcatatgtatctataaatcatacatttatgtttatatatataaaagagaaataaaattccctgagaatagaataatgtctttcttaaattagaagctttgtctatagtttgggcaacccaatctttgtatctttttattttaatcagtcaaattggtaatatataaaattattcagtaaattatatcatttataataatttaataaattatagtatttactgaatagcaaagatcattgggagtgattagaaaacataaattaactatacgaacttcatgaattactatattaaaattaaattatttattttctaaagttatgaagtattaaagtttggaaagaacatattttccattctggaaatggaaaaaaaagcatgttttctcattaaataattacaaacatttccatttaaaatttactactctattggagaattcttcttggcctcaacagattgcaaaaattgctaatgtttatttcattctccaggacctggagtccttaattgctgatgcatattcactggcgcatgcaaagtactgcagtgatgcactacttattgtaataattacatattaaagaacctatggcctacattcagtcagactcactttgtgagtttacttcttaagggggaaaaaaaaaaccctgaattaccagttacaaaatgagttagttgatagacaaaaattacccaaggaaaacataatcaataatatacactggaaaagagctcctctttgttgagcacagatctgcaatttgtaatttaaagtgttatttattttgttcagggcaggttgagctgtaacatgccgtgtaagagataaatacggctatggttcttaattacagactttaattcaatgggctatgtatagaaccaggaataaggtactactgtttcctgggagttggactatgtaaattagattgagtagtaggacacaaagctatgaataagaaggaattatctccggggaaatataggtgacaaacctacaatggcttttagcatctggcaggttctatttgaagagctaatgtcattctatgtaatggattaggaagaactggatgcactccataatgcaggccaagcataatttccatgatgactgagtcttctaacatatcagacactatagctgccttcaattttctagtctcattttcaaccctgtggtgagggatggggagggagaagtctgtatttctccatagtcagctgaggctacagcagctgtgaaagcaggatttgagggataattaacatgtagaattcatagaatcatgaccagttgaatgtgagagataagaattatgaaggaatcaaggacagtctcaaatttatggcttgatgatttaattaatgattatttcagtgatgaaaataaagaacacaaaatatatggtttgggtgagcaaaattattagttgagttatagacatgatgaaattaaaatattgcagcaaatctatgttgagatacacagatatcagaaacaaaatctggggaagaaaaatagatttttagagtcattgacatagagagctatagattgttgttgaaacagggtgatggattcagtaccaggaggtgaaacgacatgagagagagagagagagagagagagacagagacagagagagacagagagagagaaattaaaaaaggtaatccttgtggctcacacctgtaaacccagcactttgggaggtcaaggtgggcagatcacctcaggtcaagagttcgagaccagcctggccaacatggcgaaactccatctatactaaaaatgcaaaaagtagctaggcatggtggtgtgcacctgtaatcccagctactcaggaagcagaggcaggggagtcgcttgaaccccggaggcagagattgcaatgagccgagatcacgccactgcactccagcctggtcaacagagcaagactctgtctcaaaaaaaaaaaaaaaaagtaattccagtattcatgaatgtagacaaataaagaaatgcatccaaaaggaaatgctcagagtagtaataatctcaacaagaagatcatggtcaataggatcaaatactgaagactagtcaaataagacaaagaaataggggttcctaaattttggtacttatgcagatactaatgcctttaacagagaagttaaaggtagaaaacctacaacagtagcctgaaagtaacatgatgagaaaaaaatggatgatagagtagattatttgtaattgaacctaagtttatttcataggtacttattcttcattgagcgttgcactaaattatacactgtagttctttgtacctctctctttctctctgtcaaactctctctcttctattatacaactgggtatataggaaggaattttatgtatcctaaaatgtttaaagtgacatttatgcggtgaaaataagcttcactcttctgggtcaactgtgaaatagcataaaaagtccgaggttaaattagaagcaaagcattttctgtcaaacacagtttttactgaaaaaaaaaaagacttacataaaatatataactatgggtggctcatttagttgtatatggcagaattttttctgtcctctttccaaataactcgagtggtttcttcagtttgacaaatagttataaaaacaagtttgcagcataaaagaaaaggtggcaatcagctcctgcacaaaaactgattattaacttaaacaagtcatagaaactaatggtcaggattgcaattacagtcacaaagaccagaccacatctttatgtcagagggcatagagttcactcacattcaaggttcaatatgtttgaatacaaacacaagatgggtgattacacagaacccagtccatgaggtgacttcattcattaaccttggaaaatcctccattgaaattagacttttcttagtttatcgatgtttatgtgagataaactcaaggcaaacttgtatgacctcaaccatttcccttgtcactcaaggaaagggaattatttatttattaaattataaatgtatttataataattataaataaattgttataattttatttttaatttatattttatattgttataaataaattataacaatgaaaacattcacaatgctttaagaatggagtcttagccaggtgcagtgctcacccctacagccttaatactttgggaagccaaggctggaggatcacttgagaccaggatttgagaccagcctgggcaatatagtgagacccccatccatatgaatttttttaaaaaacttctctgtgaagttactaaaatcagcaaaaatgggttaatattctcctcaaagcagaaaaaaaaagatctccatagttcccaggtttttctttaagaacttttactatattgaaaggataaaagatctgtcattcctcagagcatatcacaaagttatcttccaaaaacaccctccacaccatcactacatggcataacttccctatcatgaagtagtaaagaatcaatcatagatattttcttaacattggataacacactgtttctcagggactgtctgcttaagggttttctaagacactatggcctcattgcctgaaaacaaccagttcctcactggctactctttaataacacaattttttattttcctttttccctccctcttcatttaattgatgtgcacaggagagcagataagggtgatgttcggctagtgatcaaaaaaatatttttgtcataaaaatcaacagaagcctctattctagcattttcaggtggtggtttcagagtctttcgggtaattggttttcttggactcagcaaaggcagacttgctttttctggggaagatatatttccagaggttagtgcttgtaaatctgctgttaggtgctggtatatttagtgactttggatctatggaatttgaacttgagaagtccttcctgtggcaaatttaaaaatagagcagcgttgcaacaaacataaccaaaaagaaagtgcttgcctttctgacagttcagcttgagtgcttccagagcagatagatacgtgactctcctgaatcaggcatttgagactttactgacgaaccttttaaataattatcaaaaggtcacttacatatgctgttagatagactaaccattgaaagcatgagaaaaactgctgattttaagtagtctgttgataggaactgctgtggatttaaagaaaagataaatgtcttctgtcacaatactgtcttattgtaaacaaattctatcctagctagagattcactgaacagaaaaggagcatttttagagacagttaatgtatcaggtttaactgattttcataatggtgtttttaaaaaattttccctagctttattattttatgattttctaacttatcagtatcatttgttcacacattaccatctatcttacctaacctgtagaacttccgttcaagtaatatggtgtatgttaaatgactattgttgtcatcattgctgttattgtcataattatattactcatagagttgtttaaaaccttgttgttcaaagtgtcatctgctgactaatacgacattggaaatgagtctcaatcatcaaggtttattagccagctatagtgtacatccggaaaaataggagccacagacacttttgtttttccaaagaggctttatgtgggtatttataaatttccttgaagtgggagagggcaggtagaaagaggggcaggtgagcaggaaggcaaatggctacattcccatgagacttgggttagtgcccagtaaatctacatttacataagattaatgaatgtttgaagagaaaaagagagtaaaggaagaagaaattatgcagatgtctctgggtaggtggaggaatgagtcttgacattgttctgcacctgggaagataagctcatactggtctttatcagtgtgaaatccaacagactttagttttaagagctagacttacattgtagccctgaagttacaattggcattcccttgtttatatgagaggccagcaaaaattttacttttgaatgatctatagggacagtccttttagatgcttgaggccttttaccttcccatggggatctggctaaagaataatgttagtgacagctattcatttggaagagggtgtggcaggacaggcttcattctcctttttgcataagaagtttagggttcctgagattttaaattttttcctttacaaaaaacatcagcatcacctgggagcttgttagacatgcagaatctcaggttctaccccagacctactgaatcagagcctgcattatagaagaaccccaggttattcataggcacattaaatatttaaaagtactaccttaaagggataaaattacttaggtaaaatacctataatagtcctggtcaatgtttgttaaatgttgtcttccctccctaactcagaaaatggattaactcattttctgtctatcttagaaagctgaccttcttttgtttgttatcaccaaacattatcatcataaataacaataataagaagaggtattacatccttactgttataaacattgggaatataagtacaagctatgatccctgaaatagaatatataatctatttaggatggcaggacattttatagaaagtacttaaatatgaggtatctatgtagaaaaactaattctctgtctatgaaaaatagcatcccaacaaaatgactagatagctggaacagtctcacttgaaatacaggcaatttgttgtacatgaaattcactttggaagtttctagtttagacgagttaacttctcagaaagttagatggttatctgtgagatgagcagaaactgagggacagtacaggaggaccacttggccactgattgagagagacttgccacatgtatctgctatcttggacagaaaagaaacaaaacagtttctgtaatgagtcaaaaactgaaagctcttagcctggatgtcctgaagtgcagaaataaagttgagccgttttttcatgtaaactgccataaacgtgagcataaaaagcagtatctttaggtcccctcccctcccctcccttcccttcccttcctctttctcttcctttctccctttcttcctttcttcctttcttcctttctagtacagagccaggcacctagtttaaggttatcagaaatttgggagagccagggttgggtctaggtgagggctgacaaaagaaccgctgcattccaagttctagtccatgaattgataagcctgtatctaccttttacagagctttcaagactgtatgaaattagatgttattccctctcaggctttatcttttaaaagggatggtcttcatgtgtgaattcttccaactcattatattccttaactttacgtaagtcttttccatatccactataaaaaaagtcaaagtatagcaatcagatctacatggaatatttgcggaatctgataacctgctttgagtttttttctctcaaaaagaaaaaaacctgttaataataatcaactattttagcccatttgtctgcatcaatttggtgatttcaatggagaatctacagggatgctcaggtgcctccttattgttatcccctgttcaaatctcatcattgtataggtgtggcttcaattattttctcttaagccaacattgtatttataccaaaggaatctgacttgtttcatttctgctcagtcttccagagctctaaatacttcctcaaatttaattacatcaatttggcatctccctggtgttttcattctgcactttctcttctggatcatttgcaagaatattcgtgtattagaaactcaacaattttttttctgtcaagtaaagtcctgattagccttccattgcttcccttcatctgagctacttccatatatgattaaaatctttctcagtataagaagtaaagttcctatattgaatgcatttctcaccaattcctttactaatctattaaaggattttaatgtattgttaggtaaaatgttctacagaaatcatccaagcttttctctataatgcatgtttctttagatattgtatgatactaaaacttgaaagtggtctggtcttgacattctacaaagtcaaaatttattttttctaatagataaactcttagattgtgaaacatgcacttaccccaagagagaagtctcctcattcttccccttactactcagtggattctaactttacaacacgtaagagatttatactattaaatagctgttaaagactaatttaagaaacttccatatgtctgtaaagtgtttttgcaatgcgtatttaaaacttgaaatttgcataaactaaagagcttttgcacagcaaaagaaactaccatcagagtgaacaggcaacctacaaaatgggagaaaatttttgcaatctgcttatctgacaaagagctaatatccagaatccacaaagagctcaaacaaatttacaagaaaaaaacaaacaaccccatcaaaaaatgggcaaaggacatgaacagacacttctcaaaagaagacatttatgcagccaaaagacacatgaaaaaatgctcatcatcactggccatgagagaaatgcaaatcaaaaccacaatgagataccatctcacaccagttagaatggcaatcattaaaaaatcaggaaacaacaggtgctggagaggatgtggagaaataggaacacttttacactgttggtgggactgtaaactagttcaaccattgtggaagacagtgtggtgattcctcaggggtctagaactagaaataccatttgacccagccatcccattactgggtatatacccaaaggaatataaatcatgctgctgtaaagacgcatccacacatatgtttattgtggcactactcacaatagcaaagacttggaaccaacccaaatgtccaacaatgatagactggattaagaaaatgtggcacatatacaccatggaatacaatgcagccataaaaatgatgagttcatgtcctttgtatggacatggatgaagctggaaaccatcattctcagcaaactatcacaaggacaaaaaaccaaacaccgcatgttctcactcataggtgggaattgaacaatgagaacacttggacacaggaaggggaacatcacacatcagggcctgttgtggggttgggggaggggggagggatagcattaggagatatacctaatgtaaatgatgagttaatgggtgcagcacaccaacatggcacatgtatacatatgtaacaagcctgcacgttgtgcacatgtaccctagaacttaaagtataataaaaatatatacattaaaaaaataaaataaaacttgaaatttgcagactttaaaatagaaattctacttttagaaatgtattctaatgaaataactaaggtaaacattgaaatttagcttaaaaaggctacagtattttttaataaataaacaccatatagtaaattaccaaaatgtatatccactaagtaagttagagtgcagaattttgtttgtttgtttgttttttcttgctgtgctgcccaggctagagttcaatggcgcaatctcggctcactgcaatcaatccctgcctcccaggttcaagcaattctcctgtctcagcctcccgagtagctgggattacaggtctctgccactgagcccggctaatttttgtatttttagaagagacaggtttcaccatcttggccaggctggtctcaaactcctgacctcgtgatccacccacctcagcctcccaaagtgctgggattacaggcgtgagctactgcacccgcccagaatgcaggtttttaataaaatgctatgcagccatgaaaaattacattaaacaatatttaataacatggaaaggggtttaagttattttaagtgaagaaaaaaataaattaaaaatatatgtgatacattttatagagacaactacctacacagaagaagctgaaaggttatacaccaaatattattcatcatgatttctggtagagaaattacaagaaatttctactttaaaatttttgtattttttaatgaattacatttctaaagatagtagaaaaaatgaagctctcttagagctgattcaaaatctttcctattagaacctctgttcatctctgaatcttatttcaattataaggaaagctgtgaatagcttgtaacaacatccaattcaccattgtgagttaattttttaaagtttcttctcccactgtatatggtgaaataggtgaatgtattaaaattgctaaattttgctttttctgaatttagctaatccttcttgagatgtgtgtgtgtgtatatatatatatatatatatatatatatatatatatatatatttgttcttcagcatttttctttattttattctatctccttttgagctaaatggatgacctatctgccagctccattagtaattttatttactgcttcagcctttgaaacaagttaatgcagaagattgaatagtattttagaatttacttcacacagtaatgtgactcaaggcttcattggctattatgtcccctttggcattaaatattttaatctgctaactatgacagatacaggatggccaatttcccagtaaatgtattagcctcctagtaaattaccctttcccaccttataccatgcagcctattaacctataaaatcccttctcttccaatataggcaagatgtcttaactgaagacttaatgttgaacacatcctaaagcttgagaagaccttatttcagagggttgggaaaggaaaactaatcattgcaagcaaactttaagttgctgagactacagatgtcactttggttcatttcctattaccatcgtttgatgaggatatagcccaaaaaccaagctagatgagtattttaataaatgtggactgagattgctttaacagaaaatataagaaatttctgtgtttttagtaatatatcctaggttcaaattaataaatctcttgattattctgtgccttaaacttgtatgaccatctagtcgtaccatttgagcaaataagttaccacctcaggaaaaatgaagtcagcactcaatttatatctataggataattgtgttttgttttgcttttatcttaagcccacactctagtaaacaaaagctatcagaagaaagctttgtaaaatattacagattgtgttgttaaataatactaagaactttcttgcatttcatggaaaagataatgcatattgtgtacttttcattattttaaatgtgtctaggaccaaataaaccaacggtgttctctgtccttctactggtttgggaaaagatttatgtaacaaaccattatcttctagttagaaatcatgaaagatgaggactgttgttcctgtaattaatcaccctatagtagaactctctcacagtgacttaacaaaatacacttatgtatgaatcttaaatatgcagaaggaatactaaagttgaacgggtaggatattttatcttcttttaagctttcatatggttaaataaaacaaaaattaaaagtctataaaacagaatgtatagctttacaaataattataaccaatacccaagttgtggaaaagaatattatcataaattacacacccttatatgctaatttttctttttaatgttaccgcataaacgtccctttctaaacagtataattttatttctttctgaaatttacaaaaacagcagctttatttcttgcttattttagtcaatactacacttgtgagattcatccagattgctatatgtacctataaatcatttattttgttgttccttttttcattatataaatataacacaaatccattctactgtcaaacatttggattgcttctaggaaattacaattaatgctgctattaatattttctcattcctatatgcatcagtgtcttcagattatgtgtctgggagtggaatggttgggtcacagagtgtattaacttttcatttcagaagacaatgctaaacatgtttctaaggtgtccatactgatgtagtctcccagcaacatatgagtatttttgatatttcacatcttcaccacttgatattgtcaatcttttaaattatagccattctggagagaatacagttgtgttttttattcggagttaccaataactaaagagattattctgttttctatatgttcattagatatttgggttttgtcatttgttattagtatatttaagtcacttgcccattcccaagtggttagcttctgtctttgtatattttgtatatctatatctacaaacatatacgtatgttttatctacataaaattatgtatgtacattatatattatatatttaaatataatatatttatcttctggatataaactcattgtcagttaagtattttgcaaatatatttttccatgtgaaggcttatactttcactctcttatggatgtattttgataaacacaggtccttagttttcatgcagtataattatctcctgtttatttttatgtttactactcttatttcctattaaaactttttcatatcccaagcttatgaagatattctacactatcttctaaaaacatatgtttttgctttcacttttaagttactaatccacatggaattggtttacatgaaagatatgagggagaactcaaatttcatttactttcacatgcatgtaattgtcacagcatcatttactgaaaagaatatattttccccacttttgtagcatcaaatcatcatcataataatcataataataaatgtatatttctgtatttttattccatttgtttatccttgattcagtacaacatggttggatcagtctgttttcatactggtataaataactgcccaagactgggtaatttataaaggaaagaggtttaattgactcactgtttagcatggttggggaagcctcgagaaacttacaaatatggtggaaggtgaaggggaagcaaggcaccttcttcacaaggcatcaggcggtagatgtgagtaagtgaaagcaggggaaatgccagatgcttataaaaccatcagatcttgtgaaatcactcactatcatgaggacagcatgggggaagccaccctcatgatacaattacctctacctggtcccactcttgacacgtggaaattatggggatcatggggattacaattcaacatgagattttgggtggggacacagccaaaccatagtcatggtcttaattactttatttttatcagatttgatatgtcccatggagtaattccttccatgttacactttgtttctgtcagagtagattatactgcaataacaaagaattttaaattgcagtgacttataacaacagagctttttgttttgtttttcttgctctctctagttgtccattttgggttgtctggagaatatacttgatttcttctaattctggagcccacactgattgaacagctactctcttgcacatattgctaattaccttagcagaaggaagtagatagagtgtggtgaattattaattggctcttaaatcttctagccaggagtcacaaatgtcactttcacatttcattaacaaaacacgtcacacgaccactcatcacctcaaccaagaggagaaaataaaatattggatagacagcactaatgattaacctaatcttttaaatgagtatataacttattcttgttcctttgatttttctttctttcttttttttttttttgagatagagtctgctctgttgcccaggctggagtccagtggcccattcttggctcactgcaagctccacctcccgggttgatgccattctcctgcctcagcctcccaagtagctgggactacaggcgcccgccaccacgcccagttaattttttgtatttttagtagagacggggtttcaccatgttagccaggatggtctcgatctcctgacctcgtaatccaccctcctcggcctcccaaagtgctgggattacaggcatgagccactgcacccagcctgatttttctatatgaaacttcttattaatttgtgaagttcataaataaatattttaaagattttggttggtattgcattaaatttataggtcagcctaaggttatttgcaagctttaaaatatttggtcttacaatccataaacatgaccatagttagattgagaaatacagatatagatttcggtcttcacacatgtttctttcaattatgatttttggttttctgcatacaggtcttgcataactttttgttacatcatttcttagtatctgatttttttttttttttaagatggagtttcactcttgttgctcaggctggagtgcaatggtgcaatcttggctcaccacaacctccacctcctaggttcaagtgattctcctgcctcagcctccccagtagttgggattacaggcatgtgccaccatgtccggctcccattttgtatttttagtagagatggggtttctccatgttggtcaggctggtctcaaactccgaacctcaggtgatccgtccacctcggcctcccaaagtgctgggattacaggtgtgagacaccgtgcctggctgtatttgatatttttgatattattgaatatattatattttataaaacttcattgcttatatcttttttctagtacatagaattgcaattgattttttaaaatactgacactgtatccagaaactggctaactcacttattaagtattataatttgtctttgcattgtattttctctacattaaattatttccaattcttcctctttctgttctttttctcatatttcatcctcaattagaatctctaggacaatagaaaagtgtgattgtaaacatctttattttatttccaattccaaaggaaagctttcaagtatcattattccattagatgttatagatttttttgtcagatgtcatttatcagctgtgaacattttccattgattcctaattggctaaaattctgattttgtcagatatttttctgcatgtattcaagtgatcatccaatattttagtattttgtaaattcatatgtttaattaaatcaattaaaaatcaattacaacaattgatttttgagtcttacagcaactttgcacttcctgaaaaatatgtatctttcttataatacatttttaaatgtttctagttggtcataacatattatccttttatatactattggatttttttgctaatatttattaaggatttttttgcattcatattcacgaagaatatttctctgtaatttttataatggaaaggttttgctattaaaattattctggcttaaaatatgacttgcctttctccatttttttttttttttttttttttgtttgagacggagtcttgctctgttgcccagcctggagcacagtggcgcaatctccgctcactgcaagctccggttcccgggttgacgccattctcctacctcagcctcccaagtaggtgggactacagtacaggcgcccgccaccacgcccagctaattttttgtattttttagtagagatagggtttcaccttgttagccaggatgctctccatctcctgacctcgtgatctgcccgcctctgtctccaccaaagtgctgggattacaggcgtgagccaccacgcccggccgcctttcttctttgaatgtctaattgaattaaccagtgaaatcatcaccactatgagattttttgtaataaccccttttctatttctgatattgattatcgtttttattattgatctgaatagttagaattttgtcagttttgttggtctcttcaaagtgagctgttccctttctcatctgttttctatttcattgatttctacttttgtcttcactgttttcttttacctgcttacttgctcacttactttcaccttgttaaggtgaaatcttaggactttagttttagattgttctccttttcttatataagcatttaaagctatgaatttgctgctaagcattaccttagcttttcctacaaattgtaatattttatattttccatgtcattcagtttgaaacattttctaattatcttgtaattttgttttaattcatgaattatttagaagtgtgctgtttaatttatagatattgggtgttttcttagatatctactttgatttctactttaattatgttgtggtcagagtgcacacctcgtatgattcttttttaatttattgagacttatttatggcctggcataggatctaatttggtttatgcactatgcacatgtgcaagaatgtatattttccagttgcatatactactctattatactaataagataaagacgtatctttaatgtcttcattgatttttgtctaaatgttctatttattgctgacgtagaggtgttaaatttactacaattatgaaattgtctatctcttaaattctatcaatttatgctccataaattgaggcctattatcaggcacatatacctttataaatgttatgtcttcctgatgaatgcctattttatcatgataaaatttttacaatctctcattatacacattgtcttgaagtctactttaactgataaactatcccctcaattctttttatgtttacagattccatgatatatcattttctttttacttaccttcagtctgtctttatagatctgtatctttatacttgaagtagcttagagtaaaatcttattttattttatccactttggcattctctatcctttaattggaatgcttaggcaagggatatgcaaaataggctcacaggccagccacctaatttagcaaaaatcgttttaaattggacacaaccgtgaccattcatttacatattttctatgactgctttcatgcaaaggtgattagctgagacagacaccatatggcctgcaagatgaaaatatttactctttggccctctaagagaaagtttgccaactgctagtttacatcattagcactcactgtaattactgatgtggataattttagatctaccgttttattattattttgttgttcctctattcccacttctttgttttctttttgattatttgaatatttttattatctcattgtaatttctgtctactggctgacttttttttaatctgttgattttctgcttataaatctctgatttttttttcagtttgttctagagattacaatatgcatatctaagctgtcatggtttactaagagttaatattgtattagttaatataaaacgtagaaatgctgctactttataaatccttttgccccattgaattttaggttatactttattgcttttatatacattgaaaaccccaccagataattattttttctttattaagtgaatttaaagagaaaaataactgttttctgcaattactctaatatttaccctttccaattgttctcaagacatgacggaaggtccagatatcactttggcatcattccctttcctttagccttttgttagccaatgttcggggcagatctggaaggtaataatttttctcaatttttattttacctcccttcctgaatgatatttttagtggatataaaattacggcttgacagttctattctttaaaatgttgtttccctgtcttctgaccttcattttttctgatgagacattctcatcagaaaaatcttattcaaatcactgcattcctgtaagtaatatacgtatcagtttcctctagctgttttgaaggtttttcttcatcttagagttttaggggtttatgatgtgtctatggttttctttggttatactgtttggggtttgctgagcttcttgatgctataaacttaagacttccatcaattcaaaaaaatttaagaccactgtttcctcaacttctgctccagtcactctcttgtttcttgtattgttacattagtaattccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctga

SEQ ID NO: 884 - DNA, 2938 bp, Homo sapiens
ttccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactct

SEQ ID NO: 885 - DNA, 189174 bp, Homo sapiens
ttccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctgagtaggagtctggctaatcatccaaaaatgtcaaaagagaaaccaaggtgaatttctttcccaagctgagatttgaaataaactgctagaagttgtcactgaatgtggatattagcaaataactttaagctacagaaacatcacagatttctgctttactacttttctgaatttgtaaaacacaaagagagggagagaaaaagagaggtggagaggtgggagggagtgggctagggtgagggcaagagcagggagcggggagaagaggatggtagggggagggggagagagaggaagtgggagaaaagggacaaagggaaggggagggggtagggagaaagaggggaagggggagggagggagggaggagtggggaggggtttaggtggcttttgaagtctaaagttcatttttcaatatcactatcactcaatattatgaacagggaactcacaggcagttgacagacacaggcaaggaatcatatgattagactaatcagtggaaggtgcaatgacagaggatggcatgggagcctatgaagaaagagatgatgtttctgtatattatacattctccagaaactaagagctccaatagtctatcgagacttcatttccctggcctggcgaggtggatcacagatgtaattccagcaatttgggggccaaggcaggagaattgcttgagcccaggagtttaagaccagcctgggcaacatagtgagaccctgtctctgtgaaaaataagataattagctgggcatggtggtacatgcctgtagtcctagctattcaggaggctgaggcaggaggatcatttaagcccaggaagtagagactgcggtgaatcattattgcatctctgcactctagcctgcgtgacagagcaagtctctgtctcggggaaaaaataaaataaaaataaacgagagagagaggaaaatttcatttcccttaacagcgaagggcttcactaaaaacaaatttatcatcctgccattttactaagatattgttttcacacatccccctttcaggtcattgccactcaaccatgttcaatctttaccctcctcatctctgagctggcatccatccatcttggttgatgattttttccagctcagagactcagtgccccagcacagcagttctccaagttacaataataaacttcatttgctcttctgactactctgggtcctgaaaatgttataactgacacagttgcagagccatccattggaacaactacactaaaatatagagattgtgttcaaacatgtatacttcacatttacagtaattactatggctttactttcatttgcttctctcagttttccttcatcttgcaacaagacaatcaagaaaaagcaggtagtaggtagcttctaacagaagaacagacaaaagagagcataaagaagatattagccaagaagtgatgcttgacatttttttcaaatagaaatctattaaggaccttaaaaaatcatctattatagccaaactggtgcctaactgaagtagtagctgagagtgcttcattgaaaatcaattagagtccaacctgattgtagacagtgtcccttcaacaaaactgacaagcattctatctctactttgataacatttgtatccaaaatgagaaaacactagagaaatatgaaaataaggcaatttcaatgtatgagttatatcccttaagttcatggatgacattaactaagttctgacaccaatacccctagggtgtctttatttcactcccccttctggaaatgattgaataatttataaaggatatatcttgggggtggccacttctacttcctgagctgcatacagaacataacatttttagagctcagaattgggttcaccaccttccattgcacagttaaagagactgcagtccaagaagggtaaggggtttgcctgctgtcacaaagctagggagcaatagaaccaaagttcaaatccagcaatgctggctgcaactctggtatcttctttgcattcttctgcttgtaccaaatcagatgttagcagaaacgcatggaatcctaggaatagtaaacaaagagaaactgataacaggacaatttacatacatggggcagaatgacaaaggaaaccaacctgggaagcgaagtctgccagggctggcagcagagaaagcctttgcttcctatctctacatcctaaaggaatgaggaggaggaagagagaagtaactgaaatccagaaagtactctgactatagcaaaggatctgcaggagctgtggccttggaaaggaacatgccctctgataaactgtggctttgtcaggaagaagctagagaataaaagctagacatcattttgctcctggcctctaatcacctcctagtgcctctcattagccttgcccaaccagaagccagagaacaaaggaggctgccccatcgatgttctcctaggaccataggaggagagaaaggggatgtggagggacaaatggaaaatattcagccaatatttcttagctgcgccagccttttgctttgcaatttagtcttccttaccctcctctattttctttcattgggacaaacattatcaaggttaataagagataatggcccatgtaaaaagagtattgtattcttttatggactttatctaaaatttactcaaatataacagaatcctgtagatgaagcataatatgcaacagatatactttgcaatatttaaaaatgattaatctcaaaagtaatcatctcagtactatgactcattagctggaagaaaacagtaataacatgttttgtgcacagaacaattttaattaataagcaggacatatttattcaaaaattataataagacattattattctcagaacatgaactttgatggtaggtgttagcatcctgttgggtcccagagaatgcacttctggatattaaacatgatggctttgagacctcaaatatatcagcttgtacagtcagctattatctacactgacaattgtttatggctacaaatcacccacgcttgatgtgatatctgaaagtacctcagtaagatattatgagcaatatcaggagtgggtggtgtaaaagtcatttcagtaataaaacagtattcaaagagttgattcaaaaggcagagccattactaataaaaataatataggtagatatttgttaaatgttttctttcttttgaagggcaatactatgaaaggagagtgagcatagggaagttgtctgcaacctctgagccacacacctttctttggtctaccacatatctgtgcagccattaagaatgactctcatctcttgcctttccaaaatgaggtgtaagagaagtcattctggtatagacaggagatatgttaccaaaacagtccaatggacccttttagggatacttcagttagaagttttagctctgtgtgggttcagtgtctctccacattacccctgagacctaaatcccacagaaaatcttaaaggcaatagatgctagttttccttatacctttcaaaaatatgatttgttttgttttgttttgttttgttttgttttgacagagtctcgctctgtcgcccaggctggagtgcagtggtgcaatctcagctcactgcaacctctgcctcccgggttcaagcgattctcctacttcagccttcccagtagatgggattacaggcacatgccaccacgcacagctaatttttttatttttagtagagtcggggtttcatcatgttggccaagatggtcttgatctcttgacctcgtgatccacccacctcggcctcccaaggtgctgggattacaggcgtgagccaccgcacccagccgacaaaatatgaatttttaaagaccaaacacatcagaacaaaccagctaacttgacttttaaaaaccacttgatttcacacaggtctcagatggagcaaaagtaaaaaaaaaaaaattaaaaaataaagacatcccacttgaattctagacaaaattttatattatctaatggaaatgttttttaaaccacataaactgatgagacatatcctttatcctctgaaagaaagaagaaaaaaacaatatttactagctgaacaaaatgccttgagtgaaatatctgtgagcatacatttttaatttcctaagatgaaaacagttttgagcaaggagctctcaaaaaaatgtcctgatgttctcctaatacaccaagaaataaaatctgtcaaagtgctgagattcttataggttttggtacatgttcccagttgatttgatctggctccagatgaaacatattatttaagcaagatagtaatcaaggtaactaacaattttaaaaattacttcaaagcatatactaaggcttgactagtgtgtatttattctctttccattatttctagacggagaaacaatttcattatattttaagttgtatcgaagcatttgttctggaactttctgatgcattagcagattctacctttaatatagtcatatgtgtaggtgtattatcatgcctgctagaccagaagaagtgaaagcctgaattggttatcgcattcccttttggagattaaaaaatagcattacaactatctgtgttgcatttcaagctaaacccatactttcatataaattgtttcacttggtctacataataatcctgtgaggaaaacagggcagcaattactgccccatttcatggatgaggaaattggcttagaagagttaagtggcttactcaaaggcacatggctgagcagttatggacctctgactcataactaagcccagttcaagaaaacacgtatttattcagtgttttaaaattatcaccctaagtcttttgggttcaaggtagtatacatatggcagactaatgaacaaaaagaaaagtaacatttatacagtatttattatacaagagtccctctcataagaactttatagataatagggtcattatagatttatctcatttaaccccatagcgaccttgttaacagtgagataaatctgtaatgacccataacaaccttgttatgcagttaaataagataaatctataatgaccctatgtcattgtcacgtcacagatgaagccgccgaggcacaatgcagatgattaatttgtatagaatcactgacgcattttttaaagaaattaaacaattaattagtgtgtattcatactagttgtacatatttatgaggcaattttgattttagagtccatgttcttaaccactatacatatttgcctccagagattccaaaacttacggacatcttttcattatgctacacagtctcccatgagcagagtatgaaaaaaatccagatatgaggccgggagtggtggcttatgcctgtaatctcagcactatgaggggttggggcaggtggatcacttgaggtcaggagttcaagaccagcctagccaacaaggtgaaaccccgtctctactaaaaatacaaaaaatagctgggtgtgggggcacgtgcctgtaatcccatctactagggaggctgaagcaggagaatcgcttaaacccgggaggcggaggttacagtgagccaagatcgcaccactgcactccagcctggttgacagaggagactctgtcttaaaaaaaaaaaaaaatctgaatatgaatctaagcaaacatatacacacaaacaggcatacatacctagacaaactatatgtctatctctacatctacctatctatacatacaccttatgctgagggtcttgaatatgattgataatcacattctgtgtggctaattgcatttaggccaggactcaaaaaaaaaaacaaaacatgaaataaaccaaaataacctagatgagtgagaaattctaagtttgaattttaactggggaggaaaaaagataaagaaaacttcacagattggaggccacttatctccacatttaactttcaaaacctttctcaaaatatctttgtatttaaaagaatccatcagtctttgcaaagagaggagagaaaatagacttgaggaagatgtttccttctgtgtgctgtgtgactcaggacacatgcttcttctgtgcaatgctttaccatcatctgccaaagacgtgtgtgcaaatatcagtcttgcaaacagacaatatttgcactacattgaggctaacctgccatctgcttatcagatgttcggagtccaaattgtacagttttccttgtgtttcccctaatgaaaaatggaatgctggggctctgattacaagtgtctgtgcacaggactaatactacatccctaggtagagtaatggaaacagtgcatctaggggaaatggcttatatattgacattgtttaaagaaaacagaattattttctgtggctcaggttcacatgaaatataaacctcctagttcactaaagtgtgatatatttttctcaaaatttggagaaccactgatgttctggacaactgtatttcagtgttaggcctagccgaatatatcaactaaaaatgcaatcacagtgaaaaattctaatgatatgcattatttctgaataagcaaatgccagaagcacaatcccaacatattatgaatgatgtgattgactaccagggttgctcgcagcccatagcttcaggtaacacagctgtctcctcccattaatgagaaaagagatagcattttctgtttaaaattaataactgtaacactccaggattataggaaaaattctaagtgtttcacacaaagtgcttcacaaaattttactgaagttcaacaaaatcattatataacaaatacatatgagaaattcttctttatggcttattctattgaattgcctattcatttttgccttcccagaatccacaattttcagcaagatgaatatgagcagaaataaaaatgccctttctatttaataccccctgctttcaattaaaagaaaactggttagtcatttagtatcttagaatatttcttacttataatgaattaggcattaattatattcttctatataaccaaaacaattttttagcaatggacaacactattattttctaattcatgttactttttttaagcatgcctttgggcattggatcactatcagcaatgtgcagagaatatcatcatcctttgaaaagctgtactactgatgtactttacagataaatagtaaaaatgtttaatgtacacctaaaacacaattgaaataaatgccatttcaggaatttgaaagtgtgttgaggttaccaagattatctgtgatccttttcaaacagcaataatttactcaaaaggctgtcatgtctgcttacaagactgtgcagatagttgacatagatgaaattagtattaatatattcattttaatttctacccatttactgtcttactaagggtaatttaactcagaaatgccgtcataatagggtgataatctgataatccggggtgcagtggaggcagggaagaaaggaagaaaaaaggaaaaacaatgacaataaatggcacaggcaagaagaaagcaataatgtaataattactaccatgttttgttcaattatcaccgaaaaatccagaaagatatgaaaggtgagcaaaggttctaccatgtttttgtaaagaaataaaagctcactgaaatattagggagaaatggaatcaaaagtaccaatgaaaaaagcaaaaataagataatttaaaaagaaattagaataagaaaaaactaggaaataacgttctttacatgtgaataatttctttttggttgagttgtaaatcacatatctgttattcaaaaatatttcctgattcatttgaaaagaaaacatattgaaaagggatctaaacaaaggttgtttttttttcccctctttaaatgttgctacctcaaacaagctgtaatctgagtattaaagtacaaaacacttaggaaatataattttccatgattactttgagcttcctgtaagtgtaacagtttttttactacagttttcctctctaaagacagaaatgcaccgtatgggcgcaaggatgctcatgccatagcctatgctcaaaagaggattcttagtctacattccagattcagctggagtctatattaactgcatccattcttttaatgttggccatcttgtatgggttggatgtcccaagaagccacttaactatgggtgtgattgtctattcaagaacctagaaaaaatggtaaactggttacataacaaataacacatcttgatctaagttgagaggactggagtcttctagctatattatttgaaaaaatgcaatcatgatttagtgacaaattgaatagcaacttcattaaccagaatttgactgtaaacccatgcaccgtcctagccagtatctcttttctccggaagagaggcatgggaggaggggagagaaaaaggtgagctatactactttagagtcttatgctagttctgtgaggtaaatgtaactactatttcctttatttaacaaacaaaaaatgaggctcaaaaatttaaacaacttgtgccaaagtcacagaggtaagaaatactagggcaggaattgctcccatgtctgtgtacctttaaaattcactttgcagctgcacagctgataagtctgctcagaagatttaaattataagaggaaaaaatgccttgcatccctggcactgtgcctagttctttccccaaactgaaaatgatacttgcaattttttgagccctcaccatgtatctggatcatttcaattaatcttgacaatgctggtcaagggactattattagtctcattttgaagatgaagcttagagaggtaaaataacttgccccatatcctacagctggtgggagacagagatggcattctcaccagctctctctaaactccaaagcctgtgctcttcccatttattccattctgctttctctccaggagtcttcataataactctgagttcagcagctgttttcaatgaggatataggctcaaagcaaatacaacataaccggtacatggttagatttctaagcctcttgccattccgccttgtggacaaggacatcaaatacaatgaaaaatgggtgccccgcaaatcaatacatctgttctttaatacctgtgatcacagctgtgaaataggcttaatacacagcctgaaaatattgttgtgaaaataactgtgtgtttggctgttaagtaaagttcagctggacacatgatctagtaagaggtgctaggctgctgcatgcaaaggaattccattagaaaagacagagaggtatgggaggaaaccgagcacaaagcagtgtgtccattgatgagagaagtcactcccacttcgcccacagatggtggcattaataaagatatcttgtacaatccaatgatgtgaatctcaatcttcagcatggataagaatcactggggagcttgttaagaatacagttttagtgtcatctcacctaagattctgattcaattaagtctggggtggtgcccaggaacctgaattttataaacatcccagctggttttttaattattattactattggtttctactttattctaggtttagtggttacacatacaggcttgttacatgggcaaattgcgtgtcactaaggcttgatgtatgaatgagcccatcaccaaggtagtgagcatagtacataacaggtagccttccaatccatgcccccccaccaccctccccaatgaagcagtctccagagtctttgttcctatctttgtgtccatttatattcaatgttgagcttccaattataagcgaaaacatgtggaatgtggttgtctgttcctgcactagtttgcttaggataatgacctccagctacatttcatgttgctgcaaagaacatgatttcattcttttttatggctgtgcagtattccgtggtctatatgtaccacaatttctttatctggtccactgtcaatgggcatcttggttgatgccatgtctttgctattgtgaatagcattgtgatgaacatatgagtgcatgcatctttttggtagaatgatttattttcctttgggtgtatacccaatagtggaattgttgggccaaatgatagttctgtttcaagttctttgagaaatctccacactgctttccacagtggctgaactaacttatattcctaccagcagtgtataagcgttcccttttctctgcagcttaaacagcatctgttgtttcttaactttttaataatagctattctgactgatgtgagatagtatctcatagtttgaaatttaatttctctagtgattagtcataatgaacattttttcacgtatttgttggccacatgtatgtctttttttgagaagtgtctcttcttgtcctttgcccacttttaaatgcaattaatatatttttgcttactgatttaagttccttacagattctggataataggcctttgtcagatgcacagtttgctaatattttctcccattcagaaggttgtctgtttattctattgatagtttcttttattgtgcaaaagctctttaagttaattaggtccttcttgtcaatttttgtttttgttgcaattacttttgggaacttagtcataaattctttgcaaaggcccatgtccagaatggtatttcctaagttttcttctagggtttttattgttttagttctacttttaagtttttaacccatcttgagttaatttgggtatatggtgaaaggaaggggttcagtttcaatcttttgcatatggctagccagtgatcccagcaccatttattgactagagggtcccttccccattgcttgttatcgtcaactctgctaaaggacaggtggttgtaggtttgtggctttatctcagggttctctaacctgttctatcagtctgcctgtttttgtacctgaatcatgctgttttggttactgcagccttgtagtatagttttaagtcaggtagtgtaacgcctctggctttgttctttttgcttaggcttgctttggtgattcagtcttttctttgattccatatgaattttagaataactttttctaattctgtgaaaaatgtattggtactttgataggaatagcatctaatatgtaagttgcttttggcagtatggtcactttaacaattctgattcttcctatccatggaataggaagaatatttttccatgtgtttgcattgtctctgatttctctcagcattgttttgtaattctctttgcaaggttctttaaggtccttagtaagctgtattcctaggtattttattctttttgtagcttttgtaagtgacactgtgttcataatttcgttctgagcttggacattattggtgtatagaaatgctactgatttttactcatagattttatactctgaaactttactaaggtcatttatcagttctagaagccttctggcagaatctatggggttttctaagcagagtcatgttgtcttccaagagtgagttagacttcctctctatttggatgccttttatttctttgtcttacctgattactttggctaggatctcctttactatattgaataggaatggtgagtgtgggcatccttgtcttatttcacttctcaaggggaatgcttccagctttcacctaattgctatgatgttggctatgggtttgtcataaatagctcttaaaatttagagatatgttctattgatgcctaatttcttgagggttttcagcacgaaggaatgttcaactgtatcaaaggctatttctttgcctattgagataatgatgtggtttttgttggtaattctatttatatggtgaatcacatgtattgatttgcctatgttaaaccaacattgcatcccaggaataaaccctacttgatcaccgtaaattaactttttgatgtgctgttagattcagtttactagtacttcattgagaaaattttgcatctctgttcattggggatattggcctgatatttttctttctttttttttttttgtttgttgttgttgttgtgtctctgtcacattttggtatcagaatgatgctggcttcaaagaataagctagagaatcccttctcaaattttggaataatttcagtaggattagtactagctgttttttgtatgtctggtagaattcagctgtgaatccatctgctctaggcctttttttttttttggttggtaggctttttattactgattcaatttcagaactgattattggtctgttcaggattttaatttcttcccagttcttgggagggtgaatttccaggaatttatcaatttctttcagtttttctagtttgtgtgcatacagctgttcataatagtctctgaggattttttgtatttctttgagatcacctgtaaagtcacgtttttcatttctgattgtatttatttggttcttctccttttattaatctagttattaatttattatttccctaaatagtcacaaacctaatttgtcaagttatagctcagttgcattacaaaagaagttcttacatcaagtattacagaagaatcagtagtatttgcttgggcagtacatgccatcagattatgaatggattataaatgcaaactgacgtgtgacttttaaaataccatgatctatccaatttgaaagagaccattaaagtggagatttcaactcctaccactataactctaaagtatgatctttactttggcagaatattacagacttagaggtattgtttttatcacttggttttgtttttatccatagcaaagccttcaataatatttcaggccacagagaaaataatacaagtttttgcattgttgatacttcaaccaagatagtcattcttttaatgtaggtctgctggtgtcaaattattttattgttccttcatctccgagaatttcttgatttctcctttatttctgaagagtatttattactggatataggatcctgagttgacaaaattttttctttcagcacttcaaaactattgtaatttttgctggcttccctggtttccgatgagagatccagtgtcatctgaacgttcttttttccacagagaatgtgatatttatttctgactgctttaaacatttgtctttaattttcagaagtttgtctatggtgtgatttcatgtggatttctttgggcttatcatgtttggggtttgcattatagtcccatacatttctgaggttgtgttttgtttttgttttctttaaagtctattttgtccctgttgtttacattgtgtaatttctatttgtattatttttcaatggactggttcttttctctgtctcctctgttcagctattgagcccatatgttgactttttaaattattattttattggttaatatttttagttctaacatttctatttcattcttctttgatttctttgctgtaacattctatttttttattctcctttggtgacattcttcccctttgcttatttttatttttaatttttatggctacataattgtacatattaatggggtacatgtgctatcttgatatgagcatacaatgtataataaaatctaggtaatttgaatatcgattatctcaaacatttatcatttctttgtgttgggaacattccaaatcttctcttcaaccaattttgaaataggtgatattttttcatttgttcaaggatgtttatgattgttcattcatttttatgatggctactttgaaatctttgtaagataattctaacatcgctgtcatctattaaatgtatttttttattcagcttgagatcttcctggttcttgatatgacaagtgatgtttgaatgagatggagacattttggttattatgttaaaagactatggatcatatttaaaattctggatcacatttctgctttagttggcttcttctgaaactgctttggcagaggaagaagagggttgcctcattactgcctggtgagggtaatctttaggggtaaaagtggttctcagttacatggatgaattgtataatggtgaagtctaggatattagtgcatgcattatctgaatagtgcatattgtactcaataggtagtttttcatttttaccccctcaccccttttaagtcttcgatgtctattataccacttggtatgcctttgcatacccatagcttagctcccacttataagagagaaccttcagtatctcgttttcaattcctgagttacttcacttagaataatggcctctagttccaaccaagttgccacaaaatacattattccattctttttatggctgagtagtattccatgataacatacatcacattttctttatccactcatcagttaatggacatttaggttgactgcatatctttgcaattgtgaattgtgctgcaataaacatatgcacacaggcatctctttgatatattcattccttttcttttgggtagatacccagtagtgagattcctggatcaaatggtagatctacttttagctttgagaaatctccatactcttttccatagaggttgtactaatgtgtatttccaccagcagcatataagtgttcctctttcaccacgtccacccgagcatcttttggggatttttttttttgactttttaataatggttattctggctcgggtaaggtggtatacattgtggttttaatttgcatttccttgacaattagtgatgttgagcatttattcatatgtttttgaccatttgtatattttttgagaaatatctattcatgtcttttgtccacatttcagtttttaagttgtctgtttactgtaatgattatttattttgctgtgaagaagctttttagtttgagtcctattcattatttttgttttgttggatttgcttttaggggtcttagttataaattatttgcctatgctggtgtccagaagagtttttcctaggtactcttctagatcttttatggtttcaggtcttagcttcaggtctttaggtctttagtcaaggtaaagttaatttttgtatctagtgagagacagagatccactgtctttcttctacatgtgactatgcaatttttctagcaccctttattgaacagaatgtcctttccccgatttatgtttttgtatgttttatcaaagatcagttggttttaagtatttggctttatttctgagatctctattatattccattgatctacttttataccagtaccatgctgatttggttacgttagccttgtagtaaaatttcaagttaggtaatgtgatgcctccagatttgttcttttcgtttaggttgctttgactatttgggctattttttggttccatgtgaattttaggattgatttttctaattctgtaaaaaatagtgttggtaatttgatagaaattgcattgaatctgtagattgctttggagtgtatggtcattttcatgatattgattgttctaacccatgagcaaagaatgtatttccatttgcttttgtcatctacaatttctttcagccgtgttttatttttcttgtagagatactacacctccttggttaagtatgttctagcatattttatctttttgtagctactgtaaaagggattgagttttttatttgattttcagcttggttgttgttgatgtatagcagtgatactgatttatgcacactggttttgtaatgagattttgctgaattcatttatcagatctaggagtcttttggaagaatccttagggctttctagatataagattatatcattggcaaacaaagataatttgactccatgttttacaaatcgaatgccctttatttatttctcttgtctgattgctctggctaggattccctgtactatgttgaatagaagggataaaagtcagcatccttgtcttatttcagttaataggggaaatactttgaactttttctcattcagtatgatgttggctatgggtttggaatatacagctttaattatttagaggtatgtttcttctatgtctagtttgttgagggtttttatcataaagtcatgctggattttattgaatgctttttctgcatctatagaaatgatcatatatttatttaaaaaaattctgtttatctgatgaatcacatttattcccttgaatttgttaaaccatctctgcatccctaaagtgaaatccatgtgaatatagtggattatttttttgatgcgctgttggatttggtttgctactattttgttgagcatttttgcatctatattcatcagagatttggtctgtagttttctcttttttgttaagtctttcctttgctttggtaccagggtgatactgggcttgtagaatgtattagggaggattctcttcttctcaatcttttggaatagattcaatcgaattagtaccaattctttggatgtctggtagaatttggctgtgaattcatttggccttggactgtttttgtttgtttgcagtgttttggtttttgttgttgttgttgttgttgttgttgttgtttttctaaattactgattaaatctcactgcttcttattggcctcttcaggatttctagttcttcctgattcaagctagcgggggttgtatgtttccaggaattaattcatttcctctaaattttctagtttgtgtgcatagagctcttcacagtagtcccaaataatcttttgtatatctgtagtatcagttgtaatatctccattttcatttataattagtcttatttggatcttctctcttcttgtcttggttttaatctacctagtgttctaacaattttatctttttgaaggagctattttttgtttcattggtcctttggattttttttgtttcaattttatttagctctgctctgatctttattattccttttcttctgctagctttaggtatgtttttttcttatttctctggttccttcagatgtattgttaggctgtcaatttgtgatctttcagaattattgatgttggcattttgcactataaactttcctcttagctttgcttttgctgtatcccagaggttttgataacttgtgtcactgttgttattcatttcaaaaattttttaaatttccaccttaatgtcattgttaacccaaaaatcattcaggagtagattgtttaatttctatgtatttgcatagttttgagggttccttttggaatcgattcctagttttattttaccgtggtctgacaagaaacttaatatgattttgatttttaaaaatttattgaacttatttagtgacctatcatataatctatcttggagaatcttccatgtgctgatgagaagaatgtatattctgtagttcttgggtagaatgttctgtaaatatctgttaggctcattttttctagactgaaatttaagtctagtgtttctttgttgactttctgctttgatgatctctctagtgctgttagaggagtgttgatgactcccactattattgtgttactatgtattttcttttttagacctggtaggaattgccttatgaatctgtgagctctagagttcggtgcatataaatttagacatgttatatcttcttgttgaatttatcctattttaattacataatgaccttctttgtccttttttaatattgttgctctaaagtctattttatttgttttaagaatagctactcctgcttgcttttggtttccatttgcaagaaatgtcttttttcaccccattagcttgaatctataagaatctttacatgtgaggtatgtcttctgaagatagcaggtatctatttggcttgcaaatttttaaaatccattctgtcagtgtgcatctttttaaagtggagcatttagaccagttacattaaacattgagatgtgaggtgctgttctagtcatcatattgattgttacttagtgactttgttttcttcatattgttattgttttataagccctgtgaattttatgctttcaggagtatttattctggtgagtaacaacaacttgtttcaagatttagtattctatttagcacttctcatagagctggtttagtattgacaaattccttcaccatttacttgtctgagaaaaactatttctcctttatctatgaaagagttttgctggacacaaaattcttgaccaacagtcattctgttcaggagactaaagataggaccccaattccatctggcttataaggtttctgctgagaagtctgcagttagtttgattggttttctgttataggttacctgatgcttttattttactgctcttagaattttttccttcatgttgactttagatagcctgatgagtatatgccttagtgatgttttgtttttgcaatgagtctctcaggagttctttgaccttcttatatttggatatctatgtcactagcaagtccagggaagttttcctccctggaaattttcctcaaatagacttttgaaatttttgctacgtttttctccctcaggaatatctacaattcttatgtttggccattttatataatccacatatttcttgagactttccttcttcttttaattcttttttgtttacttttgctgtgctgattgggttaatttgaaagccttgtttttgagttctgaaattctttcttctgcttggtctaatctattttaaaagcttttcactgcattttgtagttgccgaaatgtgtagtctttcatagaagttctgattggctttcctttaaaatatccatctctttagaaaagttttcattcatgtcctgaattaaaaaaaattatgttggttttcaactttatgttaacttaataatcaacttttttgaattatttatctggtattttatgttggttttcaactttctcttatgtctccttgattaacataataatcaactttttgaactctttatctggtatttcaaagatttcatcttgatttggatccactgctggagagtcagtgtgattgatttttttgagttgtcatagaacaactcaaatgttttttatgtttccagaattgtttttatggttccttctcatttgtgtaggctatttcttctaattattttaaaattagtttttgattcaattgggtttaaaaaaattttcctccttgaagatgtgactttaacatttatagtttatttacacttagtttcagctctgggtggtttcaagtggcaaagactgtatgagtttcttggttatagagaatcattgtgaagtgtctttctcagatgccggttgtagtggcagtgggctgggtgtgtgagtaggttcactgtctcctaaggggctggaatggcagaggtctcatgaagcttattttgttccccagtggtgtgcacctttaaaagtttttcttccagcattttattcaacgggttgagtagttcaggcttcaggccagtaggaggtgcccacagataaacacaggttgtggctaaagcgggtgggtaaatgtaatatccaacgattggatgaagtcccagctttgacagaggcagctggcaaagctctccgtgaaatacactgaggtcttttcatggggaagtgaaggagccaccccagctctccttccaggcaaagcaggaaagcaatccacctcccagtcacactgctgacctggtgttctagcttttcagatcaaacaggtatctctttctatctgcaagaatgctgatgttccctctaaagaagggttgtagctctacctcttgtgtaagtctgaacctgtatggcacacttcctgtggatagttaccttggagtgttccagaaagtctgtctacagatgcatccatgctgagctcccatgagagaagccccagctctctgcagtgttgggtgaggggaaaaagaaatcaccttctcaaacctttcatgagcgctgtttgactgttggggtagagctgcagactttccccactgagcccagcactgcacttgtgtctctcccgaaagaaacttctcacaagtgggaagttaagggactcaaggcccatggtctgctttcttttataccatgggatgctcccttaatgtggttcactactctttccccaaaaaatagtagtccctgaaagccaggctattctgaattctactgctcctctaggtctagctgtccagtggggctgccacagttcaggctgtactggagaatatctgcaagggatccagtgatgtgaactgtcctctagtttcccagcaccaggtgccagcattacctctgatgggggtgggtggggagtgacacagactctgagattttcttggttataaatagctttagtgttttggttttctcaaatgccagctgtagtagtagtgtattgggcacatagacagactcaagacgtcctatttagctaaggtaatactggcaatggcaatagctgaggttgcataaaagtttttggcttcctgagtgctgggttattgtttatgcagatgttttaatgggctgtgccggttggcctccagccagtaggtcatggcttgtagaaaagcaccagctgtggaggtagtggtagaatttgtgcttgctttatgtcactcaggggaggtattcctgtgtctcaggtaggtaatgggtagggccatggagctcccaaacatccctgtatattgcactgtgctaccagggcaggtggaggggcaaagctgggtatgggctaggtcaggcaactccttgctctggctcctcacatgcaggcacaagcagcggccccagtgaggatcataagtcaattccttggctactggggtaatatttcagggagtagcacagctgcctctgttgcacagaagaatccgcatgggatgcaggggttagcaagcagcagtaagccccactcagctcccatgcacttggcaaggcatgtatcccactcataatgttcgctaaaagcagcaggctgggttccaggtagtctgtacgtagaactaaaaactgccccaggccataagccgtcccagtggagaccagtgaaaccacagctttcaggccgcaccccttctggtctacctgtgaagcaggagtgcccagctcctgcgcccatggctatagcaaacttactacttgcccctcatttctggccaacagggtttatcctcactcaaggttataatctcatatctcagatgggagcttctctcaacctgtgactgcagcttgagttagctggtagacttctgtgaggtcccctgtgaggtaggatcaggaatggcttccctctgtccttgctggagtgtgaaagtgcaggcaatgtgcatcctgataccgcttcttctcaccccatcactcgctaaatcagctccagcactgggtagtgttaagatctgcctccatggcctgaattgcccggctctccggtgggagtgtgtgtcacggtggcagtctctccccctctcacacactctggagactcacagttttccatctggttcacagtgtaggctgctgtttcttctttcaaagggtctgtagtttctttcagtttttctgttaagttcctgtgttgcttcttagaaagaagtgcacattgtgaatctctgcacactattttgtctttccaagtgggagaggcaggctaacaatgcctccaaaccactgggccattttaaataacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatattaaatttaaagatataaattccaacacacatagatataactacatatagccaatgaagccaccaatcttgtgacacttctttgtagaaaaagaaatttccatgttgtagcatattgcattttctaaaaatggccagactaatattatgtctcaacccacataatctccctaaaatgggtctacactctttccattgaatctgggtaagggcttgtgactgctcctaacccacagaaactataagagataataaatgattgttgtcttaagtcaccacattttgggatgatttattatgcaccattagatgacaggaacagctgtgtgttatctttgttatttgatcttttgaaatatagtttaacttggaaactgaagacaagtttattcctttatttaaaacatatttaatatgtgcttactgctctttttcattgtgataaaaaactttcattgagagagaaacatctcttaatattagtttgtcaggtgttagaatccaggacccctgccctggaattgttcatgagtccaagcagttgtaactgcatctagcaaataatggtctgctttgctgtctccttgttaaaagtacttcaaaatgtatgcaaaatatgtcttatagccagcaggcttctcattccttgctagggactctgtaaatgaaaaacaaaacaaaaaacccaaagctacagcagaacacatttgaaattatgaatacaaccataaaaatggcaattctaaggtaaggtttgagaatacagaacttatctgagcctgttgccttcttctgtgcaaaagaaccattatagataaacaggcagcagatagtcacaattcaatgccatgatatgtggataaaacgaaacaaaggtcgagaaattagcttacttccagatgttctttgggtcaggctcatctatccctaacttctcatatgaaagttaaactgccacagcctgaaataatagataattgaaattctcattttcttcagaaaattctgcaattaaaatgttgatatttctttaaaatacacacacacacacacacacacaaacacacacacacacacacacacacacaaaacctgatatcaaatcttacattccctccacccagaaaacatgactaggtcatttaaacagtacttgaatatattcacagaaaatcagcaggtcaggtagaaaattactcaccctacacaccagttgtgtgagtgttgcagagtatgaaccgctgccaagatatctgtcattggcatatctccacttttcaatttgatacaatgtgtttaacctatcactgttattcagtgtactataactgctatacaagcacctgtgtgtttaccagagctttactattcccttggctagaaatatttccaaacaaggtactaaatataaatgcccgccattttcaaaaatatatatatataataaacattctccaaatattttaaaagcctacagttaccaataagcttttgtgtacataaattagagaataaggggcaaagaaaactttattagcataccattaagtacttaatttattatttttgcagtgacatccttgcaggatttcttctttaacatgaaaaagtcaacatcttaactgttgaaggctctgctttagaatcctaggggcatttccagacaagttctagcgattattgtgaaagtacctgtttctagaccaactctttaagcagaccactaaaaagaccttttcaaatcttccatgtaaaggaaagccttgaaagggagagagctagatagatacatagatacacatatatagatagatgatggagatagatacagagaggtcagatgataacaaagatcagattataacaaacttaaatgtaggtgctccagctagctaacagagaataacaaatcatcacacagtttagtgacttaaaacaattatcacataatttacaatctaaacttgtaaatcttgtcaacagcaatcaggagtccacattatcctttaaaccaaattttatttccaagtagaaaatattttcttatttaattgtatactgatctgaattcaatgtatcttgtacatgaaaatagcaacttggctctgctgggtaactgaagaccatgtttgtgactggaagcatgttattaatctacttaaaatcttcattccttaataaaatctactccctgtcaacatttattttagaaactgaaatctttgtgagcatagctatattggcatcataagctctaaatggaagactacttaagggcatcttcttatttctagtagagttaatatcattactaaccccaactattctgatgaaataggtatctagcataaacatcaatcatcttcttttataactcattgataattccccatggtcccttgctctatttttcatctgttgtaacacataaaggggttcaacaactactttattctaagctttctctgctgcaaaccgaaggttactaattcacttcattaacaattacaagtatttgtatctgtcctcacaaattcaaaattgaccattttataaaagacatatcccttctcttcattctacctttgttaggtatatttttctatttccaaatatttattttatttccaaatcatgattcattcaaataagttttacacaaagaagaaagtacaagatgtgtaacagctctagtagagaacatttcagctgtgccacaaaaagaaaacagcaatataatggtgtgctgacaaaataggccaggcatggaggctcatgcctataatcccagcactttcagagaccaagacaggcagatcacttgagcctgggagttcgagaccagcctgggcaatatgacaagcccccgtctctgcaaaaaatacaaaaattagccaggcatggtggcacatgcctgtagtcctagctacttggcggggttaaggtgggaggattggttgagcttgggaggttgaggcttcagtaagccatgatcatgctactgcacactagcctgagtgacggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagttgtaagaaataatatagagacatcccttgcaaactttatccccgtcttacaaaatgttaccacatcatccccctgtggtaacattttgtaagactatattttcagggtcttgacactgatataactcactgatcttatttttctccagttttacttgtattaatttttcttagtgtggtatgggtgggtgtgcaataagtctatacaattttgtcacctgtgtaggttcatggattcaccaccgcagtcaagatgttgaacagttcccacaccacaagagtattcatgttgcctttttataactatatccatctccctccttcaaaatcccacatcctcctgctagctcagtgcccccacacaaccactaactattccccatttctaaattttattatttcaaaatgttttataagtggaattatatagtatgtaatcttttgggatttttttcataacataattcttggagatttattcaacctaaggtgtttatcaacagtttattcctttttattgctgagtagtattccatggtatatatgtacaatacaaatatgttctcccattctttagcttgtaattttattctcacatggttttcacaaagttagcattttacattttgatgaagtctaattcatcaattttttaaattcacacttcatgattgtggtatcaaggactctgcctagccctagatcccgaatattttttcctattttgttctaaacattttgtatttatattataattttttaatattttacctttgtctctgatccattttgagtttatttttgtgtacagtgtgagacttcgttcggaactcattttgctgcctataggtgtcaaattgctccaacaccatttgtggaaaatgctgtctttcttctattaaattggttttgcatctttgtcaaaaatgtgttgaatatacagatttttgtgtggggatatttatgggtcccctattccagggctccccaacccctgggccacagacaactaccagtctgtggcctatcagcaaccaagccacacagcaggattggtgagtgaactttactgcctgatctttgccttctgtcagatcagcggtggcattagattctcatacgagctccaaccctattgtgaacagcacatgcaagaaatctaggttgcacgtcctttatgagaatctaatgcctgatgatctgaggtggcacagtttcatcttgaaaacacccctgcctccactcactatccgtggaaaaattgtcttccatgaaactggtccctggtcccaaaaaggttggggatcgctgccctattctgttccattgatctatgtgtctatgctctggcaatgtcacaccactttgattattgcagctatagtgtaaaacttaatatcaggtagagtacttttccccactttatttacctctttttattatttaactatttttgctattcattgtaaatttagaccacatgcatttatatttccaaaaacttgccaggattttgaagaaattgcatataaatccttttgggaactataatgaaattaaagaaagaaacagaaatgttctaggataacagagcaaaggcagataaagttctggcattggaggaagactaataaactaatacaatatgaaaaaaattgatgtgaaaaaatagaatatccacttgaaccatacatgcggacgtgtggataggcatcagcattccagcacaacggatgggacagaaacaaaaaatgagattatagcacaaagagttaactttaactatgtagtcatcacagaatgttatgggagcaaaacaataactcagtcacagcaatagaagtgtcaattttattataatagtgctgaccttttttggggcaagtggaaggggtagggagtagaagactgtcaataaagacatgtctgtatggaaatacagacatcttttgttggtaatctgctaaaaccacatacttttaaaggtgaaagagagatgaaaatacattatgttattaaggtatactctaaattgccaggcaagattgagaaaagtgatgaggcttccctgatagagactccacaattagaaccaaagcagtacagagcagcaacctgagcttccatcattcactcactgggattcccatcaacatacagcatccttggcaagtcttgttcagatggaaaagcagtcacaagaggagtgctcttctaatcctgtgctaaccaatctaaaagcatttgtgactgaagtagtggaaactctgaacaaaattaccttgtaaattttagtttatagtagcccagatatgtggccatgctagattccaaaaacttcagagaaaaatgggtataattaatgacctcttattctgacactttgagagggtttgaaggctatcaataataattctgtgatctcaagcaaaaaagaaaaaaaaaaagaaaaagaatgcggctgcacctcagactccatgagaagcttatatgtaaatggacaaaattcagaagaaataagtgcctcgcacaggccttaacacacaagttgtgctcaatcatgtttggtaaaagaatgaatggacattgtaaaaccaaaaattaacatctaaagggttcatacactacaagccaggagagtcaaagtatatatcatctgttcatctaatcattccatcattaatttattatgagcttcttgctttcagggtcccatagtccagagtgaaaaagtgatatgcaaaccaaaaaatcaaaatacaggaaagtaactatgactaggtaattgtttaaaatactttgggaacaggcaggctggagttattaattaactatatttggggaaaagaagactacaaaagtcttcacaatgtagttaacatttaagtaattttgaagaatagcagagatagagagttataaaaattactcttttttttttttttcttgagacagagtcttgctctgtcgcctaggctggagtgcagtggtgtgaccttggctcactgcaagctccgcctcctgggttcaggccattctcctgcctcagcctcccgagtagctgggactacaggcacctgccaccacgcccagctaaattttttttttttttgtatttttagtagagagggcatttcaccttgttagccaggatggtctcgatcttctgacctcgtgatccacccgccttggtctccccaagtactgggattacaggcgtgagccaccgtgcccagccaaaaagaactctttatatatgtttttgaaaagaagaagaaaagagaagcatatgctatcaaaaaagaaattcagtgctggaatgataatgagctcagagcaaaagtaaagagataaactgcctatagattgtttggagagcttaagttgaaccctccctagccattcccaaagatgcaagccccctataaaaatttggagcacctaacactacaaagtttgaaagaatattatctttgatatgattcctccctgtctgttaacttccatgtttccatcccattggccctgcttttatgtatcctccattggcctaacagctctcaaccagaggttttaaaccctgacagctcattagcatcaccagaagaacttttacaaaagccttccacttgtgtcccttccccagggattctgattccactggtttggggtaagggaccctgtgttgcccacagcggctgatgcccatcaaaagggcattaggaaaatcactctgcgggaaatcactctggcccgccatggtgaatgagtgtttttaagaggattaaacaaacatcaaaaagaaaaaaattaatgtcatggagttccataccatcttaagacttaatgattcatatgccattacacagaaggaatttgcccaagatagctatgaattgtagccatgatctctaaaaaagagtcgaatatgcgaatcctacctaaagaccggggacaagtgatccttaattcatacaaacagtaatggggagacactaaaatgttttctgaagaacattgacaaattaagatttgcacattataagaaatattctagctacatacaagaaaaaatgattgtaaaaaaatcaaagatgattcccagacttttgtttgggaaaccagatgaacataaatacaattcatcgagaggtaatggagaaaaaagtacaggcgtggcagcggaattagatgaggacagaagttctcctttagatatgctgatttttgggtatatatattacatagtggtttatacacaggttggaaattcaggagaaaaatcattacagatgggagatgtgtatttgagatccatctgcatatagctgggttgttaaggcaaagaaatagataagcttgttctgggagggtgtgtagaattctctttaggagaagaatacctagggcagaatttaaaggaacgctaacataggcagtagaaaaacacccacaaagtagattcataggaaatggccagagaggtagaaggaaaatcaggagagtgtggcataataggtgccagaagaaaagagtgtttaaaggaggaatgattgaacaatacttgcaaacattgcaatgatttcagtggagaatgcgactgaagtttgattagagtgaattaaggagtagatgggaggtaaaataaaaagtagaaataagaattagaaaaggtttataaagatggtggaagagaactttccagtgcttatccccacagagaaacattaatttgaacaaatatccatgcacaaacaaaagttcacaagagctaaagaaaccatgtgagagattacagaagctgagtggagcacagaaataagaaagacacactgataaaggtaagaaggacagttttaaatcacctgtgaagccgcttcacaaactgtatacagcacggacacagacagcagcaatacccaacccttacgggaaggaaagtgagcaccaaacttactgtggaacccaacactgggcctgctccagcaaaacccaacttcacgcaggcacctatggccccagactccaggctgatacctgcagactaagcttccaggcccacctggattctaggatagctcccacagccctgggatccatgcctgctcaatagactcaatctctgggcctgccccactgccaggctgaccccagcagccctaggctcgggaacagccccagtatcaggcaagccctaccagccctggcccttggtcagaaccagacatcacagatgtaggcataagcctgacccaggaccaggcctgacacaggccagcaccttgggacccagcctccaggttaagccccacagactcgggcttcaggcttaccccaggtttcagacaagccggaagctaaaacatcccatgcagtcccaggcctcaggccccaacaccagattagcactcctggtctcaatagcaggggactcaaatatcccactttcagcaatgaaaaaattatccagaaaaaatatcaataagtaaacatcagattaaaactacactttagaccaaatagacccaacagacatatacagaacattcccattaagcagcagcagaatatacttttttctcaaacacacacagaacattcttcagggtagatcatatgttaggtcattcacaagagcttaagaacccatgtgggagattacagaacccgggtgtagcacagaaatattggcaaaacaagtcttaacaaatttgaaaagatgtaatcatattaagtattttttctgatcataatggtaagaaattagaaatcagttaactggaaaaatttcaaaaacttcacaaatatatgaaacttaaacaatatgctctttaacaaccaacgaatcaaagaagaaagtaaaagagaaattaaaaactattttgagataagtgaaaagagagacacaaaacagcaaaactcatgatgtgtccggaattggtgggttcttggtctcgctgacttcaagaatgaagccgcggaccctcacgatgaatgttacagtttttaaagatggtgtgtccggagttcattccttcagatgttcagatgtgtccagagtttattccttctggtgggttcgtggtctcgctggcttcaggaatgaagctgcagaccttcctggtgagtgtcacagctcttaaaggcggcgcatctggagttgttccttcctcccgtccagagttgttcatccctcctggtgggtttgtggtctcgctggcttcaggagtgaagctgcagaccttcacagtgagtgttacagctcataaaggcggtgcagacccaaagcagacccaaagcttccacaaagaacaaggcttccacagcctggaaggaaaccccaacacgttgccaccgctggctcgggcagcctccttttattcccttatctgaccccacccacatcctgttgattggcccattttacagagagctgattggtctgttttcacagggtgctgattggtgcatttacaatcctttagctagacacaaaagttctggaagtccccactagattagctagacacagagcactgattggtacatttacaaaccgtgagctagacaaagagtgctgatcagtgtgtttacaatcctttagctagacacagagtgctgattggtgcatttaaaatcctctagctagacataaaagttctccaagtccccaccagattagctagatatggagtgctgattggtgcatccacaaaccctgagctagaagcagagtgctgattgggtgcatatacaatcctccagctagacaaaaaagttctccaagtccccacctgactcaggagcccagctggcttcctctagtggatcacgtgcaggatccctgggctgagctgcctgccagtcccacaccaagtgccgcactcctcagcccttggggggtcaatgggactgggcgccgcagagaagggggcagcgcccatcggggaggctcgggccttgcgtggggaggggggttggggggcagtgctcctgcatggcaggctaagggtcccaagccctgccctgctgggagacggctgaggccctgagagaattccagcgcagtgcccgccggccggcactgctgggggacccagcgcaccctctgcacctgctggcccgggtgctaagcccctcactgctcggggcctgctgtgctggcctgcggctccgagtgcggggccagccaagcccacgcccacccagaacccgcattggccggttcccacccgcgcctctccctctacacctccccacaaggaaagggagccggctcctgcctcggccagcccagagaggggctcccacagtgcaacggctaaaaggctcctcaaatggtggccagagtagatgccaaggccaaggaggcaccgagagcgagcaagggctgctagcacgttgtcacctctcaatgagatgcagcaaaagcagttctaagatagaagtttatagcaatagacacccataataaaaaggaagatcccaaataaacaaatgttacacctcaaggaactaaaaaaaaaaaaaaaaaaaaaactaagcccaaagttagcagaagaaaggaaataataaaaatcagagcagaaataaatgaaatagtgactgagaaaatgatagaaaaaaaatcaacaaaagtggctttttggaagttaatcaaaatggacaaatctttaagtagactaataaaaaagagaaagactcaaataacattatgaatgaaggaggggacattacaactgataccacagtaatgcaaaagagtataagacactattatgaataattatatttcaataattgaataacctagaagaaatgggtaaatttctagagatatcacccacccagattgaatcaaaagaaagagaaaatccaaacaaactcataatgagtaagaagattaaatcagtaataaaaagtctccaatcaaagaaaacccaggaccagatggcttcactgcttaattttatcaaacatttaaagaagaattaattccaatccttctcaaactcttctgaaaaacattgaagaagaaatacttccaaactaatttcatgaggttagcattaccaccataccaaatccataaaaggacactacaaaaaaataaaattacatgccaatattcctggtgaacatagatacaaatatcctcaacaaaatactagcaaaccaaattcatcagtatatttaaaggaacatttatcatgatcaagtaggatttattccagagatgcaggtatggttgaatataagctaatctagaaatgtgatacaccacattaacagaataaaggacagaaaaatatgatcatgtccatggatgaaaaaagcatttaacaaaattcaatatccttttgcaataaaaattatcaaaaaattagatatacaaggaacataccttaacacagtaaattccatatatgacaaatccatggctaatatcatactggatgcctctaagattaggaataagacaaggattcccgttcttttcggttctgtctaactaaagtgctgtaagtcccagccagagcaattaggcaaaagaaaaataaatggcatccagattggaaaagaggaagtcaaattgcccctctttgcagatcacatgatcttataaatagaaaaaattagtgacctcactaaactactcttaaaactgatacattcagaaagttgcaggatacaacatcaacatacaaaaatcagtagtatttctacagactaacaacaaactctccaaaaaagaaatcaagaaaactatcccatttataatagctacaaaagcaataaaatacgcagaaataaatttaaacgaggtaaaagacctgtggattgaaaactctgatacattgataaaagaaattgaagaagacacaagtagagttatcccatgttcaatgattaaaagagtttatattgtttaaaatgtctgtattattccaagcaatctacatattcaatgtaatctgtattaaaatgccaatgtcacttttcatagcaatagaaaaaaaatcctaaaattcatatgcaagcacaaaagatgctgaatagccaaagcaatcttgagccaaaataacacaatcagaggtatcacattctccaatttcaaaatatactacaaagctatagtaatcaaaacagtgtggtactggcataaaaacgtacacaaagaccaatggaatggaatagacagtccaaaaatgaacccatgtatatatgatcaactaatctctgatgagggtgccaagaatagaaaatgtggaaaagataagtctcttcaataaattttgttggggaaaatggatatctacatgcagaagatgaaattagacccttttcacacaccatatgtaaaaatcaactcaaaatggattaaagatgtaaatcaagcaatacctgaaactgtaaaactgctagaagaaaacatagaggaaaatctccatgacataagtctgggcaatgattttttggatatgatctcaaaagaaaaggcaacaaaagtgaaaatagacaaatgggattacattatgctaaaaagtttcttcacagccaaggaaataattaacagagtgaagagacaacctatggaatggaagaaaatattgtaaaccatatatctgataaggagttaataccaaaaatgtatgtgaaactcctcaatagaaaaaaacccaaataacccaattaaaaaaataggcaaaatatctgaataaacatttctccaaagaagtcatgcacactggccaacatgtatatgaaaaactgttcaacttcactaaccattaaggaaatgtaaattaaaactgcaatgagctatatcaccttatacctgttacaatggctattatcaaaaggaccaaagataagtattggagaggatgtggaggaaagggaactcttgtacactcctggtgggaatggaaattagtacagccatatggaaaataatatagaggtttttcagaaaattttgaaaataccactacaatatgatcttgtaatctcacttctggatatatgtccaaatggtatgaaattagtatgtcaaagagattgcctgcattcccatgttcctcacagcattattcacaatagccaaaatatggaatcaaactaaatgtttgtcaacatatgaatggctaaagaaaatatggcatatacacacaataaaataccatttggtcttaaataagaaggaaatcctgtcatttgagatgacatggatccacctgagggacattagtaagtgaaataagacaggctttaccacatgatctaacttacatgtgaaatctaaaaaggttgaaatcatagaagcaaagagtggaacagtggttaacatgggctgtgggatggggtggagttggggaaataatggtcaaaggatacaacattgcagctggataagatgaacatgttcaagagatctattgtacaacccggtgagtggagttaatagaactgtattcctgaaaattgcttagaaagtattttgtgttcttaccacaaaaaaatgttaactatgtgaagtaatgcatgttaattatctggattcagcctttccacaatgtatacatattttaaaacatcatgtggtacatgataaataaacacaattttatttgtcatttaaaaaattacttaaggtttagaaagtagaaattagaatagttacctctttaaagatatttgcacaattaaaaagatttttcatgtttcttttttgaaaagtaacatatatacaatctagtactaaaccttaacagatagttattattttaagacgacagaaatgtgaacattttacttctgatgaagagaatctataagagagaaagatggtgatgctaaacaaatgagaaattataattattaaaatacaacaaggtatctgggatagaagcaagacaggtggaaagattcactcatgctttgccctgccaggagggaatattccagtataatgggcagaaaggaagaaaacatggaatgaatgcagtatgattaaaagtctggtgataggataaggatgcatctctagtctagtggcttcaattttctcagcaaagtaggaggacaattctgatagtaaggaaggaatggcaggattttaggtttgagagggtgaagcgggtgaaagcactgcagagacactgagggagataactaggaattacagaagaattgccaaagagcattgaagtctcaaaactcatcttaagttggataagtacacaattttaggagcagtgataggtaaatggcagaaagtatatacaagtattaagtaacttcaggctcaattccatccaccgaaatgttgggacttacagaaaagcagattcaatatggaagacgtggctcatatctgtcataggaataacagaagaagtagtagtaaacgtttattgagtacttactgaatcttctgtttaaatgttttacataaattttagtacacggccagtaaatagtgttattattttcagtgttctaatgagaaaaccacagcacaaagaagttgagtaattttcccaaggtcaaccagctacaaagtgcagagttttaaacagtgaatccaatgcatgtccagagaaaagtgagcaggacagcaaaggatctctgcaatataaggaagaattagataattgaggatattttgcctaaataagacaggcagcagcaaataacgattgcttcaatacttaagtagttgctatatggaaaaggaattagagttttacattatgtttcttcagggagcaaaactaaaactaatatgcagaagctgcaatgaagtagatttcatctggaaagaatgatttttgtagccatgagaaatacaggtgaagtagaaggagcagcttcagaaagtgaagttccagtgaccaaggagtttgagcccagaaagggatgttaggaaggactttatacataggtgagagaggacttgctagtttatgtaaagttcaacacccattctaacactgaaagtctgcctctagtgtgcattttattaaccccaataaacatttacttttttattttctccccagagtaagcatgttggcagatacatgaagcacttggatccatgtcatgacaatatttggatataacagataagacataatgctttgccaggactgctagacctgggctttcaattgcttccagggctataataaattcagatgttgggggaagagagaggaaaggagagagtgctttttgttgttgttttttgtttttgtttttgttttttgcaatgtagccccttcccaagagtaagaaaaaatattcttctgacaattgtaaagctgtttcctgccaaaattgtcattgttaaaacttttaaaagataatccatatgtccccacacttcatactcttgcactttcatgcaaagagctcaaataagaaaatttgaagtttttctctgagtagaggtcagtgtttctgatgcagtgccagttttaatgagaagattttattttctctctctcttaagagaatggcacgaggaagctacatgttaagaagttaagatggtctctacttggacctgatgctaaaagaaggttcatgccatattttatttgacattgtaatcttgatttggctgcccaatttattgaaaagattaatattctctacaggttttagatagcaaattttaagttttgatcctgacttgccttagagagcctttctttataaagcagctctcgttctttaatcttatagcaaccttactgtgttcttgctcctgttcttcaatgtggtattgtttgtttacctgtttgtgtagaatgttaggatgccacagttaaaaacaacacacatcccaattcattatgatccataggcatcacatgctgccactaatatgtacggtaaagcttacaccatccaatctgaagcaaatgacaaattcctgactctttatttcaggcacttctctccttgatttgtcttcttcaacagctgtcatctttgcaatttctcccaaatcagaccctatattactgagcaatgtacttgcacactttcatctttgtaaactactgcatgtctgctgctttataatttttattttattaattgagaatagatttccacccatttttcaataacatgcagcaatcttagtcactaaatattgtttaaaataaattctgcaattttcttacctgaaaatcagatagttttactttttgcttcaaattattacaaagctaccgtatgggaaggcagtcgtgcaattaaaccctggttattaagaattttgagagggaaatcgaacatggaaatatcacagctgaaatatttacacttaagtccttgtactttttttgctgattgttggaagcaaacccaatcagcaattttggcagtgagtagctatagtgtaaaacaaagatggagatgtggatacttatcatggagatgtgtgtccctttcaatttggtctgtctgatgaacagggagagaaacattgctactttattgttttggttgttattgttttcacaactttcacctaactctagtactctagtaacttgtctgggagacctgggcttgagtctgatttccatcacttgtcaatgactagaaaattctctctctctctttctctctctctctctctccccctccctctctctctctgcattcatttcttcatttgaaaatgaagagctagattggatactctctaaaatcctttccagctctaaaatcttgtttttatgagacactatttctggaatgagcaattaagaaataaataaataaaaatttaagtgatgtgataatcaagattatgtaactaaaaagatatgagagaataaattaccttttaaaattcctgaacaactcagtgggggaattattctgcctcagtgaaaatataagagaggaggtcaatgttctgtgttatcacataattttgacaaagccaatgagtgaggctaccgttaagtgccagcattggagagtttgcatgcaaacacaaaagaagtaaaaagcggaaaaaagaagaggtgtgacaaatggaaggtagcctgatcatctgcctgcagcctggccttctctctcttttctaaaatattttttggagacagggtctcactctgttgcccaggttggagtgcagtggcctgatctcagttgactgcaacctgtgcctcacgggttcaagcgatcctcacacctcagccacctgagtagctgggactacaggcacccacgaccacacctggctaagttttgtaattttagtagagacagggttttgtcatgttgaccaggctggtctcaaactcctcaagggatccccccgcttcagcttcccaaaatgttgggattacaggtgtgagccaccatacccagcagtttttttcttctcagtcatattcattcatttattcactcattcaacatgtattcactgaatgaatatttattaaatgcttatgatatacctgaaactcttctaagaactgggactatatcattgaacaagaaaattttccataccttatgaactttacgttttagttagggagacaaaaaataattaagaaaacacacacacacacacacacacacacacacacacacatacgtgtagttcaatttaacttcagatatacaatgctcaaataaaaaatgaagcactataataagatagaaactgactaggtatttagatggagagagaaggtctctctgaggaggtaactttgagtagagacctgtataagtgaggaagagaaccatacaaagatttttagaaggagctaaagttttatttagaaggagctcagttttgtaactgagatctttgcttctattatattttctaacaggttgttgtgagaaaagacttagaaagacctattgtgtacttacaaggaatatttaaatgccgaaagtggagctgctatggtctgaatgcttgtttttttacaaatattcatatgtttaaatcctaacctccaaggtgatggtattaggagatgggacctttgggaggtggatggttaatgagagcagagccctcatgaatgggattagtggctttaagaaagaggtcccaagggagcatgtttatctcttctgccatgtgaggacacagttagaaagtattatctatgaaccagaaagtgggccctcaccagacatcaaatctgcccgagctttgatcttagacttcccaacctccagaactgtaagaaataaacttccgctgtttataagctacccactttatggtattgttttatagcagcccaaatagactaagaccctaggagatttaatgaaaataaagtacttctaggatctaggagtcaaaatatcattatgacaatattgacaatattcctgggttttttttctttttcatagtgacagggtctcactaagttgctcaggatggtctcaaactcctggtcttaaaagatccttctgccttagtctcccaaattgccggtattacaagcatgagccactgtgcccagcctattcctcattctaagagagaatagggaattaacctatgcacatgggttccaagatcttacctgcccatttgctcatacaactggtgactgctcattgactaaaagaatggagaaaggggctttgctctatttctacttgtgtacctcaagatgccagtgtggttcttctgtgagatcactaaaatattagttgatagtcttttaactcactggtttttgatccatgaggcagataagatagcctaatttgtgatatgcctccaacctcttaacttgtgataactctaaggttaggtgggacatccatatttctttagggacaaccttcatactgctgtagttcttagagttgtgctagagagacaaagttatgggattgagccttgcaaaaatcagtgaccaacttgtcatctcataaatatgtggttggttacaaaaggtccctgataagaaagtatgaatgcatacaaaatttatcataaattccttcaacatagaaggtatgctttttgcccaggaattttaacttgttatttcttctccctagaatgatttctcctcagctgataatatgtatcacttctttaattcttttcaggtttttgctcaaactcagagaagtcttccttcacttccctatttaaaattgatctctactctcattatcccatatccccatttcctgctttattttctctccaaagcacttatcaccatctaatatatttattccttatttattgacttttgcctattgaaatgtgagctccatgggatcagggatttctgtatcttttattcaatattttcccaaggcctatggcaactaatattggttaagtgaattaatgagttcttagtgtgtttttgttagagtttggtatattaagtgctcagtacagtgcctcgtacatagtaaatactgaataaattatagctataattattattcataaaccaactgaaatatatattttttgatactaaacaattagatcagtcatgttagaccattcatatcactattttcattctgccaattttagaatctaatattatattagtccattttcatactgctgataaaaacatgtctgagactgggaagaaaaagaagtttaattggatttatagttccacatggctgggaggcctcagaatcatggcgggaggcaaaaggcacttcttaaatggtggtggcaagagacaaacccctgataaacccatcggttcttgtgagactgattcgctatcacgagaatagcatgggaaagaccgccccctatgattcaaatccctcccacaacacgtggggattctgggagatacaattcaagctgagattttggtgaggacacagccaacccatatcaaatgtcattttctttttaaacctcttaaaacatttatattagttaaaaataatttcataaggcagaagaagtaagtcttgaggtataaagcattgatctctactctcatatcccctcttggtctccagggttttaagtgcaccaaaacaaaacaaaacaaaaacaaaataaaaaaccaacaactatgtacaatgtacaccttggccactattgctggaaggctaacttttattagcctgaaggttgttgatgcaggctttatcaccgaagagattaatgtaaaattgctgagagtctgccaacagggtaaatgttcccagagagatggcaaaagcagcaaggtaagagatttaagtgcctcaacatttcttattaatttttagtgaaaatgttaaacagtcgaatcaacgtatggtggaattacaattcagctcacagttagtttgtaaaaatttcatgcagcttcaaaaagtctggttcaaaaactggtgcactgctcaccatccatacacattataaaattaaaaagttctggatgccgcaagtgacctctacatttgcagttgttaaatccaagaactttagaaactagaaaacatatgcttaaaaacgaattgttgtttatctaaaattcaaatctaacagagtcttctctattttatctggcaagtctaattcatggggaaaatacattctactaaaattctgctgctaaattaacttttcttaaaacaatggagacattggtatccttaacaacattaatcaattaattaagacatacattcttgcaatgacaaaacatatacaatttgcttactggtctctctgaattcataatcactaactttaagagggcgtttagcatacacctgcaatcctactacattttgctggaacttccctactgtcctagatgaccatctcctaacttttcttcacctcttaaatatgcaacaaccctaccattttcttttgtttttgcaggtacactttcttcccctttcattaacaaatagaagcaactggaagagctcttctacttactttctcaacatctattcactctctcagtctatgcccatggccttccttcctctgtcctttctgtctcagtcctaaggccaatccttcctcttaagcaccagatcccatctccttttgcctcttaggggtatttctactacaattgttgtctgcttccctccttcaagatcctcaactttatcttctctaatagattatttccatcagcattcaatcatgtagcaatattttcatctgagagagagagagagaaggaggggaggagggaaaaaacagggaaaggaaaggaaggagaaaaatgcctcctttggtctcatatctaccttcaagtataatttcatttatttgtttcctccttcacataaatcctgcttaaaatgtttacctacttactactttcaattcattctatggtctttcctcccttgaacccactccagtcaagattttgacccttcttcactgaaattgcttctgtctaatttaccactgacctccaggagctgaatccaatggcacattcttcgtcctcaccttaattgctgtatgagtttcctagagctattataataaagtaccagtcttatcttactataatctattctctacacaacagccagaatgatctgttaaaaggtcagatcatgttacttctccatctaaaacctctaatgattcccccttttttcagaataattaacaatgtccttacaatggcctaaaagctggcccctccccagtcatgaccatcaactcccaaaccaatgcaccgttccccttatgtccctttcacatacctcagaatttactcttcccactctttgggaccatcgtcctccaaatttgtccaggatattttcatgactttctcacttagtttcttacttctatgcaaaaatgtccacttaaaaaggtttttgccttttacaaaaaaaaaaaaaaaaatcctcaccagtaacccaattatgcctttcccactttgcttttcacctaggcttaagaccacctgacacattacaaatgaataaaagcaattattttgtatctctccagtttgctgcctttctctcccactctactggaaactaacttctaagaagactgagatttttatctcttgttttctattgctagtgttgaaagaatcactgaatcaatcagaacataactctaaaaagttaatcagagttcagttctgtacaccaagttaaagtcttgtaaccagtgaatacctagagcaaaattaagaaaagattgtcctttagaatgcagaaacttctgcatacttataaaatcttataaaattgttacactgtgaattaaacatagttttctcctttttaaattagcattagtctccaaagaattttttctagttggacaaagactgctattacttatattttctctcctttgtcaccttaaagagtaaaattttttgccagttattcttttgtttcccttaatataagattagaacctctgtagccatttcaacatacaaattcagcctatatctctcctgccaaatgtcttctgtactaattttatattttatattaattttttatcatatacaaaaggttaatcttttatacaaaagattaatctttattctgtgtcctgctgaatacttatcagaagtttaatctcccccagacacttttatataaatatttatagggttgacattgaataataaaatgaaagctcctgatactcttgccctgtcacatctcaaatagtttttttaaaaagtgtcaatcagatttatagcactaactaagtcacataattgagcacagcttgaagaccctaaatttaccaaccataaaaggaataattttaggaaacgtttggagctctgtatgtaagttactggcagagaccttcatgaatattggtcccatctccatgcagagaagagaagatcttggcctctgatctagttgtggggttggatgaagctagcctagtagttgtgagccttgtcaggccctttgggaaatgacagatacaggctcattatctttggtgccatgactacgacaagcctgaaatctagaaacatgactattaactgactggaatcatctaggtatgttccgtctctcctactcttcctggtagggagcagaacatagcattcagcccagaagctgatgttgctaggaagaaaaatcccatgggaaaaaaatctctctcactgatatttctcactgggaaatgctcattgaaataatgcctttcaggatcctttgataatattattcaattttgtccttacgacaatattataaagctttgctcatccaccctggctgaatatgagtcagctgaaaaaattaaaaaaaaaaaaaaaaaaaaacagagatccagaccttcctacaaactggataggacccagacatctctgttttgtaaagactctcccagtgatttaatacaaatacacagagcggataaaaaattatgtaaaaaagattggctgggccaatgtagttactctgtataacaagtaagaaaacaggtcagacaggttaagtgacttacccaaggtcacactgccaacacaaggtcttctcttgccatcatatcatggtgccctctcccagcttccccaatttctactatttcatataaattttctgccttttcagttaatgaagcttacttcagctcatttcagctcagaggagaaaaacatgaacaaaattggactaaaatgggtgtaagaattggttcatggaggataaaaagcattggatttctgccagacccttcaggatgtgaatcagtcaaagaaatcaagtcaacacataataataacaacaaaagcaacaactcttttggtattttacatagtaaagccctttgcatgctgtaatttcaataatgattcctgcaaatgcaaaagtcacacaattttatctctgtctttgtattcttttttatttcagacattctttgtataggcttagatttaaacaacataaatatctgagaatctttacccaatcatgagtctgaaaaagtcaattgatggattcttataaacattgtctaacttccccgacccatctgtttcaatgccagcataggccagtaaggccacatttgtccattgaggatttaaaggcctgatgttctaaaagtctgaaagatcctcagctgtggagagatgacagtgtcagaaattcctgactagcaatacttttatatgatcataacttctttttaatcataaaacacctcttttgttttataaattttttcccttcacctttctaaactattctcagagattacactttccaaaaaatgatatttttgtcacatattacaactcaagggccaaaacagctggtttatgacttataagtactttgtgaattgcttgagctggtggggaaggttagacaataggaacgaagttttcctactataaatcattgagtcacagaatcttagctttctagaactagaaaagataaacacaatctaatataagtccaacacattgcaggcgagaaaacaggcccctggatgttggtaaccagttggggccaaacagggaattctggacagagcagacagtagaagccaagttcgtttgccttgactcccatgtattttcctaagccagactgtctactttggagtatgagatcctctgagcacatctaactctgtcttctccttcaagattcaattcatttgctgcctggtattacggaatttcaggaatgaaagagatgctaaaatcatcctgtccattcagggtttgacttttttctaccatggtccccaccacagggtcaagtactttagtaacaaaactcctaatgaagcagcctgttccatctttggatactttggattaaataacttataatatttagctaaaatgttttcctaaagcaactgttaaaaaattgatcacttttgtcatataagagtctcttatatacttgaacataggtataataaggacaccttttttgcattttccccagaataaccattgcttgcctttaaaatttcttcatgttgtgccatcctaattgctctcctttatatgccattaggttttgaaatatgtcttaaaatgtggtattcagaattaaacacattattgtaaggactgctaagaacagaatttttctttcttctttctagaatattctctattaaataaagcccataaatgctcaacaggagtgatatcacccccaagaggctgaaaactggttcttggggaaaaaaaacttacttttttaatgtataaagcacatataatgtacataaagtacattaacagatatgttatgtacttaaatatctgtggtattcaaatttcattggggaagtgatcagaaaaaaacatttttagggactccttaaagggataatagttttttttaaaaaaaggctgtgaaacagtgatatagcctaagatcacactagcacattagctattttatcagagaatcatactattaacccctattgagtttatagtcaagcacaatccttaaaactatctatctaacctacttgtacaactgttgaaaggtattttcactaccgcgaggtttccagtgtgtttggttggttagatgattggtttgtttttgaagagtagtaattttttttttgcctaattttgttactataagagcacaaagttaaatttatttctgataaaattgcccttgttaggttttatctattcccgcctgtccagatattttggaatgtaatacattcattattttctgaagctctgattatttgcaaattttatctcctatcatcttgattgctcatgccagtaatttgcagaaacaacgttaagagaacagagctgagaatattgtcccgcacacaacttttccattttgtgttaaagtatcagcagtatgttttgactaacatttcttcatcgaggtattaatgttactaactgtacatttccttacataaaatccatagttttctatttttttttatttgtacactctgagaaagaatgtcaagtgtctcacagaaatccagattgcctggctctagtatactttctaacagcctagtaagccaagtgaataaagaagcaagatttagtcttttgtttttctttaataattctgtgctggctcactctcattacttcttcaatttatctatacttaagaggttctttttagtagtctgtacagacatctcttcccagcacagcttaaatattctattgactgcatttctccctataacagtatttgtcagttacatctagttggctcttgctctgtttgttttcatgggcatatgccttaacttttcaaaaaagattataaactcccagggttgaagcatatactcttatagtgcccacagctgcccattaaagtatcacagaagatgataaaaataaattgtttgatttactaataacaaactactcactatcaaatcagattgatgaaaggatcatgaatcattcactcacaccctagcccaggtttacagattgttttaaatgcttgcttctaataagggtgtattaaaagagttaaatgctttcttctaataagggtatattaaaagagtttctttccaacactcaatttactaatttatcactaagaaatagcgtttttgctaagtaataaggaaattaagaactgatgatggaaaaggaaactatataggggaatataatgggaaacataaaagggaaatatgtctgcaaaaagtaggattacaaggtcatgtttctttagaatgaggagcctgtttccattttcacaaattaaaatcatttgaaagcacatatacttatcaggatgggttcctaaaacttttttctcaactctcatatgtgtgtgtgtgtgtgtgtgtgtgtgtgtgtgtgtgatacacatccacatatatacatacatacacatatatattcaaagatatataatcttatatataaaatatattggccgggtgcggtggttcatgtctataatcccagcactttgggaggccgaggtgggcggatcacttgaggccagaagtttgagaccagcctggccaacatggcaaaacccgtctctactaataacacaaaaattaaccgggtgtggtggtgcacgtctgtaatcccagctatttgggaggctgaggcatgagaatcacttaaacctgggcggtggaggttgcagtgagctgagatggcaccactgcactccagcctgggcgacagagtcagaccctgtctcaaaaataaataaataataaaatatctcacatatatattctatatatatatatctcattgtgcaaagttcccaaattagacattttgactacattaaaaacacaatgactacttggataaaaactggattaccaaattatctaaatgagccatttgtgtgctatttgatggtggtatatttttatatcttggatattatccatatactgaatatatatgttccaatattctaaatctctaatataattcaattacttgaaataacatattaaataatctgagagagggcggagaacgaattaagcctcaattatttttacaatatgctgtatgcttggtgttaacacaggtgttcattcattattctcaaggcctttttgtatagctaaaatatttcatattataataagttgtgtgtcatagcagatcatgttaaaagaaatctaaagttgcccgagcgtggtggctcacgtttgtaatcccagaactttgggaggccgaggctgatggatcacttgaggtcaggagttcgagaccatcctggccaacatggtgaaaccccatctctactaaaaatacaaaattagccaggcatggtggcatgtgcctgtagtcccagctactctggaggctgaggcacgagaatcacttgaaccgggaggcagaggttgcagtgagccgagatcacaccactgtactccagcctgggtgacagagcgagacttttgtcaaaaaaaaagaaaaaaagaaaaagaaatctaaagttaaaaaataatctaaagtttccattttgccattcaactgccatgtttacccacagctcctcttttctggtagctgttttcagttaaggaaagggaacactgggtggaggatgggacaggaacactcctttcacagagggctctgcatatagcagtccccttgagcatgaattttccaagctttgataaaatctattgaggaggtaaagagaggattcatctttaaaatattgtcaatgtatagttaattaaatagagtttattctgctgcaatcttacagccctgagaggtacagaatgctgaggttcataaatgctgtcagcaacacagtgaggcagtgagggtgaggagaggaaggggggataaaaacaattgcatgaaaaatagaataaattttgagatgtcttctaaatcaaagctcatccaatatggagaattgaaaaaaaattaaacaaggaacatttgagattcatggtatagaaatctccctttccctaaacattctttaaggtcttctttcaattatttctgacagttatggcaacatattatgagagtaatatgtccactatgggggggatacgcattagttcactattgttgccataacaaattaccacaaacccaacagcctaccacaacataaatgtatttgttctcagttctataggtcagaaatctggctgggttcagctgattcctggggtctaaaaggtccaaatcaagttgctggccagcctgggctcttatttgaaggtctgagcaaagaaagtacttccacgccaaggtcagtggctgaattcaattccatgctaccatagaactgacatctcaatttccttggggctcttctccagggatggttcttaacttccagagatcaatcactttccttggctcagcgtccccttcctccatcttaaaggcagcaacaataggctgtgtccttctcacattttaaatccttctaacctccccttctacctcttctcttctaggctcccctcaccgactgatttttctgttctccgattctgcccttaaagggttcatgtgattacattgatctcacctggataatctaggctaatctcctttttctttaaacgtcaatgattagtaatattagtttcatattcaaaattccttcaaaacattacctaggttagcatttgattataaccaggaatgggaatcttgcagagacatctgaattctgtctaccacagggtgtgcccaccagattcaaacagacctgccaaccagaaattggcagtttgatttatatttctcagtctatgaaacataacatttctctaaatgaagcattcttaaatagtatttgattactcaagtggataacttcatggctaatgataaagcttttctattagaagtttccattaagaatgcttttgtttgagttgttttgtgttttaaaacaggacttggatttcttgggagaagctgtttaaacaaaggagagaggatattatttgattacaattagagatgtctttttgtaggaagcaattatcagtataaattaagaaccaaactgcaaattcaattattcctaagtatttactagagaaacattagtttaactgtaattcttctggaaattaaccccataaaatatgttataagagcattaattgcatttttatagttaaaatatgacgcaataacaatattacaaaagctatttgatccatattaattttgtacaattgctgaaaaccatctattgaaatcatttttttaatatttgaattggagtgcattaggttactcctttgaagatttatgcattacccaagaaagagaaaaccaatttttaaaaataccaattaaatgaagatactcagttaaattaaaaaataattctaatgctccaaattcttgctgtgaatttgcttattgtggaatcagaacatatttgaaagaatgaaaatggccgattttaaagtacttttgaattttctgttacttttcttgttaaaccctaaatagttataataattgtaatgaaaatgtttttagttactgacctccacatgagtggcaacatgagtttcacacagttacatatattcagctgataaaccaggtagtaaaaggaaatgattaagatcacaggactctgaagtcagactacctagatttcagtcccatttgtcactttatctgaatggcttgaggcaaattattcagcctctctatgcctcagcttccttctgtaaaacggggataagagtagtacacattactcccagggttgctgtgaggataaaataggataatacatacaagtaaatacatgtaaagtcatgtaaatgtttcatagttggtatggactaaataaatgctggttattattcttgaagtgatgtccaatgttaggccctagactgacaaactgagacctcaactcttcaaacctgtcagcattaggatatagaggcaaacagccttggcctcagtagaactgacctgtagtcaagtcagctgatcaacagagagaatggaggaaggggctgaagagtccctacagaactccagcaattagctctgtactcctactggctagctatgttttcaccgctacaaagatgctatcgatatatccctcatcctggccattcaccttggtcattcattttttatcaaaaaaaaaatagtgagtacctaacaaagttataggctctgtgtgaagaagatataaagagctgaattttaaaattataagattttctgctcttacggagttcacagtcttgcaaacaaacactagcaaccccaagccatccttccttttgactcactgatttaaattgaacaagaaagccactttcctattgaaagtaataaaaattagggaaaaaagatgaaaatggtatcatgagatgtcgaagttgaggtgctatcaatgctttgggggttatgtatcaaaatttccttaagacttttttacgacattgtcactcacagttttattaaaacagacactcaaaggaaagctatggaaaaataacacagtgtctctggttcctacaaggtatttggttatggtgggagaggagacgtaaattacctctttacttccacatacccacagagaccctccatcacatctgcttttctccacccacccgagcaacacccactatcttaataccaagtgctgtataatcaactgagttaaactattttcaatttaagctcaagaaagtttagaagagctccttaaggagtagcagtttagatccaaaaagctcttaagattgatcagccttctttcatgcagtctatattctgagggtctcagaattttaggcttagaagaaaattttaatatataataaaattattttattcttctaaatatttgaataattttctcaaagccatatggatgttagttgcaaatccagatctgggccttaaattccatttctatttcaacttctttccacatcagcatgtattataattgaatataatgggcatttactactgccaaggatagattctaaagtactgattcaatctattgctaatgaggcattaaatgtccacagctgataacaaatagcatgaaaaatatttgaaaacagaatttatcaccatttagcaccactttagtcagattgcataccacctttgtttatgtattccatcatgcttatctctttgttaaagatttttgttcgttaaatcaccatatagacatattacatacattaatgaaattataaacttgactttgaagttgatgtagctaaaaaatattgggaaaagagtaaaagattcattaagtgttgctaaattgtaagtggttctatgttatgtttccaaacaaaagaaatcgtctacattacaacattgtaaaagtaatgaccacaaataaaataacactttaatacaccaggcttgctccaatactgaaatttttcttttagtttaagatacaaaactcctagacacttgtttattaagaatatctttactggtggaaaatgatatatttaagcttccaatttatgaataattaaattcctatgattagatataccaaatacagccacatcgtcaaaggatatactacataatcttaaaggcaatgaagattagatatgggccttattatattcatcatttcaaagaaacatcaaaagacatctgaataaaataaacaggagtttttatttttatttttatttttgcttgtatcaagaactttctgagcacactgtctggcaaatttagagtgtcagattagaagttcaatggcaatttgattcttgtctttgtaaacatttttacattctaccaggaagtgtataggtttttctttttattattgaaatttagaaatctcacaataatatctagatgtgagccttctttcattatcactatactaactcagcacttgttaattttttttttggtctgaagcctcaagtctttagctcaagagagtatcttctcctgtgactattgtttctcctcaatcaattccatctattcttataagatttatgtattgggtgttagtgccaagattctctaatatttgctgagattttctaacttcttcttttaaaatctgacatatgggataactccttgggtttgcttctgatttttattgatagctgttgtgctcttttcttgtcctagtaagggtttttatttgcttttgggtttttttgttgttgttcttttattatttcttcaaaacaatggtcatcttcttttcagtttctaagtccttggtattcagtgtatagtgtaattaaggttatgggcactgaatgtaggtctttctagagccttgggttagcactttcctagctattttaccttgggcaaggtatattaactatgcctcagttttctcaccacatagagataatgtgcaataatcttcagtaatattaccctattgctcctttgcatagcagtgtgtttgctcttttacagagtgaagaaaaaaaaaacctcccaaatatcaatgaggacatcaattagaattctaaatcattatcttttgtctacctgtaatatctatatttcatttgttctaattcccagctttatccctattctctccaatgatgggtaatactttattatctgttcatatgtatgcgttcagcgttagattgcccatcctagtggttgatacgggctccctctgcttaggccacctttgatgtcatgaaattgctgtgttcagggcataaagaggaacagaaaggttgatttattcccaggtgcatatgctggaaatgaacctgatacatctgtttcaaagagaaaaagcaaagttaaagtgggtaggaaaagctccaactgcatttagaatgccgatgacaccaagtggaagaagcaccagggcaaatatttcagctatcttctctctgcagagctctaataaatcctagagggcctcttgtgtgattctctctgacattcccactctttcaaatgggggttaaacaacgctacagcttcccaagcataagattcccacagttttctgctggaaagactgtctacttgcctctcagggcttccttacctggtttatattgagcaaaacaaaagccattgtcagctccttgattaaacccgatccatctgctgctgcttttttttttctttttaaataaattactgaaagagtatgcttgcttgatgttacccttcctattttctagtattactacatacctttttgctcattttgtgcttctttagtcattttcatggggttaagatatgaagggaagaaaaaaaatgagttggtttaacttcccatcctaaagctggaaattatattttggatcttgaaaataaccaaaatattcattatttttatggcagttgagttagtcgaggaacagattctatgtaatgtcatgttaagttgcttatttagctaaaatgatgcaaagtaaatagctgtcaacatgattaaaattacttgcaatctgaatttaattaaattgagaactatgttattttcctactttctccaacctctggccacttaattagtaagatttacttttagttcatctcaaaatttctgtgcttatggtcaagagtggttatgtgaacaactcaaaagagacatccagcctgaatcatttttattggcacagataccattatgtgactgtttgggttactatttgccttcttaattatattatcttcagcctaatacatgaaaataagatttcaatccctgtggctatgacagaatatttgggagatactatctggagaaagcaaaggctatgccacccagaaatttgaatctggaaacacagaagttgcaacctgactatataaaatcaaaaggaccaaagagaggtgcaaggtctcagagctattgtttacataaaaccagtcatgtctaaatcattggaagaaagcttttgtacaacggaggatttattttctgttaacataaataatgggaatttctacatgttagagttaaaacctttaaaacacacacacacacacacacaactgcaatttatcttattccttccaggttgtgaaatggactgggggaaaaagaaaacggtgacagagaaagaggttagactggcttgttctgtgtaggcaggctgtcaaaatggctgctgggataggaaaaggtattcaactttatgcagtgaaggaagctgtacagactcctcctgagcgtctgtgaggtcaaatgctatgcaccccaatctacttcctgaaattaatagccaggtgttatgctagttactgtaccttaatcattaattatgactgtggcagcaagagagaaaaaaattctaggatacatgagctagagtgataaagggaaagcatcaatcacgcatgacaggaaagccaaaggtaccctctctctgcctgggatactttcatttgtgactgcagattttctcctacatcagacttcaaacttcagagaaaccatttctcatagcctgcctctctctctttctccctctcacaaccagctatggtcctaggactcaggaggatgaaaacaaaataaaacacatttgttagtaatgccatattttccatgtactaccaccaggatctatttgaaattaaaggtaatttatacaaataaaatattcagtcaagagatgatttattcaaaaaagcaagctacagcaagaatggagtttagagtcaatagttaataaacattctggcagcacaggctggcccacatgccttcatttttctacaatgtcataaatgtgttgcatgtcatcttaaacaagtgggcagagcaggtgaatctccctcaaagtctcatggcacagtctagtatgttacaaatcttgataagcagaaacccaagccacattctggtggtactgagtggtcagaaatggggtatttggaagtaggaagaaatacattaatttagttgaatggaaggaaactaagttgggttctactttactatggtattgtggatagattacttgacttctctagcattggtttcctgtttgtaaatgactggtttgagccagatcaggaacccttattctggggtgacataggagcttcagaggatctggcaggaaactcaaattataggagaaattgttcagcatattatttaagtgttactaaaaaaacatacacactaaaggagtgcttctctaactatctgtagtgaagaattagcactttgtaatttccaatctgctatgaaccacctccttttaaaaatcatacaaaaatgaaataaaaaataattttatacaaaatagaagcccactttttttttaatcagactcaatagatataaaaatactccttcaagttgctataaagatgatatggtatggctgtgttcccacccaaatctcatcttgaattgtagcacccataattcccacatgtcatgggaaggacccaatgggaggtaattgaatcatgtgggcggagctttcccatgctgttttcatgatagtgaataagtctcatgagatttgatggttttataaaggggagttcccctacacaagctctcttacctgctgccatgtaagatgtgcttttgcttctcatttcccttctgccatgattataagcctccccagccatgtggaacctctttcctttataaggtccattaaacttctttcctttataaattacccggtctctggtatgtctttattagcagtgtgagaatagactaatacaaaagattttaaaatcttcctatcaacttgggtcattgtaatggactgaccagaactggaccataggtcaaactttgagtaacaactattctaaggttccttccagctataatcttaaaactttctatgtaaaaaacagatatccctatgtccattctgcctcaactcctcctgccaaaaccatacaatctcacttgccattgcattcagcactataaacggaactcaatctaaaggtccatcttccttgaaatgcaatgaaagattgtaaataataatgacaatgacaacaaaatatgctttcccttgtcactggtgattatttatgttccctgaacaacaaggataaaaatgagggaaagcctgtaggactacttaccactagaacctaggccatctgctccctgacctagtagttccctcatctatgcttttgtgctctcataattatcctgactcagaaagcctttactagcctttcccctattccctacctgcagtcttttcaagatccttactgcatttattgggtactcaaagcttatctattaagcacttacaaatagaagaggataaaattataattatttggtccctgtcacatacacacacacatgcacacatgcatacacatatatacatatatggcccctgcccttaagttgtctagagcaattcaatgtttataagtatgttatatgaagaatcacaacagggaatgcagaaggggcaatgacaaaagtcaaagttagacaggaagggtcacataagacttcttagaagaacacttttggggctatttcttgagtcatgactatctggtgatctggctgtaatattaaagaggcttagtcagctcactgaactattacttgcagttcttcccttcctttattgctacatatttggtctagaagtacattctttccaaagagtcgactcctctttcatcaagagtgttctaattaactaaggggggaaaaacatgtgtatgagagtgtgtgtgtgtgtgcacgcaagtgtgtcagttttatgtgtttggtgggagaaaggcaaagaatctgggagagcagcgcatgtaaagtaatgtttaaaggctggagaaggagggaccaccaggtcatgaagcttcttgtatatttccctaaggattctggattcatcctgagcacactggtgactcattaaaaggttttaagtaagggtgtaatatggtcaatgttttgtttttaaaagatcactctagcagcatgatgtaggatatctaggtggtgagcagggtggatctggtagtgccaaggtgttcatctaataattcaaatgagaaatcatgaaatcctagactaagtcagtagcagacaggaatgcgaagccatttcaatctgagacagatttgaagcacaccaagaaggcagaattactggctatgaatcatggacaaatgaatgaatgaatgatgaatgattttgaggatactagcttcagcaattgggagattggtgatttcattccctgaaagagaaaaacactcgtgtaaatacaagatgagagtgtaacaaacaagaattcagatttaaataagttaaattcaaggtgtctgcagaatgtttatatggagaagtctgttgggaggtagaaacaggagtctgtagttagaagttgggtctggactagagaaaataagttgatcaacagtaactgaaggcttgagatgggtgtgattacttcagcatgccttgcctgaggaacttcattccactccaatagatttgattttaccccagaagtattcttcatttttatcacctgtatgttttccttaataggcattgtataaaaatatactcttttttactaaataaaaacataagtgggaaaaataagctaaagggccaatgaggtacagcaatgaagataaagttggactgtgacttacacacaacatgcaaactacttgataccatttactgatctctggatcacactctgacactacactttcaagcaacaatgcaaagggtgacgaaatcgcaagttacatatttaatactcatacaataaaagtaaaccaatttctccaaaacagaattatttatgttactgtgagctgagaaaaatttctcctgaaggtcctcataagaagagcattcaccatattaatggtgagcagtatcttttttttgacacggattctctgtcaccaggctggagtgcagtagcttgatctcggctcactgcaacctccacctcccgggttcaagcgattgtcctgccttagcctagcctcctgagtagctgggactacaagcacatgccaccatgcccgactaatgtttttttttgtttgttttttgtttttttgtttgtttgtttgttttactagagatggggtttcactgtgttagccaggatggtctcaatctcctgacctcgtgatcctcctgcctcagcctcccaaggtgctgggattacagacatcagccaccacacctggccagtgagccttattcttaatcacatccccatagtgaataaaaaataatacttacacaattattatatccatcaatgtaaggtgatagtataataacaaagaagagtagaggaaaggcaattcaaaggaagaagaatggcaaaattctgtcatttatgtggacagcccatgtggattggtatgtatgaatgaacagcaacatttccttcaggtattcatctataatacttgggatatgggatgtattttatctcccaaactagactggtatgtccacatctgcctttccactatttaatgtccacaactttcttcaagatgcattcatttgttccttcaatagtcaataattttctgaactaaagtcatgaaggactgagtcttaaaggatacttaggaatgattcagacaagatgggagacagggtaggaatagaaacacttccaaacagatggatacgtagcatgaacaaagctaccaaggtaagaatgagcttggtatgcaaagaaatataagcaatttagcatggcaacaatgataataataaggcagagagaatgatgagagaggaagctaaaaaggtagacaggagagcattgaaggaattttttcttatctctactcttggcaaatacaactcttggggactgagatcatatgtagccttaaatgttgcataagctgtgtatatggcacagaggtgatctccagtgtctacataaactttgtggaatttcactgatgaaacagtttgtgccatggctggagaaaagcatttggatgcatatttattgactgatgtatcggatgtgatgtgatgtttgaaatatgtcataagagtgctttctagaagaattacccatttgttcattatgtaagagagaaattgtttctggtcctctagaataggactttggggagtgactgcatattaccctgactcattctgccatcaatgtgctggagtcaccattcaacaactgcttcaactcacttggtcctaagtttggcagctcaaaattccaacaacctcacagaatatacctggggatccaaactggaaacagctcattagattcaaaataggagggtatattttagaaaataaaatctagcatacctttactggctcttaaaaaatcagattggaataggtggtctgaaaatgaatttatccagcaaaccatattaaaaaacaaaacaaaacaatatcggagtcctggcctaaataaagtggttggttactacctccctcttcaatcaccttaggctcttgtagcaaaaggacttttaccatattagctgctacaagatttaataaggatatgatgtactatatccttcattttgctaggcaacgcaacattctaaataagattgaatgtttgtcaatatttggaagaggaacctcaggggtttctttaaaaatttcctcttttcctattcctctaagactgattttaacctaaaactgattttttcttttcatgtatacaagatacctttttgggggtttgtgtttatttcccctgaagaaggctttacagagcttggattttaatggaaatttattgctggatgtttgatagccaaaaggattgtgttttgatcacagtcaaaatggcaattttctccacagtagcatagcagcatactagtacaaggccactgcagctagaaacctgtgggcgtgtcaggtcctttgtagtgagtgtcagtagcacctgcaagagcccaatccctaactgtgctggaaggaggtttgatcctattaagtttcaaataatatgtcagcttttcagctttgatacaaattcctccagaattatctattttcccacttgtgatataagacttcgtgaaatgtgtaaaatctaagagggtctgcctcattttctgtgttgggagagctttggaatgacctcggactctgtcaagactagtatttcttgagctttccccaaaccaattaatcttttcatctgggggttatacaatgcacaataataagaattaaaggtaaaaattaaaagaaaataaagaaatcttgttgtataagaattaatgcaacacaaacatagaggccatctcctcaaaactgacctggatggctacagattaaaatatggatggaaggaccactgagaaaaaagacagacatagagagcaagaattaatctaatactacatgtttggtacacaaacaacaaatcaaattgagcaaattattttctcaggagattctctcaatcactgtattttattatctgtgaattccagtaaaatcctcattttctaggtggaggctttcttttttttttttatttctgttttctttcttttttctttttcaggttttattttagattcagggggtacatgtacaggtttgttatatgggtatatttcatggtgaagccctttcaataacaaaaggaagaggtaaataattatacaaacaaaacaaagaaaagcaacattaaagaatacatttaaatgtgagtcaaaagacctaaattgagggccaacaagcatttgctctgtcacttcacttttctgtgcctcagttttcttttctggaaaatggaggtcatgaaaatactcatacctgccctcctcatttcacaggttgtggagcaaatgcaatgagtgtggctcaatcattgccagatcttaacgttgtacataaatgttagtgactgaggacaattatttaacccctatgagctttcatatatccacccgtcaaataaagcttggatactggcctgcctatccccaaaatgatcttataaaaatcaagtaaggtgataccagtgtgtgctttgaagtagtaggtgctatcaagtattagactgtcaaatatattcaaacaactgtgtgtgggaaaagattgtggtggactagaaatagccaaactttagaagtattctatagtctttgggaataaagctgggatgtatgaaaaaccttcttatgatattaaaatgttcacctttgaggaagaaagtagactagcagaaagtttcactatcaaaattctagaacattaactactgatactattacaagttgttaggaaacagtaaattaaactttgtaatgctctcccaaaggaagtagaaatacaccatcattacttatagtttaaattggactgggaacagtgggccagcatgtattatggagaagcaatgcttcagtagtagcaaagtgaaccaaatgacactgcagatcttatccatatttaatgtttgacaggcaaaaatacttacattaatgcagtaatgtgctatgcaagtcatcaacatgggaatgctcaaagctttaatactgtttaataagcatcacactatgagagcatattttccctttcaagtacgactcattcaagtttgagggaactgctaaattgtcacacttggcaaaatcttgaatgacagccaatctaaacaaaagcaatcattttgtattttgggctggtttgaagaaagatgggaagtgtgaggtaggcagggggatgtaggataccccaaaaggccacaataatcagacaaaacccccagcaaaattgcaaaggtaggatagacaagaaaaggcatcaatgctttgcgattgaacctacacaatgacctgatgtatacaaaaaagatgggattttggtcaatggtaaagtttatttcaggggctggaggtgtgagacatggctcctaaaagtaggtgtgtcaatgactaattatctaatttacaataagttgacctctctgtaattctgtcccactttttcaatttctaaaccagcagttctcagttggggaggggaaggaggataaattttgtcagggatattggggttatctggcttgtcaccacaggggaagtgtggtgctactggcatctagaaagtggagtccaaggatactgctacatatcctataatgcacagggtagccctccacaatagagaattatctagctgagattcaataataccaagcttgagaatacacgtgctaaactaaaatcatctgagaagtatattatggggtaaaatgggacctaatcattcttagcataaaagcaattttctaaaaatcagtattttattaatattactgttattgcttaagcttcttttctactgagtttccttttaattataaagcacttggcagaaaaataagattcatttctataataggcttagtgctttctttttcagcagtctttttcttcaattaattaacatttaactgctttcttataatgaaggccaaaaaaacaagctgtctccttaaacttctcaggagaagtgataaaactctgtgagtatattaaatttttctgataaagtatttgtaggacatagatttaggaggtctttctctcttaggaatgttacttataaacatttcttggaagtccaagataaaattaaaaacacgtgcatgattctagaggctacatatgctattgatgctgaaaatagaatgttggcaccggagaagtccttactatatatgtggatgaagatgaactcctatttattagtaattatgtaggaataaacgtgatgattctaaaaaaattatcttattgtctttgttggcatttattttaaaaataagtgaaaaaaaactataaccaatatgcaattcatagatcttctatcatggctaatagttcaaattttgcaagctattggtttgaattattgcatttgctacatataaaaatggaaggtttctaaaagaaaatgaataatagaaaatattcagatgaaaaccaaagcaagctataaggcattcttagaagaactatatatatatacacgtatatatatatatacacatatatatatacgtgtatatatatatacgtatatatatgtgtatatatatacgtatatatgtgtgtatatatacgtatatatgtgtgtatatatacgtatatataagtatatatatgtgtgtatatatatgtgtgtgtgtatgtgtgtatatatatatatatatatatatatatttttttttttttttttttttttttttttttttttttttgagatggagtctcgctctttcgcccaggctggagtgcagtggcgctatctcggttcactgtaagctccacctcccgggttctcgccattctcctgcctcagcctcccaagtagctgggactacaggcacccgccaccacgcccggctaactttttgtatttttagtagagacagggtttcaccatgttagccaggatggtctcgatctcctgacctcgtgatccgcccacctcggcctcccaaagtgctgggattacaggcatgagacaccgcaccaggccaagaaccatattttttttaaaaagtttgccactgtaaacaagatatttaaaatgaccatgaacaatttttatgtatctgtaggcttctctctttaccagaattaaagtgtggggtcctggaagaagcagagggctagaagccacgacacttaggtttgtctcctcatcttggcactttctgagatgttaaattattcaacttcactgattcttcattttcttgataataaatagaggggattagatatagagatgcacaaaatccctcccaactctaaattttcatagttttataagactttgagtttaaaatcatttgatctacttatataacactcataatttttgtatctttatttccatatgcacagtttatgttatgacaagaaccaactcaaactagcttacgccaatacaggaattgattggcttgtcttccacacaaattcagtcagcatgcggatcctgctccagggactcaaatggcatcctcagtatttgttttttctatatatctcagctctgcctcatgctatgtttatttaattcttgaggtatatgtagtaattccctattgctccaagaatactcttcagcagcctgggcaacatggcgaaaccccatctctacaaaaaatatgaaaactagctgagcataatgacacacctgtcagcccagctccttgggaggctgaggtaggaggatcaattgagtcttgcaggttgaggctgcagtgagctgtgattgcactactgcacctctgcctgggtgacagagtgagaccctgtctcaaaaaatatatattttttcccattttcaaatttcagcaataaataaataagaagctgtttttcttttcttctctctactgtcctagcaaaagtctgcttctttctagtttgctttgatcaggctataggcctctctttgaaccagtgattgcagacatagaaataggatacacagatttaagtggcatgaatgacatgtcttctcctgggaccagagatgaggtaaatggaaagaatgttcttgaagcaacaggaaaatacaataaatattttgagtattaaaccaatatagtaaaaagcagagctgagagagagaaaccaaataaggacaataccatttgaatccctgaaaaaatacctgtatgaagactgaaatttcatgaagaacaaaccaataaatctctgtgatttgctttagtttgagttgttgttgttttttgtttttttgtcacaacataattagtaccaactgaattaaagataattttttaaattacagagtattatatcctatattaaaatcaataaaaaattttaagctcaaagaacttgatgatatctttgatacaaatgacatactttatacttaataggttcccaataaatatgtattgtttggtacaatgtaatgaatatagaattaaaagaaatatgtatgtaccaaatgagtatgtaccaactaagaagaagggaaaaagggtacattcatttcctatctatataataatatggcaaaaagaatggaaaaatatatacataaatgatgcaagaaggaggcaaaaaaggtgataaatttcaaagtggaaacactcaagatatatatgttgtccttcaccaagaaaattacaaaagaccttgatattgaaggcttcttctttgtcttcttgatgcctcccatttcttctcagcgaatttcattggtacatacccatcctaatatgataagagcattttaagaaatacctgtaaataatattttcccctattctgttagaatataagctccataactttagaaatctttgttttgtttactaatatataccttatactactaagtaaatccctagaataaataaacaagacatagtaaaataattgtaggatgaattacaaacaggtgataaaatgaagaagcctgaggagagggccaagcaggatatgaactgttctgaattctttcttctacctttttttctcaccttaaaaactctggtccttatcacctgtattgattcatatatatatatatatatacacacacacacacatacacacacacacacacataccacttaagtcagatttcaggattcagaacatatggaagatggtgattatcttctagactctatattctaatgaaagataatattttcttttgggaggcatttcatatattccataatttattgaggaaaaaaatgatattgaggtcaattatactatagagtttgtaggataacttacttaattgtgttgaagattttagatttgctgagcttggaagaagaaaggaagagagattgtgtcaaacaccaaatgagaagctgttttgagggtaaaagatcctagaaataaaaaatatatggtagaattaaagtaaaaatatataaaatctaaaagaagattcctacccttgcattttgacttcttccctggtagacaaggctagaaggaaacaggatttacatggcaggagagtataaaagatgactcaagtatttccgtgaagaaaataaaaagatcatgtccactgtgtcataaaatcacatcacccttctgatcaaaagcaatcaagaacttcccttaggttttagaataaaatccaaatgtttcccctgcctatgtcctttattattacccatttgccctcatgattttctagtcacaccagccttcttgcagacctcaaagtcgccatgcttgttttcatcccaccggatttttgcatgggttgttcctctttcctggaatgttctgccaccctcagcccccaacattcccgtaactagtccttctcctcagttaggtcaaagaacgaatgatgtcacttcctcagagtgacatcttctctgacactatctacagtagccaattcaccagttactttctatcagctagactgctttattttcttcacctcagcagaagattttttgttcatttattgtttgactttactaactttattttctaaaattaaagccccataagagcagagaccggccgggcgcggtggctcacgcctgtaatcccagcactttgggaggttgaggcaggtggatcacgaggtcaggagatcgagaccatcctggctaacgtggtgaaacccgtctctactaaaaaatacaaaaaaaaattagccgggcgtggtggcgggcgcctgtaatcccagctactgaggaggctgaggcaggagaatggcgtgaacctgggaggtggagcttgcagtgagccaagattgccccagcctgggccacagagcaagactccatctcaaaaaaaaaaaaaaaaagagcagggaccaaatgcctattttaatacccccaaatacctagaagaatacttgacatacagcagtgaatcaattattattgaaatctcctgtgtgtgtatgtgtgcacgtgtgtgtatccatgaatcaatgaatcaatgaatcaatgaatccattaatcatccaaaattaggagaacttggggcaagcctgagacacttagggcagagggggaatgaaggttagagctgcttctgaaataggcagagtaagcagtggtataaaaattttttttgaaacatactgaattgaagcagaactgagtatcaagactttcaacaaatggcctaggtccttttaatgagtttgttggcctggacagttgtcccataaagctctctccaaaattaggtaatcaaagaaaactattaattcctgagaaattgccttgtattgcctttatttcaaatattttaccatgtcataatcatatttatgcaaatgtggcttaaacaaacttttggaacaatcccaattatttgttaagagtcacttgctattaacatgaacaaaagaaaatttaaagaggtgatattaattatatcatattaaaatattatggtcagttttctagtagcccaagagtccttggagacatttaaatagacaattttgatatctcaaagctctttgacatattaataatattgaatgttgcctcactccttaatgaggagtccaataatcttctaaatcataaataacaagtggattcaataaaataacaagacagtaactgctgatattgaaaagtaatgagaagaccaataaaggagaatgcagtaagactacaagggagagagggggaaaatgagaagaaaataactcagtgcagctgggatttcacagtattcctaatacttgtgatctagtcccacaaacaagatagaaaagacacagagaaggcaaaatgctacagatctgctttctccacacttgttttaatattttgggaaatttctgaaaatagaacaaagaggatagcaatgaaactgcagagaacaaaaggacaaagctgatgagtattaggcccagagaaatttggaaaagggaaattagacacaggagtcttaaagcttaataaagtatccctcaaaaataaagaataagaggtgtgtaactgggagtatgcatgtatatgtgtgtatttgggtatatgttgaatgaaggttcatcaatggtggctctagaaatagatcatgggaaggacttgggtgcagactgaattctaatataattttatttacagatacttaaatttgaattttacattatttttatatgtcacgtcttttaatttttttctttttttattattattatactttaagttttagggtaaatgtgcacaatatgcaggttagttacatatgtatacatgtgccatgctggtgtgctgcacccattaactcgtcatttagcattaggtatatctcctaatgctatccctcccccgtccccccaccccacaacagtccccagagtgtgatgttccccttcctgtgtccacgtgttctcatcgttcaattcccacctatgagtgagaatatgcggtgtttggttttttgttcttgcgatagtttactgagaatgattcccaatttcatccatgtccctacaaaggacatgaactcatcattttttatggctgcatagtattccatggtgtatatgtgccacattttcttaatccagtctatcgttgttggacatttgggttggttccaagtctttgctattgtgagtagtgccgcaataaacatacatgtgcatgtgtctttatagcagcatgatttatagtcctttgggtatgtacccagtaatgggatggctgggtcaaatggtatttctagttccagatccctgaggaattgccacactgacttccacaatggttgaactagtttgcagtcccaccaacagcgtaaaagtgttcctatttctccacatcctctccagccaagatggccgaataggaacagctccggtctacagctcccagagtgatcgatgcagaagacgggtgatttctgcatttccatctgaggtaccaggttcatctcactagggagtgccagacagtggacgcaggacagtgggtgcagtgcaccgtgcatgagctgaagcagggcaaggcattgcctcactcaggaagcgcaaggggtcagggagttccctttcctagtcaaagaaaggggtgacagacggcacctggaaaatcgggtcactcccaccctaatactgcgcttttctgatgggcttaaaaaacggcgcaccaggagattatatcccacacatggcttgcagggtcctacgcccatggagtctcactcattgctggcacagcagactgagatcaaactgcgaggcagcagcgaggctgggggaggggcacccaccattgcccaggcttgcttaggtaaacaaagcatccgggaagctcgaactaggtggagcccaccacagctcaaggaggcctgcctgcctctgtaggctccacctctgggggcagggcacagacaaacaaagagacagcagtaacctctgcagacttaaatgtccctctctgacagctctgaagagagcagtggttatcccagcacgcagctggagatctgagaatgggcagactgcctcctcaagtgggtccctgacccctgacccctgagaagcctaagagggaggcatcccccagtagaggcagactgacacctcacacggctgggtactcctctgagacaaaacttccagaggaacgatcagacagcagcattcgcggttcacaaaaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcgccatcatcaaagaccaaaagtagataaaaccacaaagacagggaaaaataaaaggaagaaaaactggaaactctaaaaagcagagcgcctctcctcctccaaaggaatgcagttcctcaccagcaatggaacaaagctggacagagaatgactttgacgagttgagagaagaaggcttcagatgatcaaactactccgagctacaggaggaaattcaaaccaaaggcaaagaagttgaaaactttgaaaaaaatttagatgaatgtataaccacaagaaccaataaagagaagtgcttaaaggagctgatggagctgaaagccaaggcttgagaactacgtgaagaatgcagaagcctcagagccgatgtgatcaactggaagaaagggtatcagcaatggaagatgaaatgaatgaaatgaagcaagaagggaagtttagagaaaaaagaacaaaaagaaacgaacaaagcctccaagaaatatgggactatgtgaaaagaccaaatctacatctgattggtgtacctgaaagtgacggggagaatggaaccaagttggaaaacactctgcaggatattatccagaagaacttccccaatctagcaaggcaggccaacattcagattcaggaaatacagaggacaccacaaagacactcctcgagaagagcaactccaagacacataattgtcagattcaccaaagttgaaatgaaggaaaaaatgttaagggcagccagagagaaaggtcgggttacccacaaagagaagaccatcagactaacagcagatctcttggcagaaactctacaagccagaagagagtgggggccaatattcaacattcttaaagaaaaggattttcaacccagaatttcatatccagccaaactaagcttcataagtgaaggagaaataaaatactttacagacaagcaaatgctgagagattttgtcaccaccaggcctgccctaaaagagctcctgaaggaagcactaaacgtggaaagcaacaaccggtaccagccactgcaaaagcatgccaaattttaaacaccatcgaggctaggaagaaactgcatcaactaacgagcaaaataaccagctaacatcacaatgataggatcaaattcacacataacactattaactttaaatgtaaatggactagatgctccaattaaaagacacagactggcaaactggataaagtcaagacccatcaatgtgctgtattcaggaaacccatctcacacgcagagacacacataggctcaaaataaaaggatggaggaagatctatcaagcaaatggaaaacaaaaaaaggcaggggttgcaatcctagtctctgataaaacagacttgaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaacgagacttagactcccacacaataataatgagagactttaacaccccactgtcaacattagacagatcaacgagacagaaagttaacaaggatacccaggaattgaactcagttctgcaccaagcggacctaatagacatctacagaactcttcaccccaaatcaacagaatatacattcttttcagcaccacaccacacctattccaaaattgaccacatagttggaagtaaagctttcctcagcaaatataaaagaacataaattataacaaactgtctctcagaccacagtgcaatcaaactagaactcaggattaagaaactcactcaaaaccactcaactacatggaaactgaacaacctgctcctgaatgactactgggtacataacaaaatgaagacagaaataaagatgttctttgaaaccaacgagaacaaagacacaacataccagaatctctgggacacattcaaagcagtgtgtagagggaaatttatagcactaaatgcccacaagagaaagcaggaaacatccaaaattgacaccctaacaccacaattaaaagaactaggaaagcaagagcaaacacattcaaaagctagcagaaggcaagaaataactaaaatcagagcagaactgaaggaaatagagacacaaagtacccttcaaaaaattaatgaatccaggagctggttttttgagaggatcaacaaaattgatagaccgctagcaagactaataaagaagaaaagagagaagaatcaaatagacacaataaaaaatgataaaggggatatcaccaccaatcccacagaaatacaaactaccatcagagaatactacaaacacctctatgcaaataaactagaaaatctagaagaaatggataaattcctcgacacatacaccctcccaagacgaaaccaagaagaagttgaatctctgaatacaccaataacaggctctgaaattgtggcaataatcaataacttaccaaccaaaaagagtccaggaccagacggattcacagccgaattctaccagaggtacaaggaggaactggtatcattccttctgaaactattccaatcaatagaaaaagagggaatcctccctaactcattttaatttttttctaacttttaaaaatatgtaaaaataattcatagattgcaggatatacgaaaacaggtagattaggtgctcgcaggccataatttgcctctgccatcaaacaatagcataccataatctacatctgtgaattccaagggatcacaaacagaaaagcacaatggcagctgagaacaatagtggaagaatacatttttattactgttattacttattccacttatacaaatggaaaatgccatttttaaatttggtatttcctcttgtgcctcctcagaaattatactaaatttctttcagaattcatttattattaatgtgcccagattgtttcagtataagatttcttcattaaggtgatttcattttgaacagaggcaaagaaatacatttggctatttactaactataaaatatacaactgctgaaagctcgatggcacctaaaggaattgaccactttgttatcccaaaatgttctgacacttcaatgtcattgaaataatgccagagatatttcaagggatttcttttccttttcaaagatgcacattaaatagattgctatgtaaagctgatacatcatttagtcctccccaaaagggaaatgcaggtacaggcatgtttgcctcctgactcccagacaccatggctgggaaataaaacaagcaaggctgggaatctttggagtcaggcaaatctgggctctgctcaataggaagtatttgtttctttgggcaacatggagccttagttttctctccactgaaacttggaccttagctccctcacttctaaaatggaaatagaaatttctacttcccagggaaaatgagaggtttaaacttaaatgaaatgagaaagtatatgtaatattcacattgctagcacaatgtgtagaatctattattatcctcgaataccctctgtgatacacatagaaatagacacagcttctcccagcagcctagtagttggttgaaaattgttctatattcacaataaaagtcattcccagaagttgttgcaaggaaagaagtgatcctgttacaggtttgttgagacaggaagatacaagaagacaaaaataaaaatatttctttaatattgttattgggccatctgaccttagaagctagattcctgcttaaaaattcatgactaatttttagcatgaaacagcagaagtttccaattctcaagagacccactgcattgaaaatcctggggtctttttgtatggtccaaaactaatggagacaacttagcccatctaaaaattgggtgaaagagacgtaaggggggggggcaataaaaatgtatttttctaactagttttcaggtatccatattccaaaatagaacagcatctttgccagaagttcaagtcattaaggagttggtatggcattctcacttacataaagtatgggcacctctgaacaatgacctgaggattactaacaggtatgcaacatatttgaaatgtcaggtacagcaaagcaaatgactttatcaaaatataaatcacacttttagcagaaaaaccaatagttatatgaatttaacttcatctttaagtgcaaagagtaatattttgtgaattttctaaccgttttttagatgtcatcagtgtttcagaaactggtttctttcattttaaaataaagagatgctatttacttcatcattttccagccttcctgataggcgtatactcacatgaggagatacaaaactgaaaacattatctcattatagactatccacgatttaaaccttcaagctggcaatatgtatttaaataatatgtcataaacacctcttggtacataataatgtagtaaatatgagaatgcctttaaagtgaactaacttattctcccaactgttagattattccctgctatgatcccatcaccaagtgaaattttaggcatattcctctaggcaaagtaaatagttatgaggaaaaaaatattgctaattccagttgaaataagaaagcctcttaatcatctaaaatatttctggggcagatgcagtggctcatgcctgtaatcccaacactttgggaggcccaggcaggaggatcatttgaggtcaggagttcaagatcagcctgggcaataaagtgaaactctgtctctattaaaaaaaaaaattaaagaattatccaagcatggtggtgtgcgcctgtagtcccagctactcaggaggctgaggcaagaggatcacatgatcccaggaggttgaggcggcagtgagctctaatcatgccacagagtgagatactgtctctgaagaaagaaagaaatacataaataaaataaaataaaatgttctctatgggccagatttctctctgcttaggtcaattaaactacaaatttctcagtaatttttgaacgctctatctcccaagatgcctaggtggaattgttaggaagcaactgcccatccacaaaatatacctggagaatctcagatttcattcactgcttttaaaaaaggaaacaagaaaatcttcctcttagaagaaatttaatcttttaccacttttattacttttattatagaaatatatatgtatatatacatatgtgtatttatgtgtgtatatatatcagatatatctatatatatatagatatatagatatctatcagaaagcaaaacttaccttccttagacaaatggagatttggggaaattgtattggagtctagaagaataaatcctaggaaaagcaaacacacggtatacacacgcacacatacaaacctccaataaactttgggaaaaaaatttatatacacaaacactgatacacaaaatatatggattatatatgtatgtatatgtgtgtatatatattaaaatataggtttattcaccaatcactgaaaaactacatcataaactacaccaaaggagtagttttaggacaaatggcaaaaaatagtaccttacagagttgacagtttggaattgcaatacttcagatgatcacaagctttaaaaatgctcaatgtgctcgtctatgaatttcaaaatgggtataaattaaaacttattacactttttttaagttgcattcccagtacatgaaaaaacattgtcctaagactacctctttgaagcaattttcaaggattcgtgaatgagtatcgtgagcaataaactaaagctgcataagagagatatagtgtataaactgtgctagcatattatctttggttccaatcgcctcataagcattgctacactgactcaggccaatggtggtctcaaaacaatgttttcatctccctgaaccatttattcttttagaacataactcattgttgggtttcaggtgactattctgactgccattccaaggaaacaggccttctgaacaagaaaaaaatctgaaaacggaatatttcctttcagagatgtatggaaacaagctctgcctttttacccatgccataatgggtcttgctgagagtttgcttcaagaaccagaactcagtaaatgtaaacattcccttaaacagatgcacatatgttcttaatataaaatcttccagatgtaagtttcatgcaagaaagcaaagtgacctagcaagaattgagctttccatatctggtgaagcatttttcttagtgtgtgccacaagcagttattctgagaaatcatgcatctgctcctcttcacatggacattccacttctgatgagactacattcttggaaaatgtaggcaggagctgaattcaatcttacaatgtgtgtgcgcttattccttccatctatcacttacccaaaatacctgcaggtggtatcagaaatgagctttaaagggcctgtggcactgattacaaaaaaatgttaagtggtatttcatatggttgtggagtgggcagactcctgcttaagattcataatcctcatcagtaacacaagtgtatcacactcacaagataatattgaagtaatagaagaaatcgtccagaaatgcaaaaaatagttcacgtaagatgcaaaatcttatgacaaaatgaaatcctgaactaataaatagctctgtactgatatcaggccctaaagcctatattactgagagataaaacgtgggggacagcaacttagagatagggctattacattaaatctatgattacattagctaaaaagaaaaagcacaagagatgaaacaaaacatccaagaaactcatcaagatttatgcttcaagcaatgtcctaatatctgagaatatcaagatatgaggacactaacaaaagtattattattctaccggatcatttaaaaaattccttttgttctgaaatcaaataaaaagtaacaagactggcctgagtagcagaatatacatttcatactttatatttgtgtatgtctatatatatgtacctttacacatacacacagatacacataaacaatcacatctgtatttcatatctgtatttcaaccttctccattcactggaacagacatttaggttgattccatatcttgtatattgtggctaaggttgcaatgaatgtaggagtgcagatatattttcaaggtgctgatttcatttcctctggatatatacccagaaaagggattgttggatcatatggtagttctatttttaattttttgaggaagctccatacattttttcataactgtaccaatttccattatcagcaacattgtaccagggttcccttttcttcacactctcgccaacacttgttatctcttggtgtttttctttttttctttttttttaaataacagccatcttaataggtgtgaggtgatatctcattttggtttgatttgcatttctctcattagtgacattgagcaccttttcatatacccgttggctatttttatgtcttgtttagaaaaatgtctattcaagtactttggtcattttttttataaatacatacacatatgcacatgtgcacatatacatgggtatgcacatacatatgcatattttaataactatgagtactcaatgatatttaccttttttttttttgagatggagttttgctcttgttgcccaggctggagtgcaaagtcatgatctcagctcacaacctttgcctcctaggttcaagcgattctcctgcctcagccccccgagtagctgggattacaggcttgtgccaccaccctggctaattttgtatttttagtagagatggggtttctccatgttggtcaggctggtctcgaactcccgacctcaggtgatctgcctgccttggcctcccaaagtgctgggattacaggtgtgagccaccacagctggcccactttggtcattttttttaaatcaagttacttggtttttttttgttttgttttttgctattgtgtgagtttcttatttattttagagattattaactccttgtcagatagtttgcaaacattttttccaacctatagtttgtctttttattctgatgattgttttgttatacaaaagctttttatagtcccacttgtttaattttgctttcagtgcctgtgcttttggtgtgatgttcaaaatatcattatgaaggacaatatcaagaagtttttcccttgttttcttccagtagttttagagtttcaactcttatggttaggtatttaattcattttgacttaatttttatatatggtgtagataagggtccagtttcactctttgcctgtggatatccagttttcgcaacaccagttattgaagatactaccctctctccatcgtgtcttcttggtagccttgctgaaaattggttgactttataaacttgggtttatttctgggctttttattctgttccattggtccatgcatctgtttttatgccagtaacatagtgtttggttactattactttgtagtataacttgacattagggaatgtcatacctccaactttatttttctttctcaagattgttttggctattcatggtctttgtaattccacattaattttagaatttttccatttttgtgaaaaatgctatttaagtatgtccatcattctaaattaattataagagtgaagttatgccctaaattgttcattttgtaagatgtgccttgcagttttgcaccttgcaaaatgagcattaaaaattaggaacagtattttgctaatttgttcctgtgatctagaatacataattttattctatagcaggagctgtatattctcacatcggaagaaagtaatataatctgcttatatagcacatggtgtagccaataaatagcattttacatttcgtcccttttttcctttctctctcatactttcctactatttttaacagctttattgagttaaaattgacataaaataaacatcccacatttcaagtgagtgtacaatttgataaatttttggtaggaggttattgattgaattttttatattaataaccagttgttccagcaccatttgttgaaatgattatcctttgcccactgaattgcctttgaactttggttgagtatcagttgtctacatccatgtagatctttatggactctagtcatttctattgatctatttttctgagtttcctttaacactacactatcttgataaccatagttttataatgagttttgaaatcaggcagtcttagtccccaaattttgccttttatcaaagttgttttgactattctaggtcctttgcatataagtttcagaaacagtttttcaattactagccaaatgaatgttgggattttgatctggactccattaaatctacagatcaattgaggagaagagaagaccactttaacactgttacagtttcaacactgtacagtttaacatcataatctgcatttatttaggtcttccttaatttctcttggcactgttttatacattttgtgtacaagtcttgttaattttttatagacatatttcatattattgatattattgtaaaaggttttactatttcaactaatttcaattactcttaatgatacatgtaaatactactgatgtttgtatacggatcttatatcctgaaaccttgcaaagctaagttttgagttctagtaagtagtagaggttgaataaccctatccaatacacttggaatcagaagtgtttctgattttgttttttaattttggaatgtttgcatatacataatgagatatcttggagatgggacccacgtctaaatacaaaattcatttatgttttatatgcaccttatacccatagactgaaggcaacattatataatattttaataattttgttaatgaaaaaattgtatattttaaatcatcagaaggcaagtgtcaacatctcggccacccatatgagccatctgtggttgtttggcatcacaatcattcttgattttgaacttataagctactgataagcaacaattttcttaacttatttacccataagtacttatctgtaaaaaatatggcatgccatttacacagtaaaaaaaaaacaaatgtgtccagggtaactaagcagcacagcagcatcaccagaattcccgtaacagctgttgaacatcagcaacaaccaacaatggcaggctttcagtctccacctatgatgctgtgttttgattaataggttactgtgtgctgatttttttttaggtgagagaaaaaaaaaatcaaaacagttgaaggaccaggaagtgagtcctctagggatgaagaggcattttgtggatggcttttaaaaatgtttccttcagagtcatcttgcctcattaacaatggtttttgtcttagaagtctccctttgggattacaggcatgagcatgggtggatcacctgaggtcaggagttcgagactagcctgaccaacatggtgaaaccccatctctactaaaaatacaaaaaattagccgggcatggtggtgggtgcctgtaatcccagctactcaggaggctgaggcaggagaatcacttgaacttggaaggtggtggttgcagtgagccgagatcatgccaccggcactctagcctgggcaacaagagtgaaactccacctcaaaaaaaaaaaaaaaaaaaagaataagtagtagtagtagtagtagtagtagtagtagccatcgtcgtcgtcgttgtcgtcgtctctctttggctttataaactgacatgatttcttgtgctgttataaatgtacagtgctgtagtccttcaataagcccgtcacacatttttaccttatccataggaactttttcttcagtgttaacaatgtcattttaatcatcactattatcacaatcaacttgattcaaaaccatctggactatttccccattggtcaatgaagaattggaatctcattattgatgttaaaaataatcaagttctttgatatttacttctgctagcctagggaaagactctgaaattatattttttgtgtatgtaaggaggtcagacaccatctttttttctcagttggcccacagaattcttcaaagtcactaccttgttcatcaagatcacttaatatagtcacaggcaagaggttgtgccaggagtgtactactgtgtctttagtcactgcgttccaagtgttagcaatggcataaacagcacccttcatgctaaactccttctagaaaccttccacacccacacctctcttcactggtgctggcatgatgttcaagaaagtgtttttatatttactcttcatcaatctaaggataccttggtcacatgactgaattaatgaagtcacatttggggaaaagtatatggcataagcattatttttgatgaaaatttcagctgaaggatgagcagaaatgttgtcaaggaataacaaaaatctaacagttgtcatccaatccagcttccttgcagtaaccttgagcctctggtataaatgtttgtgaaaccaatcagaaaatatgtccgtggtgatccatacctttttgttaacataatagtggactgctgagaaattcactccttgaaaacagtgaggatgcaagcttttgcttttcagaacaagtttatacttttgtatgcctgctgcattagcacatgccagcacagttattgtccttggaatccttaatttttgtaggggctacctcattagcttttgtcagtgtctttctggggcaacagtaccaaaacagtgatgtttcattagcattatagactagttctggcatcagattttcatcagcaatgactctggcaaatttgtcaatgaatttttccactactacatgaccagaagatgctttatcactacaaatctttaaaaatgtaatatcatagtttttcttaattttctgcagccagcctgttgagtactcatggttcccttcaatattcatttcctcattatagatctttgcttgtctcccgattcgtattccattaagtgacaagtgttcactgcaatggtaatggatccactatttaaatacacaatcaatatttttattgttagctgtatacggtgtttttctatttttcattgacttctattcatcactttcagtataaaacttcaacagtttatccttctgtttcttcaggtcatatatggtagtcaacactatactcttccatagaacatttcaacttccgccactgtccagtttcttcttcttcaacagtttgactttctgtgctgtagagaaacataaatgcttctttttcttatcactgttacccaatactgatatcacagagggaactgcaggagtttttaatatttttaataatctttacaccatagagcagataataagaaaataaaaacacagtaatgcatgtaggtcttggccccatgtgacacattattggaaacctgccattggtgtgtttggcctgcatacatgccattttattaccctttatgagtgtgcctgcatagtgggggtggaggaatctgggtacttaagaaagatatatttcatagctgaaggggtctgggagggtcttcttccccttagggatgctgaataaactgtgtgctcagagcctgttttttgactacaccagtcacatgaagtcatgtatagaattttccacttgtggtattatgtaggtgttccaaaaagcatcttggattttcacattagcaatgctcaacctgtactagtagattccatcatattttctacataaatgatctcatgtcatctgtaaagctttacttcttcctttccaatctggatgtcatttgttcattcattcattcattcatttattgctttccttagtgcactggctatagcatctggtataatgctgaacagaagtggtaagagtgaatatccttgtcttattcttgatcttaaagtatccagtctttctgctctaatgatgtttgcattttatagacccctcttatcaagttgaagaagtttctttccattcccagtttttactttagttgaatttggtcatatttttgtctgttgggataatcatatggttttcttttttaatttgttactatggtaaccttacattgatttgttttaatgttaactaacctagtattcttaggataaatcgtatttcattaggatatgttaagcttttagatacattgaattagatttgcccacatcttaaaaataaatttttgtatctatattcatatcgatccatatatttactaattttttataatgtctttggttttagcatcaggatagtgttagcctcagagaacgagttgggaagtagtttctctgctcaattttttgaaaaataattgtatatacttggtaataggtactatttcttacttaaatgtttggtagaattcatcagtgaagccatctgggcttcaaattttctttgtgggaagatataaatgttagctggattaaattgataatgatgccgtttaagtcatctacatccttaactaatattttggtttgaatgttctatcaattattgagattgaggtgttgacatctctaaatataattgtgtgtttgtttaatactccatctttttttggaagcataatatcccttccttaacaaattatcttcttttattctatttgcacttttactttttattatgttcttttttgatccttttaagaatactggttgtactaaatgctacccatggttacactgatttttgtcttaggctttattcatttctagcccaactatatcttcctacctcttgtttgaaacagaaatattcatttttctccataaagcaggcatcccttctaatcctaagcaacacaattctcctagacacaagtattttcaagccagtcatctttgacatcactttatagaaaatacatcttctcagttaaatctttactcaagtagtgtattatcctccctctgctatcagtccctgactgtacttcatgttatgacattttaaattattgtggtaaacctcttcagcctctagaacagtatttcatacatcatcagtgtgcagtagaaacaagaacatccccaggtttactactgcctacaaaaaacaatggaaattcttcagtctatccaaataaaccagttgtcctcccttggcatcactctgtctccttccatccttcatccattcattcttccttttcttctttccttccattcaacaaatatttatactcgctcttaaatgcagctttcattcaattaatctactcattgttgtcaaaagatagcttatctttttttttttttaattggaccatatggccccactactcttcctatgcaagtcttgcaaggcccacttttagcccatcttctgaatgaacattttctgtctccaaagacagcaatttctctcatttctgagcatattattgactgtgtacataaacacaccaaacagcagtggattaaaaaaacacacagaagccattactgcctcaatcagttaaataagaatggttaaaaataatctgttgtttaaactgatggaaacaggaaggagaatgtcagcttgctttttaggctattgtcttcctgataacactggtagaaagataatcctttaccctaaaaattaatactgaattatgaggaataaatgcatacatagttcttcctgccatgcagtccatatgaaaagggggagggggtcacaacagcttaaataaaagagaagtttcagtttgtctgtaaatgtctacaccataaggaaaaaaatatttgaagccacagtaatgagagagtgtttcggtagaataaagtgtgaaatttgtaggaaggagaaccaagactgaaaatacaaaaacattattaggaaagagacattgcaaaacactataatgtgtacagttaacagaattagcagagaatataagagacacacaagaagattatgaaagatatcaatactagaaagacagaagagaatgtttaaaatagtaagaatactaatgtgtccaatttaagcatttaatgatgtttaaataaaaaataagccaccctttaaaaattccttctttattttagagttccaagataaaaatattgggaaggtatttttcaatcagtaaaacaaacttcagttagaaaaatttactattagataatcttattaatatctataaaagctgcattcatattgatttagcctacacccactttgtgcacaatgtatagagaaagaacagcttataaaattaatatctaggcaacgatggccacagtgcattttaggtatggccacttttacagtcttttgtaataattacattttaattttttttttgtcttagcaactggatcgtaaaatctttgagggcagggctccctcttacactctgtgtatcatatatagtatctagcaaggtagaaattaaataagatttcctgaattattccctggctgctcatcttaattgtaggaatccataaatgtctttcctattgattctaacatgttgggagtgccaagtatccttaagattacatccttggactagagatttaatagaaacacttcatttaatattaatagaaaagaaactaactcagagtaccaatttcttgggtggaaatacatggataataagtgacaaggtggtagaaaagcaagctacctatttcaaaaccatatttcatgtgtcagctggtgttaactaaccaggcaactactatggatgtaaacaataactacagacaacactttccaagtcttcatatcgtatctccttagaaaaaagctattatcaagcagttttgaaatccacttaaaccttttcaaaatgtattatagatttacttaggacaaagtgttctggtgcattcagtcataattggtaggaaatatcaatcaattgtttcatttgtcataatgttaaagtcactcaatctagggtcttagctgatttctcttttctgaagaactataaaacgtacaaataaactttatagaaatgggaaaatcccaagcatgtattaaaaataattcttgccactaactataaaacacatcaactctggcaagagcctttcctggggagcatagtgtacaaggtctagatgtgactatcatacagagcttttttggcttgccaatgctgccaaaaaaaaaaaaacaccactgactggatgtagcttaaacaacataaatttattttctcctagttctagcggctaaaagtccaaaatcaaggtgttggcaggtctagtttcttctgagacctcttgtctttgcttgcgggtggcggccttcttgctctgtcttcgcatggcctttcctctgaactaacacacattcctggaatttctgtgtgcccaaatattctcttcttacaaggacactagtcatgttaggtaaagtcccatcctagaagtctcattttgtctcaattaccccttgtaggaccctatctccaaatgcactctcattccaaggaaggtgctaggagttagggcttcaacatatgaatgaggaggaggaaggaagagatacaattcagcccataacaagaggccagagagctgtcatgaaatttcaggaaagatatagctctctcaaataatatttttactgagtatcactgaatttagagccaaaagagacctcaaagttgatcatgtctcaccacctaggcaatgctgaaatccctcgtaaggttgtaaggtttcactgactagtctcagcctctgcttccttatccagggaattcaccactaccatggaaatagatgccatttatagagagttaatcattgtgtggtgggataataattttgaaatatcaaccgttttttcttttccatttttctatcttgtattttctcttttcatcaactccagtgagcttttattctatacttatcacctcaccaagtgatatacactagaagcttttagtgtgaaaacgtctaggccccgtaaagaccaggaaggatctggcatttgcactctccaaggcctgaattcctctagaccaaattcataaacacagcagcagaaccttatacacaaccttatataaacttgagaaaacctaaaatatagggaaataagatttcagggtagaatggcttgctctgtgtctgtttcagggctctgtgtctccttagatggacctaaaacagtccacggaatttcctgtgcttggatgtggcacaggaaaatgaatcccatcttccaaaaggggccttgacatagctgagataggacttgtagataggaacaagtattgattcagtagcaacttgcatgggtgaatgactagaaaggataatgagtctcagcaaatgtcagatgaaatggaagcataaaggtcgtcatcccttggcaatatggaaagccccataaattagagagctgccaaatggctaaggtttagtttttgccattctgtctcaaaacagaaattatttcgagaaaaaacctctattttttgaatacttgggtttatgactaccattaaacaaaaatatttattccttattacttcttcactcacttatattgattacaaaagtatgaattatattaaaagttggtgttgtttattacaaacaagaattgaaatgagatcaactagtatatttgttcttatacgtaggtgacacacggtcatttcaatgcccactctttaagaccccttgggcttgtaaaacatgaagtacatattaagaggtgtgaatatgtacaataccaacaaacatggctgattatgagcctcccaaacattctttaaccaaatcagaaccctaatgtgtaaatttcgctgttgtagtaagaaatatacaattatgatatttgaaatgctattagaaattaagaaagaaactaataacactatacgttgcttttgaccctaataaaatactcataaaaataaattggatgtgtcaatgtgtccatcctttgagatcaaggccaattgtagcgacatagaatgttgaaactgaaagggttcttagaagccatctggcaaacactctcataaacagatgtgagaattgagatccagaaacatgaaaagatgtgtttagggcaacagcagtcactggcaaatccagtgtggaagatggtgtcttcacacattccacttctttttctgcaggcatctcaaggtcacagcagaatcatttcttcaaggtttccttactcttctataagggcaatcacatggttgatgcttatttaaaatatttaaaactatttataatcatgaatgaaatttaaaagagtcaagacactagctaacccaaaagttgggcttttcccttttgagaaaatatttttctaactgatagaacatttggtttctcaacttttatctatcattaatgatatgctccactgctagaatgatggaatggcctagattgtttagagtacacgaaattatctttaatgaagataatttcattatctttgtgataatgaagaattagcctatctttgtgataatgaagaaataaagatttcttcacaatgataagcttagttgaatttagaaaaattaatatgtggctcctaaagcattcataattatatataaatctctttaataatttttttcctaaagttatctctgtgataatatatattctagacatatattcaaatatatttaagatatattaaaagtagtaattttaaatacagtttgaggaaagaattaaactctgagatatttataattcaacattgaaacaaatcttaaaactttgtcatgcgcttgttacaattacagttttgtaattctgtttgcatcaggtatgttgcaaataataccacctctttattcatttagcactttctatctataaaacatcttttaaatatactactaatttcatccatgccttgctgtagaatctttaaaaatgtgttagcagtttatgcagttttttcttctagttatagatcaaaagattcagagttagccacctgaggtaggcagtgtggaaacctactctcaaatacatttttggtgagtgaacataatcctattttctaccaattgacacaaatctcaaactgatttgttagaacatgtattctgcaatagtcaagcaatacaggacctggaatacacaattagtctcttcaagaaactttttcagcctttcaccgtgaacaagaaacaaaaaaaaaaaaaaaaaagtaagaaacttcagcaagataaagaacataaactcatcatgacctttagcttcagaaatttcagaaattttaattgaaacattaaaaaacagctatatatcatgaaatatatgaatttaagtacttgaactctctaataatgtatcttcctaggtgtccctcattcatatgtcccattattcagtctgcttttgtcttccttgtgcttctctgtgttgcttctttacccattcaacaacataagttaggataacttggtgggcttttcttttttctttttttgttttcttgagacagagtctcactctgtcatccaggctggagtgcaatggcgtgatcttggctcactgcaaacttcacctcccgggttcaagtgattctcctgtctcagcctcctgagtagctgggattataggcgtgtgccaccacacttggctaattttttgtaaattttagtagagacagggtttcaccatgtctggtctcgaaatcctggtctcaccaggatggtctcgaactcctgaccttggtgatctgctcgtctcggcctctcaaagtgctgggattacagaagtgagccactatacccaaaccttactttcaaaagttcttacctttcttgtgtttttactatttagaatatttggctgaagtttttactctttctttttgccttccccaagcctaggccccagccatcttttctgactgctcccatttttgctaggcaaaacctagcaagaacctcctttacaccaaaaacaaattttcctaatgctctcttgtcaaggtccaacagtggtagagctgaaacagagccaatggagttgtttatatcatccagcttcgtatttattagccacatatgtgctgcaaatcttagaaagggaaggatggtgctaagttctctgcagatgctcaaatgctaaataataaacatgtgatacaagctgagattcacaataaagacagggaatatccaaaaatatgtacttcaaaattatatcagttatttcccctaggcagtttagaatacaggattttaaaattcttgatgagtaaagagggaggaattaaatgataggcaaacatgtagcctgcatattgagtaagaatttattgtcccaaagagctgttatcccaaatcagctggttctgatatttcgatattattcaagaaggtagttagtcaccattttaggaatggtttaactttagctgaaactgattagcagttttttctgaatataaaatatggagaagttattaataaatgtcaaatcagtctctctcttaatcgctctcactctctctccctctctctctctctctcacacacacagcaagagacatttgaatataccatcaactttcattggcttactaacgctatggcacagcagagtgtgtttctttcctttggagctctatagtagcataagaaaaccttgctgaaaattgagcaacactttttcatgctgaatgattttgttttacatttcctctgatacaaatagaaaagacgtctcacattcagctacctatgctagactacaccacaaataagctcatacctttataatgtgtctacatgacagtaacaactgtggtgagcatagaattattcatatgcctatacttatttcctatgtctttacttaacatctgggaaccactctcaaggtagtgtctctggtagttctgggaaagctgggtgcttctgtgttactagtatactaagaccttaagtaaggggtcctcttatgctctagggacttctctaacctctctctgaaaccctcaaggtaacagagctttagttccacacaggaggctcgagaaccacaaagctagcaggctgctatgatctgggtctctctaatgcctgtgcccgcccatatcttattctccttctcaacagacagaaatgagttccaaaatcttttcaaatcatttcttcctctggcaatattcaatagcagggccctcaccttggttcctgcaattgcctcacttcccatctctcctaatcactgtggcttcattccttttcagttttggttcccaaagtaactctaaccagggatctcttttatatgacagtatttagcagattggtattttaaatgttttagagtgtggttcctggcaggcctttttttgttgtttggtttttgtccacagtgtgagcaataaagatcttaattaaagaaattaatgaaaatgtcacctagagttggaagctcaattcacagtgttgggttgctggttccctactaatagattatatcctggcaacactgtcacagtacagcaataaaaactgttctggcatcttccaggtccaccacagagtctcattcttgctgttatgtctggactgaactcagagtaacccagaatcttcctcatacaagccttgtccacctatattctattctcgaatcatatctgaatcagcatttaaaactcaagtcactcctcccaataaaaccctccagtaatatcccatttaatttttggcttggcttataactttcatatatttacatatttcaacatatggaaggagacaccttcatttatactcttgccctggttcattcaaacattaagggtgaacatgcatcctgctgcctgttaaagagagtaatattaattttactaagcctaaaataatattttaaagtataaggacatactacagagaaaatcacatgatagaatataatgaagtaaaaatacccattctgaacagatctaccttgtaagagagtaattaagttaaaggcttgaggcactctccaaagaggagaccacacccaaaatgatcgaatcgtgatggtgtattgactgttattgataaataacattagcatattaactatatttacctcaaacttttcctaatggagctagtatattctgtaagtaaataactttccctcttctttggttcagcacacccaaagttcagtaatccagttgttgcatgatattcaattaaattgcacctttacgccaatgactacaattaaaatggaaatccattctctttctctctttctctagattacagacttgggctctttcatacattcaaaaacaagcaagccagatacacagttatcctcaacacttgtgtcttccttatccagaccttgcaaattcagttaggtactgtttctcaaaactcttatttagacccttcatcactgcttccataaaactccctttatttttccctgctttgttgcagtaatcccctatcttgtctactttctgtagattcatctttctaaaccattcaccatccacctctgcttttttgagcagtgcttcttaaagtatggttcccgtatcagcagcatcacatcactcaggagttgttagaaatgcaaactcttgggttccaccccagaactactgagtcagaagctctggaggtggggcccagccatctgtgtttcaacaagccctccaagtgattatcatgcattttaaaatttgaaaaccaaggttctaaagtcatatttttaaaaggcaaaaccaatcatgtcatttgcttgcttaaaacttctttaatgagtctcttctgaaggataaaagccaagttcttgggaagacgtgtaataccctttctgttctcatatttcagcccttctctttccacttcctccttcccacccagtgttttagtcatataaatgttttgaaatattgtgaagcaacctgctttttctgcctttttgccttttcctagtgcacctcttcccacacacaattcatccacctggaggggttccattcatctttccagatcaagctcaaatgtcccctttttcagaatgatttctgagggctaatttcaataacttacttacagcctattccacttcttccaggtccacctacataattttcccaaattaaatttttatacctccagctctttaaaaggaaagaaagtctgtttactgggcaaggaggcataggaaaaaatataaagggcactgcttatcccacctcacatcctcccacccctagttcacaagttaaagattgtcatccatctcttggaatagttatggctccttaaggatgttaatgccccctcctagatgttgtctcaattgtttattggtaagcccactcctagatatgcaggacccaaagcaatagtagaaagggaggcctacataccacatttaaatatttaaaagttatttaaaaactaagaaactttaataaaatatgttctatcattgtgctgccttaaatatataatttttaatgacaaatgaaaagtattatgtaaggcaatagtttttagataactaaaagctggcaaaatatcaaagatattcagtgcaatatttgatagcatacctgggcattctcttgatgagatagcaatgtttaggtaagtaataaaatgaaaccagcttaattcataaacacacatgtgttccataaaatttatatttctcctctttatttcatcaaaattatattgctatggtcaagatttttaatttcttgacagggatgagccaaaggatttaaaataaaatgaaattgtattgaagttagaaaattcaaatatatttcattaaaaattaaatataaaaacaaaaataaaattatttttttcataattcttaaatattcaaattatctattaagtcaaaaactgaaatgcatataaggaatatcacattttaatttcagaatatttcattaaagctgacattttctcatttaattttgtctcatttaacattgagcatccactatccatttgcttgccaatatgaagaattggtagcacacttcatacttattttctctaaccctacatatagacaaatgtaggagtactatgatttatttaataatccaaaatatacttatcgtgtacaaatgttatgctaatttgtctggactttcaaatctaccaatgaaacatgaacagatacaagaaaatggatgttcagctctacccaggaaaacaatcctcgattctgcaatgatttggtgcgttcattccacaaggaagaatttgaaaataatttatgtatattttctctatagtgctcaaatcctagcccaccccacccacctgctgcaaaataagatgttcatctctcatattgacagcagttcaaactgcaaatgttcatggcatttgagctttgttatctttttgctactaggatgtaagaaaaattgtggagaagaattttccggtagcccgagtaatattaaccacgagagtgaatgtttagagttacagattgcactgagccagtgctgtaggccagaattgaggcaacagaggcatttatgtttgtgtttttgtcatatgtggggccctctaatgcatggggcccaggacaaagacctttctttcctggatctaagcatggcactacctaggtgtttgatggctttaccctaggagtaaggttgagttttaaggtgctatcctagggaataatttcaatatatcttggagttggaacttctatacatttgcagtgcgtcacccgactttggtctatcaaagcaaaaaaacttggtcaggctttggtgcctagctatctggtcaaatatttatctaaatgtttctgtgaaggtattttacagacgtggtgagcatttcttaatcaactgactttaattaaagagtttacccttgataatgtaggtgggcttcacccagtaagttggaagccataaaagcaaaagataaaaacagaaaaaaaaaaaaacagaaaactgaggtatcccccataagaagggattctgccttaagactaacatagaaatcctgcctgagtttccagcctgccaacctgccctacaaatttcagatctaatattgcaacatcaactcttgcctgagtttatataaaacctacgcgatagatttcagacctgccagcccccgccatgtaagccaattccttttggaggaccccgactgacacaggtaaataattccatcttcttttatcccagtccccaaaggcagataaagaaaatgtaaacatatatatgtactatataccttatctttataccttctgatagcacgttggacaaaccacggtttctagaatttatggcatagtattataatcataggtttcaaagtctgtctcctattctagactggaagttccttgtgtgcagaggctgtgttatcacagcgctttttgaggctggaaataaacgttcaatacatgtctgtcaaaggttagagaatcaaaattaacacattacctggataagctggcatgtggtggggacaggagtaggggatggtggaagagcaaggagaaagaatcaaacaatgtggacgtaggaagcagtctccctgaagctaagacaccccatgagatggtactcatccagctttgccaagctcccagcacagtcttaatcacctctctcacagcgactttgatagctctggctaaggaacttgatacctgcaagcaattaactttaataagccagcaggtgatttccttgagaatgctgacgattcaatttgctgacagcagctctagattctctggctactcagccatggcttctacctctgcccttatgaacccagtgtgtggttgtgagtaataaatgaaaaggtagccaaagtgtgaatccttttaacagtgaaaattgtaatcagctttaaggcatgattatatattacagacagaaccaaaaggtcttttaaagttatgaagaaaaacaaaagccaacaagttgtacagctacattggcaccaaacttttatagtttctgtgaatgtgaaatgaagggatataaaagtactttcacctgtattaaccttttttttttctgttactcatcatagcattatctaacgcagaatcctaggaatgattctaaactctttctctctgtctcaataatcctaaatgttgcaattgccttattgtcctattttactgcattattttttacacaatggcagcctaatgagttcccccggcatcagtctcaggcatcacctatcaaacaactccactgcttgcgtcctcttcccaaaatgcaaatattatttcatctgcatgtaatttcttaatagttctccattgttaattgactacagtggagtcaaatcttagaattaaattttaaggaaaaagaggcaaaagagctattttactcaaaattaacactgaatatttcttaaattgtccaaaaaatacagtatgctccccattatatatgaaactgtgcagcaatacatgtttgtatatgtagtaatttatggtaaataaatttataataaaactgtaatattataattaaatataataatataatgtaaatatcattaataatataataaaataaacttataataaagagaatgtaagctttgtgaggacagtgattttcattcattttgttcaccgatgtaccccaaaggccaaaaactgtgcttgtcatagcaggtgatcaatgaatacttgttaaatgaaaatcacataacaattgattaacaccattttaacaattgatttgacaattgttatgtcactgacaattgtttgttaaaatcatttcaaataactttattttccctttttgtgcaacacatttaccactaaagtaacatagaaagtctgtgtgtggtggaaagtcattaatttacattgctttctaggtactaccgtcttccatgatctgcgctatccgttctgcacttatactttgacttcagtgtatcaaatcactcaatgttctccaaatatgctgtgcaaagatctttgcactttgattcctcaagccaatttaagtgtcctgtgatcttacgaactttgtttttcctctattttcaatgtttatttcattgcatttttatcgttttcttgtgggtctgccttcttgatcagattctaagactcttgattataaaatctatgtcttaatagtgtttttaatagtgtctctagtacaatgtcggtgtatcaatagacacatacagagtatctgatttatattaagtgtttatttgtctgtctgtgccattatgaccacatatgttacacttgaactttctgaccctaagttaacatctgataacatgtgttctacattttaggagcaaaagatatacttaattatttcaacaaactaatgagcaaacaattttagtatcagcctgcagtaaatactctttgatccagtatccagaatccagtacacagtatccactgtgtagcagcttctgcacatggggcatcaagggtaccaccccagaaaaactgctatgaccagaagtattgcagagaccagggtaaccagaagcacgatcatctcagaatatacctgcagcagcatgcctacagtggccttatatggtttgtgggcaagagaccattgtgaggaagtcagagaaacatatttgagtcactttgttcctatgcaaatatatgcctcccagagatcttcttgagttggcagagagggactttgctgtgggagaggggagatatgttttttggcctcaatggtagcagctaggcaccagtataatttgatattaatctagatgcctgcatttcaactcacctctcaggcgggaatatggactcaggcttttagaaagctttttcacaatgggggacaaagtagcaagtgaaagaaaagggtaaagtggaaggaaaaccttttcctgatggttaagcagttcctaacttacatgtatgaatgcatacatacaaatataaatactagcttaaagaagaataccctatcccatgcactccaggtaattaaatgtttatttcactctgatttgagatgtctcacgatgctaaggaaaatattggaaagaccttctctctcgttatctcaccttcagttaaaaaaaaatgaaagagagaagaagagagaaaagagataaatagaagggctatttgaaggtaagaaggtgaaggcagtcaccttttatgccttcctcccttcctcctgccaatcatccactctatttggttgactcccaagcttgctttataaacagctggagagcaaagcaaaacttcaactttagaaagataaggtcaactcatcctttcatttgcaacaagttgatagggccattgccgtgcaggtttggctggtcctggacaaaaccgccttctccagaatgggatttagaggaagacccttctctctctaatgtgactgaggaaaacagaaggaaggtaggcaaaggagatctgctctaggccaggcacagtggctcacgcctataattcaagcactttgggagactcaggcgggtggatcacctgaggtcaggagttcgagatctgcctggccaacatggtgaacccccatctctactaaaaatacaaaaaaatagctgggcgtgatggtgggcacctgtaatctgagctacttgggaggctgaggcaggagaattgcttgaactcggaggcagaggttgcagtgagccgagatcgcgccactgcactccagcctgggtgacagagagagaccctgtctcaaaaaaagaaaagaaaagaaaagaaaacaaaaagacctgctctccagtagcctctgaggccccaacttcccagaatgggagtgttgatcaggacctatggtaaatgtttcctactccagtccaacagctcactgggctaaacaaaagaggcccttcacagcctcggggcagacccacaaatatttttatttaattggtttgagatggggccacagactttttggactggtccccaggtgaatcacacgtacagacaaaattcagaagcactgggttagagggccagcatgagggctagagtgagagttcagatactgcagggagaggctatgggatttcctcacggaaagagacccaagggtgtggaaggcattttctggaagatgactgaggtacttggttatgggcaagacagtctaatttacaaaaacatgataaacctctcgagcaaagcttttcaagctgtgcaccccagaaggtgtgcaagatgagccatgacaacatataagaaaacaactgaatgtaacatttccattctaatttttataaaatttctttgttttacttattagtatagtagtgcatatgtattatttataaataaagaaacatttattaggagtatagcctcaacatcattttactaatgggcataaataattctaaaatttggaaactagtgttctaaagaaggaccatgattcctcactgaaggctcagctgagaaagctgtgataaccaggcaaaccagagaggaacttcatccagttgcctggtaagaatgatgaatattctgggttgctaagaaaatacatcagccagaagggagcaagagaggctgccctgctggggaatgtttgggagaccataaaaacagaaggtgggagcaacgagagggctcttcatcgctactgttaataacaaaacaatagcaacaaatgtaatacctgctcttacttactgaattcccagtaaggtcaagcactgtgataggcactttttgggcatcactgttaatcctcatgctgtcatacccattttacagattaggaggaaaaaaacctttaaaaaccataagtggtgcaacacagatattctactccaaactcaatgttcctgacattatgtcatgcagtttcaagagcatggatcatgagtgacattaggaaactgagagaagaagcatattatagcacttagagggtattatagtataaccaggttgtatttatcagctgtcttttctttcaattaaaatgctaaaggccgggtgcggtggctcatgcctgtaatcccagcactttgggaggctgaggcgggtggatcacgaggtcaggagatcaagaccatcatggctaacatggtgaaaccccgtctctactaaaaatacaaaaaattagccgggcgtggtggcaggtgcctgtagtcccagctactgaggaggctgaggcaggagaaggatgtgaacctgggaggcggagcttgcagtgagcctagattgcgacactgcactccagactggacgacagagcgagaccctgtctcaaaaaaaaaaaaaaatgctaaactgtggttgatgttttcataaacagagaattggtgctagcttcccaggcaatttgagagaatagattttcctgagtgtaagtaaacctacaagttaaaagaagtgacatccactgggagactcaggccaaatgtgatttcttccatacaaagtcaggtttatcaactccctccccccaccccaccacacacagaaacacacttttaatacttgcttttacactctgcatctgtgttcactttttccattgaccctccaaccaaatttgtggttctaaagctctgacatcaacagtgcattcctgagggtacttctctaggactgtcttcattttaagtctttgctcataggcacaactgtaaacttataagaagtttcaagcaactgtagagtaataagaatcagatctgtcctggggttgtggcgggggtgggcgggggaagtgtggctcttgagtagacagagacttggcatgacagtccttgtttaggattgggactcaagagattccaggaaagtcagtgtcccttccgtccaatcacagtgtgaggcccggtgattctggccttttctgctctatcattcagaaatgaagtcttttctgctctatcattcaggaaagaagtcttttctgctctatcattctagcttcttagccaccttgttggtttttatggattttctttttaccctgctcctgcctagcaagaaagaataaagaaaagggagaggaggggagagaaaggagctgactctgcagaccacaactttataattatttgaatataaaattagctggtaatgtctctctctttatgcaggctatgagatacatgatagttgtttctagtaacatatgttttctcatttttatcttttgaaatgttgttgaagtattcctaacttttatggctattaatggaggatgctgctaccatcctacccaagggcccatttttctaaatcctacaatcctctacgaatggaagcaatagcactacagttaacactctaaattgtacccttgtgcacacatacaggcctaaatcacttggccttatagccacaaaacacaattaggaaggactaaggtcatcaaaaaaaatcctaaatgccagttcactgcacagcacattctatagtcatcttacttacttgttcttgataaaaatgaatcccagcagggactagaatggtgaccctgattgtgaataatggcacacatgcagtgtccctcaatggctaccagaaaacaacagcatcagttaatagcctgtgttgtctcttaactgcccattgccagcaataggttttgctctatatagtctggattcccagtttcaagggtcttcactcctaccaggcaaaagtgctgtaatgagaacaagccaagaaaggaatgaggcaggcaacaagccaaaatccaggcagtgttagaacagccttgtcagggaagcagagaaacaaataattgaaattagaaaaaactagattttcagaggagtctcataaatcagacttgaaaatttaatttgagagcttttctctttctttcatcatattttttcccctcctggagctgtgctacaggcctgaacagaggaagtggaatgtaattaatcgatgtaaatctgcttcattaatggattgctactccctgtgtttcctctagtcaagaatgtttctgaaagtgctctctgacaacaatgctattcacagtctggataatggtaccaagcaggagaagaaacgatgaagtacttgcatgaagggagcccatgtttgctattgactggtagagaaatttagttagctcattaaatgttctgcttacaaaccctattcatgctttttaatcaattgatacttgtcctcctttctcacattgattaaataccaggaagtcctcacaagatagtgagatgtgaagttcccattgcagttaacaaatggtcctaagacccttagaaaacacatggttgtgcatctttatgcccacagggaatacgccattaatctgaactaataaagaggaacagcaggctaatcatagctcatttatatttggccctggaatgtgttatgtggtttttggcagaagatttaccttactaattatgtcttacttaaattaataatacagttaatttgcattcccttagcacacaccaattgacagtgagaagaaatgtgctaagtgataaggggatatcatctcgaaatttaaaagcttcattgaataatttgtgtatatatgtatgtgttgacactatatacatttaggacaaaaactctcaacatactttggaaagagaagttaaaattatgtgtgaaaatcgctatcaccttttggctaatttgcatcatcattgtttcaatattttatctcactacttctgagaccaataaattagaaagttaaacctgtaatcaacaaatatgtgtatatgtaacctaccatatcctgagcactgttctcagtattgtaaagggatttgaagaaatatacagtcattactctgtttcaaagtggggactggttccaggacccccatggacaccaaaattcatggatgctgaagtctctgatataaaatgatgtagtatatgcacaaaacctatgcacatcctcctatttactttaaatcatacctagattacttataatttataactcaatgtatgtgttatgcaaaatagttgttattgtactctgcattgtatagggaataatgacaagaaaggaaaagtttgtacatgttcagtacacacacaactactatagacctaaccacatttttcatctgtagttggttaaatacatggatatggaacccatagatactaagggccaactgtaggctattttctatcttaagatctaaaaatctggagaaagaaatattaagagatctagcactaatatgctttaggtgatctttgccttgtttgtagagactacaactcatttacaaaccatctcctatagacctggattgctgatgtggggaagaaaaaattaaggggtttacctttaagcagagtcaaggaggttaagaccaggtatctgattttccagtaaatgaagttgatgaacacaataaacccatgtatcattgctaaagtgctgtaaagtagagctttaatgccctctgtcaacttagaatcaagagtaaatatccactagcaattctacactggtataacaacattgcccagttactccacctttgaaatcttcccagacggacagttgttcaccatggcagatatgaagattcaaatatgtttgagctatacgaagtacatgataatgtaatgttgatctatctggttttggatgcatgaagcaatggtccaaacttggatatggaaaggaaacctcacttgtttcacaaatcacaggcatatttgtttcagatattgtaacacaatgattttcacccctctcacttttagcacaagtgttgcataagacccttggaagttggcctaatactagagatatcactaagtcttttttataatctatttctgattaattagtcctttaggataacatatacttatcaatatcattatgacattgcaggaaaaacaaaagcggtatgggtggattcatctcctctaaacttctttctttatggtcttgaacaaattactaaattgtaatgagtaaaatatgtatgttaatacccacattataatgtagttataagagctcgacataatgtatgttgagtgcttttgcaaagtgctttatattttagaaatactctccttttagtgcagccatactttgattctttttcattgcaatgacatggaaatttcaggacacaaaaatcagagtggccaaagaatttcatgggttcctttcaaaggataaaacaggaaattagaaagaataagtatgatataattcaaaatgtaaagccaatatctcgccaacttattaatacataaaattatatgccaatcttaacagaaatgaatgctacaacgtggtttgctaagctaattcaataggactacattaataaagttcctataacaattgagatggtaatctcatgttacagttggctagtctggccaatccaacaatactacattctattttgaacatcacttggagtggtattaccaaaaaataaactggaaagcatttagacaagaatggctcagacaaggtaagagctaaaagtaaccatttgaagggactataaaattcacctcagagaagagggagcatatggaatacatgagggctgacttcaaatatttcaagagttgttgccaggaagaactttaaacatagagtaactgatgtttaactcatgccgtgaactcatccactgtatgtttgaaaaccagtagcccagtagcctgttgggaagacagatttgtttcatatgtaagtaaagacaattcttcttattgaaaaaagcatggacataagatctgataaatccagcagaaaatttcaccttcaatcaagtagcaatgtgaccctaaatataaaacctctttgagcttatttttccaaactataaatcatgtcaacaataaggctgatacaaggattacctaagagaacatgtttaaaagcaccagcataatgctttaaatttcatagatgtgtaacaagaactaattctaacagtcatatgtcaaagatgttcaaagatggaattgagtgttatgggagacaataattttcctatgctagaaattgtttaggcaaaggctaaataaccacttggaagaatacaaaagaggaaagtcaagcttcagaattaaaattagattactttcaggattcctttcaactctaaatctgaagatcttgtgatacaaacattaaaaaaaagtttgcctaggaaaaaatatcaagaatagcaacagttatatctacaagagtaggtaaaaattgactaatatttgaaaaattagtctagctccctattaaagtatatagtttattactcttttaaactagtcaaggggaaaaaataaataatattggtaaaactcaatgcagatcatatttcattaaacaagaacatctttctttgccagatgtataggttagttatacactttcagaggatactatgataatgatcatatacaataacccagttgtcccattctttgatattaataattaaagcaatatttcttttggagaagttattcctttaaaaattcaactggtaggataaatctaatagagaagtagcacacagctaaaaacagaagttttagtaaattaatgagtggaatgttgaattcagcagtagctttaactaatgttgtgaactcatccactgtatatcagaaaaatttacagtacgttagaaaataatttgtgaaaccaatagcccagttgtctaggaacaaatgcacatcaagtaatagggaatatttttaataaaatttagtagattatggtgtaaggttttatacacaaatgtaaaggttttaattcaaatgtgataaaggagatgtttgtggatttatttagggtataaaaagccacatttttaatataaaactttattaatgtgacgaaattttggaattaaaagtagtaggacgcttacatcatatccctcactaaatgaagggcgtattgtttatgaaataatgttacatgagaaagaagacaatattgcacatacatattaacaaagtccttagctatccataaaatctagtttttccttcattactagtaacagatgtgtagcttttgcaagtggctaccagaaacactacatttcccagtctagcttgtagttggaaggaatcatgtggctaatttcaggagaaggtaagcagaaataatgtgtgacactgatacctgtaagaccagccctgtatttttcttgtacatttaagttccctgtacactctggatattagacctttgtcagatggatagattgtaaaaactttctcccattctataggttatctgtttactctgatgatagtttattttgctgtgtagaagctcttcggtttacttagatctcatttgtcaatttttgcttttaatgcaattgctttgggtgttttcatcatgaaatctttgccccatgcctatgtcctgaatggtattgcctaattttcttctagcgtttttatattacagttttgggtttttcatttaagtccttttttatttttatttttatttttggcagagtctcactccgtcacccaggctggagtgcagtggtgcaacctctgtcattgcaacttctgtttcccgcgttaagtgattcttgtgcctctggctctcgaatagctggaattataggtgtgtgcaaccatgcccagctaatttttgtatttttagtagagacagggtttcaccatgtttgccaggctgatctcgaactcctgacctcaagtgatctgcccacctgggcctcccaaaatgctaagattacaggcatgagccatggcatccagccttatttaagtttttaatagatcttgagttaatttttgtatatggtataaggaaggtgtccagcttcaattttctgcatatgactagccagcactctcagcatgatttattaaataaggagtcctttccccattacttgtttttgtcaagtttgtctaagattagatggttgtaagtgtgtggtcttatttctgagttatctattctgttccattggtttacatgtctgttcttgtaccagtgctataaaaagtggacatgaacagacatttgtcaaaagaagacatacatggagccaacaaacatatgaaaaacagctcaacatcactgatcattagagaaatgcaaatcaaaaccacaaagaaataccatctcatgccagtcagaatagctattaaaaagtcaaaaaacaacagatgctggcgaggttacggagaaaaaggaatatttttacactgcaggtgagagtgcaaattagttcaacaattgcggaagacagtgtggcaattcctcaaagatctagaggcagaaatgccatttgacccagcaatcccattactgggtatatacccaaagaaatataaattattctattatgttcacagcaatgtggatggaattggagatcattattctaagtgaagtaactcaggaatggaaaaccaaacattgtatgttctcacttataagtgggagctaagctatgaggatgcaaaggcataagaattatacagtgaactttggggactcaggggaaagggtggaagggggcgagggataaaagactacaaattggatacagtgtatattgcttgggtgatgagtgcaccaacatctcacaaaaacaccacaaaagaacttactcatgtaaccaaacaccatgtgttcccccaaaacctaaggaaatttaaaaaattttaaaatcattctattataggccaggcgtggtggctcatgcctgtaatcccagcactttgggaggctgaggcgggcggatcacgaggtcaggagatcgagaccatcctggctaatgcggtgaaaccctgtctctactaaaaatacaaaaaaaattagccaggcgtggtggcaggtgcctgtagtcccagctactggggaggctgaggcaggtgaatggcgtgaacccaggaggcagagcttgcagtaagccgagattgtgccactgcactccagcctgggtgacagagcgatactctgtctgaaaaaaaaaaaaaaagatcattctattataaagatacatgtattcatatattcattgcagcatgagtcacaataacaaagacatggaatcaacctaaatgcctgttaatgatagactggataaagaaaatgtgatacacatacaccatggaatactatgcagccataaaaaggaatgagatcatgtcatttgcagggacatggatggagttgaaagccattatgctcagcaaactaacgaaggaatagaaaactaaacactgcatgttctcacttataagtgggagctgaatgatgagaacacatggacacattgttggagggaacaacacacactggagcctgtcggcatggggtggggacagggagtgcatcaagaagaacagttaatggattctgggcttactacctagatgatgagatgatctgtgcagcaaactaccatgacacatgtttatctatgtaacaaacctatacattttgcacatgtacccctgaacttaaaatttaaaaaaagaccagtcctgtcttttcacattcccctgatctcttcctatgagctggaataataaaaaccagagtgatcttttatatcacatggtgaataaggcagaggcactaccagaataagaccttgagtgactatgtggaaggaaggcactgctaacccagaatactcatttgcaattgttatgtgagaaaaatacacttctatcttgtctgagctattgaatcttactttatttgtttcagtagtttagcatttgaccctaaaaactactctgactaaaactatgcaaaaatgcatgtttatctaatcatagagataacaagaagccctaggaaagtacaaagtgattgttttaaggtaatattttataaaatttaagtattttccaattatgtgacaacatttcttttggataattattatggatcagtcaagggccaaatacacaataaattgttcaatagattcagtcttcctctgaaatccaaggaaggccatatataaaaacaggagcaaattgctaggggaattcatatttgattcctaattgtacatttaccagaagaaaatttggcatttgaattgagcatttaaattcactactattcaacagcaatctgaatccccaagttcaattaaaaaggtcattaccctctagaactggaggtgctcttttaattacaatattgctaatgaattgggagacaagacattttggcttagttcaattagcacatttaagtcaaagcaaacttcagccaatatgggtgactttcccagtggcatgctttttctttattccctccttccctccctcccttccttctttttgtgtcttccctacttccttctttcctcggaaatttaagcataactctggcacgtaagtctctcatttccattttatctgtaaactgctgcaaagctgttaatagctaaggacctacaaccacatttttgttttgcaaaactcttcaaatttatatgaatattgagaaaacattttgatgagaaatttttaacatagctttctgaagcagagtaaaacataaatttcactttccctagctaaaacaataattatccaatcactttatcatggtgtattgcacatgcttttgctatgggaaagggggaaaagtgaacatatttaacactttgctaccaacaatggtttattgaggttaatttatattaggaaagtggagtttccggatgacattccaaactaaagaatactaatgaatagctcctgagctctgagctttcctgcctggctagaattcacaggacatgaccttaaatgtaacagtttttggtaaaaaagagaaaatcttcccttcaaagtgatttgaaaagttcagaaaattagctcttatgctcaaactaatagtaacaaaaacactgctaccagattaaatttaaataaagttcataacagctgtttgtaacatctagatttaactttaggggaaataattgactcaatttgcccaggttattctcttcctttgctatgccagtaaagggcttggagaggttgcccatgcaacatatcctacagatttgagtcagctagactaggtgtttattcatttattcaggaaatacactgagcagcctactgtgagcttggaggtgggcaaacaaaacagagaaaaatctagacctctctctctctgtaaattgacataaagatagttttagccaaggaggaacaatttccttctaatttagcactacagagtgttctccttggaaaagccatccacttggctttgtaccctgattagtctgttctcacactggtaataacgacattctcgagactggttcatttataaagaaaagaggtttaatcgactcacagttcagcatggctgaggaggcctagaaaacttacaatgatggtggaaggagaagcaaacaggtccttcttcacgtggtggcaggaaggagaagtaccaagcaaagagggaaaagctctttataaaaccatcagatctcgtgagaattcagtcactattacgagaacaggagcatgggggtaactgcccccaagattcaattaactcccactgggtccctcccatgacccatggggattatggaaaatacaattcaagatgggatttgggtggggacacagccaaacattatcccctaaacaaagtcataccttttcttttttttttaaagaaacagattctcattctgttacccaggctggagtgcagcgacatgatctcagctcactgcaacctccacctcccaggttcaagtgattctcatgcctcagcctcctgagtagctgggattacaggcaccagccaccgcgcccagctgatttttggatttttagtagagacgaggtttcaccatgttgaactggctggtcttgaattcctgatctcaagtgaccctcctgcctcagcctcccaaagtgctaggattacaagtgtcagccaccacacctggtcaagtcatacctttttaaaatatattctcctttattatattcaagtaagatatgttctttaaagaaaatttagaaaaaaaagaagaaaaaacaaatatcttctttctttgccaaagcaaaaactgctaacatttttaaaattttctttcgaatttcatctctttaactctcttgtgtgtagtagaaaaaaaagttgtaattatattgttttttaaatttgtgctaagttttaatgcaaacttttcataaaacatttagtggaagcatattccttaatttataacatattatgatttttcttattgttttcttcattgcagattataattaagatgatcaacttttcagataacactttcctaggagaagtgttgagtcaaagaataaatatgtatgtttttattttaaagtatatatgtatacacgaacacacacaaatatatatgtatatattttttatttgtttaatttgtattgttaaagggcttttccaaaagattgaaacaaattatactccatctaaaaaaaatgcttacttaacctcactcaggtatatacataatccacagcttactcagatgtatatataattttctaatgagttaggaaaatgattacatgcctaagattttctctgtatttgtaactaaagtatggtgatttgtgaaaagcttctttacatctattttctattaagatgttgttaaatttttttgcctatctttgaggtttcttttcaatggcttattgtgtgtaaaataaaccatgataaaactattaggtaatctttaaaaaacaatttctaagagtgctgtacatattaaaaatatgaactttatattggccacatttattgcaaatattttcccagatataattagttttaattttatttatgacatgttttaccaaaaagtacaagttttatataactaattgtgatgtatttcttatatcaagatgttaaccaatattttttattcaattcttatttttcacttctgataaatttccatggtatttgtctcaaagctccacataattctcatcattccttaaaaaaaaatattgactttttaaagaaacttcttttacttattgaattttattactcattccaaaaatggttaattttcttctctctcttttcttctctctctctaaacatataatctaaacaacaccttttaagttgtttttcttctccagtaattatcttccttatttccactcttatcacagaagccaaacttccagaactatataaaataataataataatgggaatctgaactattagttgttaatataatattgatatttttcagcatgttaagaaaatacctttttatttctaaatttctcaaaagtattttgttggtggtgctggtggagaactatttttacatttaaagccagaaatgattagttatataaaactctgactttaaatgtaaaaaagtgcattacattatgaattttattacagccaggcatggtggctcacacctgtaatcccagtgctctgggaggccaaggcgggtggatcacaaggtcaggagttcgagaccagcctggccaacatggtgaaactctgtctctactaaaaatacaaaaaattagccgggcgtggtggcaggcgcctgtaattccagctactcaggaggctgaggcaggagaatctcttgaactcgagaggtggaggttgcagtgagctgagactgtgccactgcactccagcctgggcaacactgtctcaaaaaaaggaagactgtttcaaaaaaaaaaaaaaaagaaattttattacattacggaatcttttttaaggcatttgcaatatattcagtggctagctttgcaaaaagttcttatgaatttgttttatagataagatgttcaatattgtcagcattttttgattaaatatcttttttatcttttattgataaaacaatattttttattatatattattaaagtaagttattctgtataacagactaggcaacagtgaaagttttctaaatgctttcttgattcaccttaatattgaattttgctatctataataaaaaattctataattattacctttttgttatctttgtcaggctttttataaggtaataattatagaatttttggggaaaataaatcaattggtagctttccatacttttgcatgtcttacaacaaattctatagcataggaataattcttttaaaaaccctaaatactttgggaccaaattcttatttagaggtaactaacattttgatactactcatgactaatggtacattaagaatgtttttattttctggctcaatttaggtagtgtatattttctcagaaaaatggcttctgagaccttcaaacatactaagatttaattttacataatatttccttattttaaaaagttattcttaatatatttccattttaatttataacatttataactttatatatatttactcttactatttgattcactatgggtcagtcttgttttgtttgaaataaccagagttgattaagttatcaactcttctgatacctttcttctaataaataaattcttgcttttatctccatcattgtctttcctccattttcttctacttttttaattgaagaggatattatagaagaaattgttatttcttcacaattcttccttagctctcactcttgccatggttcactgtgggcagagtaaattccttggctccactgacctaggcctgaccatgagagttgctttaataacatttaggtagaaaagaagttgtgtcacatccaaataggggctttatggagcattccatgtgtccctctccacgtgtcttgtgttcttacccttgccttgggaacatgcttcccatttggcggctgatccttcagtcagcatcccagaaatagaaaaatgcataaagcagacatcagtccaacctgcagagtgcagttgagccacagcgcccaacaacgacccagcctctcttattcaacgtgctgggaaacaaacatttattacagccattgagattctgtactgtcatggaggaagacctagtgaaaagtgacgaatactttttttttttttagactgagtctcgccctgtcgcccaggctggagtgcagtggtgccatcttgactcactgcaacttccgcctcccgggttcaagcaattctcctgcctcagcctcccgagtagctgggactacaggcgcacgccgccacacccggctaattttttttttttttaattttagtggagactgggtttcaccatgttgcccaggctggtctcgaactcctgagctgaggcaatctgcctgcctcggcctcccaatgtgctgagattacaggagtgatctgccgcacccaggcaactaatacaattttacattattctttctatcattataaattgaaccccttctttatgctccatcttacctgtttattaataataaggctaaaattatgccactgtgtacagctttgtaaatgggccaaaaatttaataattttatgttaaaacattctaaaagtatgaaattatagttattatttcctatttgacctaatatatatttacaatatatattttaaaatttctatctgtgtgcttttatcatttaatccgtattattcgtttacagcattcttgcagtgttttcagagagatgtggtcttacaatttttgagttttcaaatagatttaggttgcttatatggcttacaatgtgatattttaaaatcacattactgttttggtaaatagttgaaaaacatttgatttttaataacactttaaatgttttaaacttaatctgaatatttgaatttaatttgggatataaatctatgtgccttgattatgatgactggtaagattcactttatctctgcactgtgtgctttaattttcttcagtgatacaaaaccaaaacattcatatcctcctaaatttttaagcgcattcttaaaccatttcctctgattaacaaatttatgaaaaatacaaaaacattggcctgtgcatgtttcatcccccaacacacactagtgtaaaataattttttatttctagttcacttaaattttcagtatttgacaagatattttgaggatacagttgttgattatgactgtttaatggccaaacttttcatatatttattctctgggaatttttttaacatttgcaaaatattccgtggccagtgttgcaaaagtttttaaaaatctttatgttgaactggaatcatgcccacaccactgtatatatgttatttaattctctagttcttagttgccgcattctcatttttcattttattggagcatattttcaagtaggattattcaaaaatgattcatcaatgatatatgttttgaatcctttacaatttcaagaatgtcttcacatagaaatgacaacatggctacatttataaatattgaaatgcaatttttttccctgtgagactccatataagtgacttcttctagcatttattatggtgcaaactttgaatctaacttaaaagttgtacttttttttttttttgagatggagtctcgctctgtcaccaggctcgagtgcactggtgtgatcatggctcaccgcaacctctgactgcctggttcaagtgattctcctgcctcaactcctgagtagctgggattacaggcatgtgccaccacacctagctaatttttgtatttttagtagacatggggtttcaccatgttggccaggatagtctcgatctcgtgaccttgtgatctgcccgccttggcctcccaaagtgctgggattacaggcatgagccatcgcgcccggccaaaatttgtgcttttaagtaacatccttctcttccctgcactgaaggatatgactttgttattgacattttaaaaatctaacagtatattctaggcataggtctttttcaccagctttccatgaaacatagtgatccttttaaacttacaaagccaaaatcttattagttctataatagctgttttattatgactttgattattctttttggtcagtttgttttggcttaattcccaaggattgtcagctatctacaaattgcatctttgttttctttccttgatatctattatgtttttgattgatctgcattcttaatgtacttttcaaagttgttctttaagtcactgactgcatttcatagttagctgattctgtttttaccacctccaatgaatacttttatcagtttgatgtattctttctaattttccttctcatcccatattttttatgctcacaagctgcatctctgcaaatgacaactttgtatcatctttaatctcttctgtagtgaatttgtcttttctggttctttattgaaaaagcaaatatacattctagaaaaaatatgtttctaaaataattacttctgtttgcaatgttaggacatcaaatttttcttatgttagctctttctgtagaaagagtttggtcttcatcgatttgaacaaggggatctttacccatatacacgtttcatgtaaataagtgtatgtattcattttaatctccatcactatttccctgtgtacatccagatattccttttctgatcttgtcaatgaaacccagattaagtgagattgtatcatctcctgtttccctaatccttgcagtaaagtaggtgtatttatttctggataattttaagcagcctgaaattattttcttctatttcccgcactactggtattttacagttctacttataatttgctttataaatgtgttgtgtggttttcccaacccttttcacctctaaacatgctgtatggaagttgcaatctccagaatagaggaagaaagatagtgatgtgtgagggggatgtggaggaggatacaaaataaatttcagtcatctcagtcacccatagacctgggattatcactaaattctctagatatatacagagattataaatctctgaacaaaagatccagagtggggatgaatgaaagacatctcccacccattctaatcacttctggatccattccatctctactgtatttagagcaatggttctcaaactttagtgtccatcagaatcacctggaggacttgtaaaaacaaaacaaaacagattgctgtcacactcccagaccgtctaatttaataggactgtggtggatcctgataatttgcatttccaacaagtcccaggtgatgctgatgctgctgctctgggcaccaaatttcagaatccctaacttacagcaattcttccaagggagctcaatcacagattgaaatattttttaactttatatcagtgtgtattttcacagctatcccacgagcatgtaaggaaaggtgaattaagcatccacagctagtgatttagttaaaatatgttatgtttatatatatttatttacattatttatgcattttactattagatttctttttaagattatcttatatatagatagctatttaaaagctagttggaaatgaaatgtgtttcattgtctaatagaaccattaaaggtacattgttaagactaatttgtaacgtactggccattatatctggaataaacttgtttttagtgggggattaaataaaaatttcctaatacaaaaattgagctaagtctgattggggaaagtacagttgtgtgtttgtgtgtgtgtgtgtagacacaaacatatacataaaatatatacatatgtgtatacatatatatctgagagacttgctaaagtttatacaaagaaaaattctaatttctggctgtgtgtattaaaacatgaagaacaaagccctcctgagacaacattaagcacgtgcaagataacgtgggaatggagtaggaaaggtgtttgttcctggctggccagattcagatcatttggggaatcatgtcttgagtgcagaattgtgggtcactgtgtttctctttctctttgttgctttgagttattaaacaagagcgggggactttattaaaaagaaaatggtattaatgttttagtcctgttaatatcttgaaagttgtttccctaagagtgaccagacatggtgagactttactcaatcagcaagaataccaccatgtactttaataatgaaagaaattaggctggggctattgtaagaacagtttctgaatgacgatgcaaaatataataaacacagaagtcccacactggcacagcatctgtgaggctctggggtttatgctccctaggtttagaagattttatgtttcaactccacagacagacattttcagactacctttatgtgattacactgtaatattcaattttgtcaaattatttttctttcatgcattgaattagtccctttttcctaattctctttggaattaacaaatttagattttccagcacatggcagttccatttaagtggaataaaataagctctgttcatttctcttttgctttctacagtttgcttttctctgtgtgaaaatgctgtttctttttcaaatgtattattattctcacagacacaaacagaagctccttttgcaattgacttgcctctctttctgccattacaaaattatcactatggtagtttcatgagttagaagataagtat

SEQ ID NO: 886 - DNA, 114361 bp, Homo sapiens
caccatatagtaaattaccaaaatgtatatccactaagtaagttagagtgcagaattttgtttgtttgtttgttttttcttgctgtgctgcccaggctagagttcaatggcgcaatctcggctcactgcaatcaatccctgcctcccaggttcaagcaattctcctgtctcagcctcccgagtagctgggattacaggtctctgccactgagcccggctaatttttgtatttttagaagagacaggtttcaccatcttggccaggctggtctcaaactcctgacctcgtgatccacccacctcagcctcccaaagtgctgggattacaggcgtgagctactgcacccgcccagaatgcaggtttttaataaaatgctatgcagccatgaaaaattacattaaacaatatttaataacatggaaaggggtttaagttattttaagtgaagaaaaaaataaattaaaaatatatgtgatacattttatagagacaactacctacacagaagaagctgaaaggttatacaccaaatattattcatcatgatttctggtagagaaattacaagaaatttctactttaaaatttttgtattttttaatgaattacatttctaaagatagtagaaaaaatgaagctctcttagagctgattcaaaatctttcctattagaacctctgttcatctctgaatcttatttcaattataaggaaagctgtgaatagcttgtaacaacatccaattcaccattgtgagttaattttttaaagtttcttctcccactgtatatggtgaaataggtgaatgtattaaaattgctaaattttgctttttctgaatttagctaatccttcttgagatgtgtgtgtgtgtatatatatatatatatatatatatatatatatatatatatatttgttcttcagcatttttctttattttattctatctccttttgagctaaatggatgacctatctgccagctccattagtaattttatttactgcttcagcctttgaaacaagttaatgcagaagattgaatagtattttagaatttacttcacacagtaatgtgactcaaggcttcattggctattatgtcccctttggcattaaatattttaatctgctaactatgacagatacaggatggccaatttcccagtaaatgtattagcctcctagtaaattaccctttcccaccttataccatgcagcctattaacctataaaatcccttctcttccaatataggcaagatgtcttaactgaagacttaatgttgaacacatcctaaagcttgagaagaccttatttcagagggttgggaaaggaaaactaatcattgcaagcaaactttaagttgctgagactacagatgtcactttggttcatttcctattaccatcgtttgatgaggatatagcccaaaaaccaagctagatgagtattttaataaatgtggactgagattgctttaacagaaaatataagaaatttctgtgtttttagtaatatatcctaggttcaaattaataaatctcttgattattctgtgccttaaacttgtatgaccatctagtcgtaccatttgagcaaataagttaccacctcaggaaaaatgaagtcagcactcaatttatatctataggataattgtgttttgttttgcttttatcttaagcccacactctagtaaacaaaagctatcagaagaaagctttgtaaaatattacagattgtgttgttaaataatactaagaactttcttgcatttcatggaaaagataatgcatattgtgtacttttcattattttaaatgtgtctaggaccaaataaaccaacggtgttctctgtccttctactggtttgggaaaagatttatgtaacaaaccattatcttctagttagaaatcatgaaagatgaggactgttgttcctgtaattaatcaccctatagtagaactctctcacagtgacttaacaaaatacacttatgtatgaatcttaaatatgcagaaggaatactaaagttgaacgggtaggatattttatcttcttttaagctttcatatggttaaataaaacaaaaattaaaagtctataaaacagaatgtatagctttacaaataattataaccaatacccaagttgtggaaaagaatattatcataaattacacacccttatatgctaatttttctttttaatgttaccgcataaacgtccctttctaaacagtataattttatttctttctgaaatttacaaaaacagcagctttatttcttgcttattttagtcaatactacacttgtgagattcatccagattgctatatgtacctataaatcatttattttgttgttccttttttcattatataaatataacacaaatccattctactgtcaaacatttggattgcttctaggaaattacaattaatgctgctattaatattttctcattcctatatgcatcagtgtcttcagattatgtgtctgggagtggaatggttgggtcacagagtgtattaacttttcatttcagaagacaatgctaaacatgtttctaaggtgtccatactgatgtagtctcccagcaacatatgagtatttttgatatttcacatcttcaccacttgatattgtcaatcttttaaattatagccattctggagagaatacagttgtgttttttattcggagttaccaataactaaagagattattctgttttctatatgttcattagatatttgggttttgtcatttgttattagtatatttaagtcacttgcccattcccaagtggttagcttctgtctttgtatattttgtatatctatatctacaaacatatacgtatgttttatctacataaaattatgtatgtacattatatattatatatttaaatataatatatttatcttctggatataaactcattgtcagttaagtattttgcaaatatatttttccatgtgaaggcttatactttcactctcttatggatgtattttgataaacacaggtccttagttttcatgcagtataattatctcctgtttatttttatgtttactactcttatttcctattaaaactttttcatatcccaagcttatgaagatattctacactatcttctaaaaacatatgtttttgctttcacttttaagttactaatccacatggaattggtttacatgaaagatatgagggagaactcaaatttcatttactttcacatgcatgtaattgtcacagcatcatttactgaaaagaatatattttccccacttttgtagcatcaaatcatcatcataataatcataataataaatgtatatttctgtatttttattccatttgtttatccttgattcagtacaacatggttggatcagtctgttttcatactggtataaataactgcccaagactgggtaatttataaaggaaagaggtttaattgactcactgtttagcatggttggggaagcctcgagaaacttacaaatatggtggaaggtgaaggggaagcaaggcaccttcttcacaaggcatcaggcggtagatgtgagtaagtgaaagcaggggaaatgccagatgcttataaaaccatcagatcttgtgaaatcactcactatcatgaggacagcatgggggaagccaccctcatgatacaattacctctacctggtcccactcttgacacgtggaaattatggggatcatggggattacaattcaacatgagattttgggtggggacacagccaaaccatagtcatggtcttaattactttatttttatcagatttgatatgtcccatggagtaattccttccatgttacactttgtttctgtcagagtagattatactgcaataacaaagaattttaaattgcagtgacttataacaacagagctttttgttttgtttttcttgctctctctagttgtccattttgggttgtctggagaatatacttgatttcttctaattctggagcccacactgattgaacagctactctcttgcacatattgctaattaccttagcagaaggaagtagatagagtgtggtgaattattaattggctcttaaatcttctagccaggagtcacaaatgtcactttcacatttcattaacaaaacacgtcacacgaccactcatcacctcaaccaagaggagaaaataaaatattggatagacagcactaatgattaacctaatcttttaaatgagtatataacttattcttgttcctttgatttttctttctttcttttttttttttttgagatagagtctgctctgttgcccaggctggagtccagtggcccattcttggctcactgcaagctccacctcccgggttgatgccattctcctgcctcagcctcccaagtagctgggactacaggcgcccgccaccacgcccagttaattttttgtatttttagtagagacggggtttcaccatgttagccaggatggtctcgatctcctgacctcgtaatccaccctcctcggcctcccaaagtgctgggattacaggcatgagccactgcacccagcctgatttttctatatgaaacttcttattaatttgtgaagttcataaataaatattttaaagattttggttggtattgcattaaatttataggtcagcctaaggttatttgcaagctttaaaatatttggtcttacaatccataaacatgaccatagttagattgagaaatacagatatagatttcggtcttcacacatgtttctttcaattatgatttttggttttctgcatacaggtcttgcataactttttgttacatcatttcttagtatctgatttttttttttttttaagatggagtttcactcttgttgctcaggctggagtgcaatggtgcaatcttggctcaccacaacctccacctcctaggttcaagtgattctcctgcctcagcctccccagtagttgggattacaggcatgtgccaccatgtccggctcccattttgtatttttagtagagatggggtttctccatgttggtcaggctggtctcaaactccgaacctcaggtgatccgtccacctcggcctcccaaagtgctgggattacaggtgtgagacaccgtgcctggctgtatttgatatttttgatattattgaatatattatattttataaaacttcattgcttatatcttttttctagtacatagaattgcaattgattttttaaaatactgacactgtatccagaaactggctaactcacttattaagtattataatttgtctttgcattgtattttctctacattaaattatttccaattcttcctctttctgttctttttctcatatttcatcctcaattagaatctctaggacaatagaaaagtgtgattgtaaacatctttattttatttccaattccaaaggaaagctttcaagtatcattattccattagatgttatagatttttttgtcagatgtcatttatcagctgtgaacattttccattgattcctaattggctaaaattctgattttgtcagatatttttctgcatgtattcaagtgatcatccaatattttagtattttgtaaattcatatgtttaattaaatcaattaaaaatcaattacaacaattgatttttgagtcttacagcaactttgcacttcctgaaaaatatgtatctttcttataatacatttttaaatgtttctagttggtcataacatattatccttttatatactattggatttttttgctaatatttattaaggatttttttgcattcatattcacgaagaatatttctctgtaatttttataatggaaaggttttgctattaaaattattctggcttaaaatatgacttgcctttctccatttttttttttttttttttttttgtttgagacggagtcttgctctgttgcccagcctggagcacagtggcgcaatctccgctcactgcaagctccggttcccgggttgacgccattctcctacctcagcctcccaagtaggtgggactacagtacaggcgcccgccaccacgcccagctaattttttgtattttttagtagagatagggtttcaccttgttagccaggatgctctccatctcctgacctcgtgatctgcccgcctctgtctccaccaaagtgctgggattacaggcgtgagccaccacgcccggccgcctttcttctttgaatgtctaattgaattaaccagtgaaatcatcaccactatgagattttttgtaataaccccttttctatttctgatattgattatcgtttttattattgatctgaatagttagaattttgtcagttttgttggtctcttcaaagtgagctgttccctttctcatctgttttctatttcattgatttctacttttgtcttcactgttttcttttacctgcttacttgctcacttactttcaccttgttaaggtgaaatcttaggactttagttttagattgttctccttttcttatataagcatttaaagctatgaatttgctgctaagcattaccttagcttttcctacaaattgtaatattttatattttccatgtcattcagtttgaaacattttctaattatcttgtaattttgttttaattcatgaattatttagaagtgtgctgtttaatttatagatattgggtgttttcttagatatctactttgatttctactttaattatgttgtggtcagagtgcacacctcgtatgattcttttttaatttattgagacttatttatggcctggcataggatctaatttggtttatgcactatgcacatgtgcaagaatgtatattttccagttgcatatactactctattatactaataagataaagacgtatctttaatgtcttcattgatttttgtctaaatgttctatttattgctgacgtagaggtgttaaatttactacaattatgaaattgtctatctcttaaattctatcaatttatgctccataaattgaggcctattatcaggcacatatacctttataaatgttatgtcttcctgatgaatgcctattttatcatgataaaatttttacaatctctcattatacacattgtcttgaagtctactttaactgataaactatcccctcaattctttttatgtttacagattccatgatatatcattttctttttacttaccttcagtctgtctttatagatctgtatctttatacttgaagtagcttagagtaaaatcttattttattttatccactttggcattctctatcctttaattggaatgcttaggcaagggatatgcaaaataggctcacaggccagccacctaatttagcaaaaatcgttttaaattggacacaaccgtgaccattcatttacatattttctatgactgctttcatgcaaaggtgattagctgagacagacaccatatggcctgcaagatgaaaatatttactctttggccctctaagagaaagtttgccaactgctagtttacatcattagcactcactgtaattactgatgtggataattttagatctaccgttttattattattttgttgttcctctattcccacttctttgttttctttttgattatttgaatatttttattatctcattgtaatttctgtctactggctgacttttttttaatctgttgattttctgcttataaatctctgatttttttttcagtttgttctagagattacaatatgcatatctaagctgtcatggtttactaagagttaatattgtattagttaatataaaacgtagaaatgctgctactttataaatccttttgccccattgaattttaggttatactttattgcttttatatacattgaaaaccccaccagataattattttttctttattaagtgaatttaaagagaaaaataactgttttctgcaattactctaatatttaccctttccaattgttctcaagacatgacggaaggtccagatatcactttggcatcattccctttcctttagccttttgttagccaatgttcggggcagatctggaaggtaataatttttctcaatttttattttacctcccttcctgaatgatatttttagtggatataaaattacggcttgacagttctattctttaaaatgttgtttccctgtcttctgaccttcattttttctgatgagacattctcatcagaaaaatcttattcaaatcactgcattcctgtaagtaatatacgtatcagtttcctctagctgttttgaaggtttttcttcatcttagagttttaggggtttatgatgtgtctatggttttctttggttatactgtttggggtttgctgagcttcttgatgctataaacttaagacttccatcaattcaaaaaaatttaagaccactgtttcctcaacttctgctccagtcactctcttgtttcttgtattgttacattagtaattccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctgagtaggagtctggctaatcatccaaaaatgtcaaaagagaaaccaaggtgaatttctttcccaagctgagatttgaaataaactgctagaagttgtcactgaatgtggatattagcaaataactttaagctacagaaacatcacagatttctgctttactacttttctgaatttgtaaaacacaaagagagggagagaaaaagagaggtggagaggtgggagggagtgggctagggtgagggcaagagcagggagcggggagaagaggatggtagggggagggggagagagaggaagtgggagaaaagggacaaagggaaggggagggggtagggagaaagaggggaagggggagggagggagggaggagtggggaggggtttaggtggcttttgaagtctaaagttcatttttcaatatcactatcactcaatattatgaacagggaactcacaggcagttgacagacacaggcaaggaatcatatgattagactaatcagtggaaggtgcaatgacagaggatggcatgggagcctatgaagaaagagatgatgtttctgtatattatacattctccagaaactaagagctccaatagtctatcgagacttcatttccctggcctggcgaggtggatcacagatgtaattccagcaatttgggggccaaggcaggagaattgcttgagcccaggagtttaagaccagcctgggcaacatagtgagaccctgtctctgtgaaaaataagataattagctgggcatggtggtacatgcctgtagtcctagctattcaggaggctgaggcaggaggatcatttaagcccaggaagtagagactgcggtgaatcattattgcatctctgcactctagcctgcgtgacagagcaagtctctgtctcggggaaaaaataaaataaaaataaacgagagagagaggaaaatttcatttcccttaacagcgaagggcttcactaaaaacaaatttatcatcctgccattttactaagatattgttttcacacatccccctttcaggtcattgccactcaaccatgttcaatctttaccctcctcatctctgagctggcatccatccatcttggttgatgattttttccagctcagagactcagtgccccagcacagcagttctccaagttacaataataaacttcatttgctcttctgactactctgggtcctgaaaatgttataactgacacagttgcagagccatccattggaacaactacactaaaatatagagattgtgttcaaacatgtatacttcacatttacagtaattactatggctttactttcatttgcttctctcagttttccttcatcttgcaacaagacaatcaagaaaaagcaggtagtaggtagcttctaacagaagaacagacaaaagagagcataaagaagatattagccaagaagtgatgcttgacatttttttcaaatagaaatctattaaggaccttaaaaaatcatctattatagccaaactggtgcctaactgaagtagtagctgagagtgcttcattgaaaatcaattagagtccaacctgattgtagacagtgtcccttcaacaaaactgacaagcattctatctctactttgataacatttgtatccaaaatgagaaaacactagagaaatatgaaaataaggcaatttcaatgtatgagttatatcccttaagttcatggatgacattaactaagttctgacaccaatacccctagggtgtctttatttcactcccccttctggaaatgattgaataatttataaaggatatatcttgggggtggccacttctacttcctgagctgcatacagaacataacatttttagagctcagaattgggttcaccaccttccattgcacagttaaagagactgcagtccaagaagggtaaggggtttgcctgctgtcacaaagctagggagcaatagaaccaaagttcaaatccagcaatgctggctgcaactctggtatcttctttgcattcttctgcttgtaccaaatcagatgttagcagaaacgcatggaatcctaggaatagtaaacaaagagaaactgataacaggacaatttacatacatggggcagaatgacaaaggaaaccaacctgggaagcgaagtctgccagggctggcagcagagaaagcctttgcttcctatctctacatcctaaaggaatgaggaggaggaagagagaagtaactgaaatccagaaagtactctgactatagcaaaggatctgcaggagctgtggccttggaaaggaacatgccctctgataaactgtggctttgtcaggaagaagctagagaataaaagctagacatcattttgctcctggcctctaatcacctcctagtgcctctcattagccttgcccaaccagaagccagagaacaaaggaggctgccccatcgatgttctcctaggaccataggaggagagaaaggggatgtggagggacaaatggaaaatattcagccaatatttcttagctgcgccagccttttgctttgcaatttagtcttccttaccctcctctattttctttcattgggacaaacattatcaaggttaataagagataatggcccatgtaaaaagagtattgtattcttttatggactttatctaaaatttactcaaatataacagaatcctgtagatgaagcataatatgcaacagatatactttgcaatatttaaaaatgattaatctcaaaagtaatcatctcagtactatgactcattagctggaagaaaacagtaataacatgttttgtgcacagaacaattttaattaataagcaggacatatttattcaaaaattataataagacattattattctcagaacatgaactttgatggtaggtgttagcatcctgttgggtcccagagaatgcacttctggatattaaacatgatggctttgagacctcaaatatatcagcttgtacagtcagctattatctacactgacaattgtttatggctacaaatcacccacgcttgatgtgatatctgaaagtacctcagtaagatattatgagcaatatcaggagtgggtggtgtaaaagtcatttcagtaataaaacagtattcaaagagttgattcaaaaggcagagccattactaataaaaataatataggtagatatttgttaaatgttttctttcttttgaagggcaatactatgaaaggagagtgagcatagggaagttgtctgcaacctctgagccacacacctttctttggtctaccacatatctgtgcagccattaagaatgactctcatctcttgcctttccaaaatgaggtgtaagagaagtcattctggtatagacaggagatatgttaccaaaacagtccaatggacccttttagggatacttcagttagaagttttagctctgtgtgggttcagtgtctctccacattacccctgagacctaaatcccacagaaaatcttaaaggcaatagatgctagttttccttatacctttcaaaaatatgatttgttttgttttgttttgttttgttttgttttgacagagtctcgctctgtcgcccaggctggagtgcagtggtgcaatctcagctcactgcaacctctgcctcccgggttcaagcgattctcctacttcagccttcccagtagatgggattacaggcacatgccaccacgcacagctaatttttttatttttagtagagtcggggtttcatcatgttggccaagatggtcttgatctcttgacctcgtgatccacccacctcggcctcccaaggtgctgggattacaggcgtgagccaccgcacccagccgacaaaatatgaatttttaaagaccaaacacatcagaacaaaccagctaacttgacttttaaaaaccacttgatttcacacaggtctcagatggagcaaaagtaaaaaaaaaaaaattaaaaaataaagacatcccacttgaattctagacaaaattttatattatctaatggaaatgttttttaaaccacataaactgatgagacatatcctttatcctctgaaagaaagaagaaaaaaacaatatttactagctgaacaaaatgccttgagtgaaatatctgtgagcatacatttttaatttcctaagatgaaaacagttttgagcaaggagctctcaaaaaaatgtcctgatgttctcctaatacaccaagaaataaaatctgtcaaagtgctgagattcttataggttttggtacatgttcccagttgatttgatctggctccagatgaaacatattatttaagcaagatagtaatcaaggtaactaacaattttaaaaattacttcaaagcatatactaaggcttgactagtgtgtatttattctctttccattatttctagacggagaaacaatttcattatattttaagttgtatcgaagcatttgttctggaactttctgatgcattagcagattctacctttaatatagtcatatgtgtaggtgtattatcatgcctgctagaccagaagaagtgaaagcctgaattggttatcgcattcccttttggagattaaaaaatagcattacaactatctgtgttgcatttcaagctaaacccatactttcatataaattgtttcacttggtctacataataatcctgtgaggaaaacagggcagcaattactgccccatttcatggatgaggaaattggcttagaagagttaagtggcttactcaaaggcacatggctgagcagttatggacctctgactcataactaagcccagttcaagaaaacacgtatttattcagtgttttaaaattatcaccctaagtcttttgggttcaaggtagtatacatatggcagactaatgaacaaaaagaaaagtaacatttatacagtatttattatacaagagtccctctcataagaactttatagataatagggtcattatagatttatctcatttaaccccatagcgaccttgttaacagtgagataaatctgtaatgacccataacaaccttgttatgcagttaaataagataaatctataatgaccctatgtcattgtcacgtcacagatgaagccgccgaggcacaatgcagatgattaatttgtatagaatcactgacgcattttttaaagaaattaaacaattaattagtgtgtattcatactagttgtacatatttatgaggcaattttgattttagagtccatgttcttaaccactatacatatttgcctccagagattccaaaacttacggacatcttttcattatgctacacagtctcccatgagcagagtatgaaaaaaatccagatatgaggccgggagtggtggcttatgcctgtaatctcagcactatgaggggttggggcaggtggatcacttgaggtcaggagttcaagaccagcctagccaacaaggtgaaaccccgtctctactaaaaatacaaaaaatagctgggtgtgggggcacgtgcctgtaatcccatctactagggaggctgaagcaggagaatcgcttaaacccgggaggcggaggttacagtgagccaagatcgcaccactgcactccagcctggttgacagaggagactctgtcttaaaaaaaaaaaaaaatctgaatatgaatctaagcaaacatatacacacaaacaggcatacatacctagacaaactatatgtctatctctacatctacctatctatacatacaccttatgctgagggtcttgaatatgattgataatcacattctgtgtggctaattgcatttaggccaggactcaaaaaaaaaaacaaaacatgaaataaaccaaaataacctagatgagtgagaaattctaagtttgaattttaactggggaggaaaaaagataaagaaaacttcacagattggaggccacttatctccacatttaactttcaaaacctttctcaaaatatctttgtatttaaaagaatccatcagtctttgcaaagagaggagagaaaatagacttgaggaagatgtttccttctgtgtgctgtgtgactcaggacacatgcttcttctgtgcaatgctttaccatcatctgccaaagacgtgtgtgcaaatatcagtcttgcaaacagacaatatttgcactacattgaggctaacctgccatctgcttatcagatgttcggagtccaaattgtacagttttccttgtgtttcccctaatgaaaaatggaatgctggggctctgattacaagtgtctgtgcacaggactaatactacatccctaggtagagtaatggaaacagtgcatctaggggaaatggcttatatattgacattgtttaaagaaaacagaattattttctgtggctcaggttcacatgaaatataaacctcctagttcactaaagtgtgatatatttttctcaaaatttggagaaccactgatgttctggacaactgtatttcagtgttaggcctagccgaatatatcaactaaaaatgcaatcacagtgaaaaattctaatgatatgcattatttctgaataagcaaatgccagaagcacaatcccaacatattatgaatgatgtgattgactaccagggttgctcgcagcccatagcttcaggtaacacagctgtctcctcccattaatgagaaaagagatagcattttctgtttaaaattaataactgtaacactccaggattataggaaaaattctaagtgtttcacacaaagtgcttcacaaaattttactgaagttcaacaaaatcattatataacaaatacatatgagaaattcttctttatggcttattctattgaattgcctattcatttttgccttcccagaatccacaattttcagcaagatgaatatgagcagaaataaaaatgccctttctatttaataccccctgctttcaattaaaagaaaactggttagtcatttagtatcttagaatatttcttacttataatgaattaggcattaattatattcttctatataaccaaaacaattttttagcaatggacaacactattattttctaattcatgttactttttttaagcatgcctttgggcattggatcactatcagcaatgtgcagagaatatcatcatcctttgaaaagctgtactactgatgtactttacagataaatagtaaaaatgtttaatgtacacctaaaacacaattgaaataaatgccatttcaggaatttgaaagtgtgttgaggttaccaagattatctgtgatccttttcaaacagcaataatttactcaaaaggctgtcatgtctgcttacaagactgtgcagatagttgacatagatgaaattagtattaatatattcattttaatttctacccatttactgtcttactaagggtaatttaactcagaaatgccgtcataatagggtgataatctgataatccggggtgcagtggaggcagggaagaaaggaagaaaaaaggaaaaacaatgacaataaatggcacaggcaagaagaaagcaataatgtaataattactaccatgttttgttcaattatcaccgaaaaatccagaaagatatgaaaggtgagcaaaggttctaccatgtttttgtaaagaaataaaagctcactgaaatattagggagaaatggaatcaaaagtaccaatgaaaaaagcaaaaataagataatttaaaaagaaattagaataagaaaaaactaggaaataacgttctttacatgtgaataatttctttttggttgagttgtaaatcacatatctgttattcaaaaatatttcctgattcatttgaaaagaaaacatattgaaaagggatctaaacaaaggttgtttttttttcccctctttaaatgttgctacctcaaacaagctgtaatctgagtattaaagtacaaaacacttaggaaatataattttccatgattactttgagcttcctgtaagtgtaacagtttttttactacagttttcctctctaaagacagaaatgcaccgtatgggcgcaaggatgctcatgccatagcctatgctcaaaagaggattcttagtctacattccagattcagctggagtctatattaactgcatccattcttttaatgttggccatcttgtatgggttggatgtcccaagaagccacttaactatgggtgtgattgtctattcaagaacctagaaaaaatggtaaactggttacataacaaataacacatcttgatctaagttgagaggactggagtcttctagctatattatttgaaaaaatgcaatcatgatttagtgacaaattgaatagcaacttcattaaccagaatttgactgtaaacccatgcaccgtcctagccagtatctcttttctccggaagagaggcatgggaggaggggagagaaaaaggtgagctatactactttagagtcttatgctagttctgtgaggtaaatgtaactactatttcctttatttaacaaacaaaaaatgaggctcaaaaatttaaacaacttgtgccaaagtcacagaggtaagaaatactagggcaggaattgctcccatgtctgtgtacctttaaaattcactttgcagctgcacagctgataagtctgctcagaagatttaaattataagaggaaaaaatgccttgcatccctggcactgtgcctagttctttccccaaactgaaaatgatacttgcaattttttgagccctcaccatgtatctggatcatttcaattaatcttgacaatgctggtcaagggactattattagtctcattttgaagatgaagcttagagaggtaaaataacttgccccatatcctacagctggtgggagacagagatggcattctcaccagctctctctaaactccaaagcctgtgctcttcccatttattccattctgctttctctccaggagtcttcataataactctgagttcagcagctgttttcaatgaggatataggctcaaagcaaatacaacataaccggtacatggttagatttctaagcctcttgccattccgccttgtggacaaggacatcaaatacaatgaaaaatgggtgccccgcaaatcaatacatctgttctttaatacctgtgatcacagctgtgaaataggcttaatacacagcctgaaaatattgttgtgaaaataactgtgtgtttggctgttaagtaaagttcagctggacacatgatctagtaagaggtgctaggctgctgcatgcaaaggaattccattagaaaagacagagaggtatgggaggaaaccgagcacaaagcagtgtgtccattgatgagagaagtcactcccacttcgcccacagatggtggcattaataaagatatcttgtacaatccaatgatgtgaatctcaatcttcagcatggataagaatcactggggagcttgttaagaatacagttttagtgtcatctcacctaagattctgattcaattaagtctggggtggtgcccaggaacctgaattttataaacatcccagctggttttttaattattattactattggtttctactttattctaggtttagtggttacacatacaggcttgttacatgggcaaattgcgtgtcactaaggcttgatgtatgaatgagcccatcaccaaggtagtgagcatagtacataacaggtagccttccaatccatgcccccccaccaccctccccaatgaagcagtctccagagtctttgttcctatctttgtgtccatttatattcaatgttgagcttccaattataagcgaaaacatgtggaatgtggttgtctgttcctgcactagtttgcttaggataatgacctccagctacatttcatgttgctgcaaagaacatgatttcattcttttttatggctgtgcagtattccgtggtctatatgtaccacaatttctttatctggtccactgtcaatgggcatcttggttgatgccatgtctttgctattgtgaatagcattgtgatgaacatatgagtgcatgcatctttttggtagaatgatttattttcctttgggtgtatacccaatagtggaattgttgggccaaatgatagttctgtttcaagttctttgagaaatctccacactgctttccacagtggctgaactaacttatattcctaccagcagtgtataagcgttcccttttctctgcagcttaaacagcatctgttgtttcttaactttttaataatagctattctgactgatgtgagatagtatctcatagtttgaaatttaatttctctagtgattagtcataatgaacattttttcacgtatttgttggccacatgtatgtctttttttgagaagtgtctcttcttgtcctttgcccacttttaaatgcaattaatatatttttgcttactgatttaagttccttacagattctggataataggcctttgtcagatgcacagtttgctaatattttctcccattcagaaggttgtctgtttattctattgatagtttcttttattgtgcaaaagctctttaagttaattaggtccttcttgtcaatttttgtttttgttgcaattacttttgggaacttagtcataaattctttgcaaaggcccatgtccagaatggtatttcctaagttttcttctagggtttttattgttttagttctacttttaagtttttaacccatcttgagttaatttgggtatatggtgaaaggaaggggttcagtttcaatcttttgcatatggctagccagtgatcccagcaccatttattgactagagggtcccttccccattgcttgttatcgtcaactctgctaaaggacaggtggttgtaggtttgtggctttatctcagggttctctaacctgttctatcagtctgcctgtttttgtacctgaatcatgctgttttggttactgcagccttgtagtatagttttaagtcaggtagtgtaacgcctctggctttgttctttttgcttaggcttgctttggtgattcagtcttttctttgattccatatgaattttagaataactttttctaattctgtgaaaaatgtattggtactttgataggaatagcatctaatatgtaagttgcttttggcagtatggtcactttaacaattctgattcttcctatccatggaataggaagaatatttttccatgtgtttgcattgtctctgatttctctcagcattgttttgtaattctctttgcaaggttctttaaggtccttagtaagctgtattcctaggtattttattctttttgtagcttttgtaagtgacactgtgttcataatttcgttctgagcttggacattattggtgtatagaaatgctactgatttttactcatagattttatactctgaaactttactaaggtcatttatcagttctagaagccttctggcagaatctatggggttttctaagcagagtcatgttgtcttccaagagtgagttagacttcctctctatttggatgccttttatttctttgtcttacctgattactttggctaggatctcctttactatattgaataggaatggtgagtgtgggcatccttgtcttatttcacttctcaaggggaatgcttccagctttcacctaattgctatgatgttggctatgggtttgtcataaatagctcttaaaatttagagatatgttctattgatgcctaatttcttgagggttttcagcacgaaggaatgttcaactgtatcaaaggctatttctttgcctattgagataatgatgtggtttttgttggtaattctatttatatggtgaatcacatgtattgatttgcctatgttaaaccaacattgcatcccaggaataaaccctacttgatcaccgtaaattaactttttgatgtgctgttagattcagtttactagtacttcattgagaaaattttgcatctctgttcattggggatattggcctgatatttttctttctttttttttttttgtttgttgttgttgttgtgtctctgtcacattttggtatcagaatgatgctggcttcaaagaataagctagagaatcccttctcaaattttggaataatttcagtaggattagtactagctgttttttgtatgtctggtagaattcagctgtgaatccatctgctctaggcctttttttttttttggttggtaggctttttattactgattcaatttcagaactgattattggtctgttcaggattttaatttcttcccagttcttgggagggtgaatttccaggaatttatcaatttctttcagtttttctagtttgtgtgcatacagctgttcataatagtctctgaggattttttgtatttctttgagatcacctgtaaagtcacgtttttcatttctgattgtatttatttggttcttctccttttattaatctagttattaatttattatttccctaaatagtcacaaacctaatttgtcaagttatagctcagttgcattacaaaagaagttcttacatcaagtattacagaagaatcagtagtatttgcttgggcagtacatgccatcagattatgaatggattataaatgcaaactgacgtgtgacttttaaaataccatgatctatccaatttgaaagagaccattaaagtggagatttcaactcctaccactataactctaaagtatgatctttactttggcagaatattacagacttagaggtattgtttttatcacttggttttgtttttatccatagcaaagccttcaataatatttcaggccacagagaaaataatacaagtttttgcattgttgatacttcaaccaagatagtcattcttttaatgtaggtctgctggtgtcaaattattttattgttccttcatctccgagaatttcttgatttctcctttatttctgaagagtatttattactggatataggatcctgagttgacaaaattttttctttcagcacttcaaaactattgtaatttttgctggcttccctggtttccgatgagagatccagtgtcatctgaacgttcttttttccacagagaatgtgatatttatttctgactgctttaaacatttgtctttaattttcagaagtttgtctatggtgtgatttcatgtggatttctttgggcttatcatgtttggggtttgcattatagtcccatacatttctgaggttgtgttttgtttttgttttctttaaagtctattttgtccctgttgtttacattgtgtaatttctatttgtattatttttcaatggactggttcttttctctgtctcctctgttcagctattgagcccatatgttgactttttaaattattattttattggttaatatttttagttctaacatttctatttcattcttctttgatttctttgctgtaacattctatttttttattctcctttggtgacattcttcccctttgcttatttttatttttaatttttatggctacataattgtacatattaatggggtacatgtgctatcttgatatgagcatacaatgtataataaaatctaggtaatttgaatatcgattatctcaaacatttatcatttctttgtgttgggaacattccaaatcttctcttcaaccaattttgaaataggtgatattttttcatttgttcaaggatgtttatgattgttcattcatttttatgatggctactttgaaatctttgtaagataattctaacatcgctgtcatctattaaatgtatttttttattcagcttgagatcttcctggttcttgatatgacaagtgatgtttgaatgagatggagacattttggttattatgttaaaagactatggatcatatttaaaattctggatcacatttctgctttagttggcttcttctgaaactgctttggcagaggaagaagagggttgcctcattactgcctggtgagggtaatctttaggggtaaaagtggttctcagttacatggatgaattgtataatggtgaagtctaggatattagtgcatgcattatctgaatagtgcatattgtactcaataggtagtttttcatttttaccccctcaccccttttaagtcttcgatgtctattataccacttggtatgcctttgcatacccatagcttagctcccacttataagagagaaccttcagtatctcgttttcaattcctgagttacttcacttagaataatggcctctagttccaaccaagttgccacaaaatacattattccattctttttatggctgagtagtattccatgataacatacatcacattttctttatccactcatcagttaatggacatttaggttgactgcatatctttgcaattgtgaattgtgctgcaataaacatatgcacacaggcatctctttgatatattcattccttttcttttgggtagatacccagtagtgagattcctggatcaaatggtagatctacttttagctttgagaaatctccatactcttttccatagaggttgtactaatgtgtatttccaccagcagcatataagtgttcctctttcaccacgtccacccgagcatcttttggggatttttttttttgactttttaataatggttattctggctcgggtaaggtggtatacattgtggttttaatttgcatttccttgacaattagtgatgttgagcatttattcatatgtttttgaccatttgtatattttttgagaaatatctattcatgtcttttgtccacatttcagtttttaagttgtctgtttactgtaatgattatttattttgctgtgaagaagctttttagtttgagtcctattcattatttttgttttgttggatttgcttttaggggtcttagttataaattatttgcctatgctggtgtccagaagagtttttcctaggtactcttctagatcttttatggtttcaggtcttagcttcaggtctttaggtctttagtcaaggtaaagttaatttttgtatctagtgagagacagagatccactgtctttcttctacatgtgactatgcaatttttctagcaccctttattgaacagaatgtcctttccccgatttatgtttttgtatgttttatcaaagatcagttggttttaagtatttggctttatttctgagatctctattatattccattgatctacttttataccagtaccatgctgatttggttacgttagccttgtagtaaaatttcaagttaggtaatgtgatgcctccagatttgttcttttcgtttaggttgctttgactatttgggctattttttggttccatgtgaattttaggattgatttttctaattctgtaaaaaatagtgttggtaatttgatagaaattgcattgaatctgtagattgctttggagtgtatggtcattttcatgatattgattgttctaacccatgagcaaagaatgtatttccatttgcttttgtcatctacaatttctttcagccgtgttttatttttcttgtagagatactacacctccttggttaagtatgttctagcatattttatctttttgtagctactgtaaaagggattgagttttttatttgattttcagcttggttgttgttgatgtatagcagtgatactgatttatgcacactggttttgtaatgagattttgctgaattcatttatcagatctaggagtcttttggaagaatccttagggctttctagatataagattatatcattggcaaacaaagataatttgactccatgttttacaaatcgaatgccctttatttatttctcttgtctgattgctctggctaggattccctgtactatgttgaatagaagggataaaagtcagcatccttgtcttatttcagttaataggggaaatactttgaactttttctcattcagtatgatgttggctatgggtttggaatatacagctttaattatttagaggtatgtttcttctatgtctagtttgttgagggtttttatcataaagtcatgctggattttattgaatgctttttctgcatctatagaaatgatcatatatttatttaaaaaaattctgtttatctgatgaatcacatttattcccttgaatttgttaaaccatctctgcatccctaaagtgaaatccatgtgaatatagtggattatttttttgatgcgctgttggatttggtttgctactattttgttgagcatttttgcatctatattcatcagagatttggtctgtagttttctcttttttgttaagtctttcctttgctttggtaccagggtgatactgggcttgtagaatgtattagggaggattctcttcttctcaatcttttggaatagattcaatcgaattagtaccaattctttggatgtctggtagaatttggctgtgaattcatttggccttggactgtttttgtttgtttgcagtgttttggtttttgttgttgttgttgttgttgttgttgttgtttttctaaattactgattaaatctcactgcttcttattggcctcttcaggatttctagttcttcctgattcaagctagcgggggttgtatgtttccaggaattaattcatttcctctaaattttctagtttgtgtgcatagagctcttcacagtagtcccaaataatcttttgtatatctgtagtatcagttgtaatatctccattttcatttataattagtcttatttggatcttctctcttcttgtcttggttttaatctacctagtgttctaacaattttatctttttgaaggagctattttttgtttcattggtcctttggattttttttgtttcaattttatttagctctgctctgatctttattattccttttcttctgctagctttaggtatgtttttttcttatttctctggttccttcagatgtattgttaggctgtcaatttgtgatctttcagaattattgatgttggcattttgcactataaactttcctcttagctttgcttttgctgtatcccagaggttttgataacttgtgtcactgttgttattcatttcaaaaattttttaaatttccaccttaatgtcattgttaacccaaaaatcattcaggagtagattgtttaatttctatgtatttgcatagttttgagggttccttttggaatcgattcctagttttattttaccgtggtctgacaagaaacttaatatgattttgatttttaaaaatttattgaacttatttagtgacctatcatataatctatcttggagaatcttccatgtgctgatgagaagaatgtatattctgtagttcttgggtagaatgttctgtaaatatctgttaggctcattttttctagactgaaatttaagtctagtgtttctttgttgactttctgctttgatgatctctctagtgctgttagaggagtgttgatgactcccactattattgtgttactatgtattttcttttttagacctggtaggaattgccttatgaatctgtgagctctagagttcggtgcatataaatttagacatgttatatcttcttgttgaatttatcctattttaattacataatgaccttctttgtccttttttaatattgttgctctaaagtctattttatttgttttaagaatagctactcctgcttgcttttggtttccatttgcaagaaatgtcttttttcaccccattagcttgaatctataagaatctttacatgtgaggtatgtcttctgaagatagcaggtatctatttggcttgcaaatttttaaaatccattctgtcagtgtgcatctttttaaagtggagcatttagaccagttacattaaacattgagatgtgaggtgctgttctagtcatcatattgattgttacttagtgactttgttttcttcatattgttattgttttataagccctgtgaattttatgctttcaggagtatttattctggtgagtaacaacaacttgtttcaagatttagtattctatttagcacttctcatagagctggtttagtattgacaaattccttcaccatttacttgtctgagaaaaactatttctcctttatctatgaaagagttttgctggacacaaaattcttgaccaacagtcattctgttcaggagactaaagataggaccccaattccatctggcttataaggtttctgctgagaagtctgcagttagtttgattggttttctgttataggttacctgatgcttttattttactgctcttagaattttttccttcatgttgactttagatagcctgatgagtatatgccttagtgatgttttgtttttgcaatgagtctctcaggagttctttgaccttcttatatttggatatctatgtcactagcaagtccagggaagttttcctccctggaaattttcctcaaatagacttttgaaatttttgctacgtttttctccctcaggaatatctacaattcttatgtttggccattttatataatccacatatttcttgagactttccttcttcttttaattcttttttgtttacttttgctgtgctgattgggttaatttgaaagccttgtttttgagttctgaaattctttcttctgcttggtctaatctattttaaaagcttttcactgcattttgtagttgccgaaatgtgtagtctttcatagaagttctgattggctttcctttaaaatatccatctctttagaaaagttttcattcatgtcctgaattaaaaaaaattatgttggttttcaactttatgttaacttaataatcaacttttttgaattatttatctggtattttatgttggttttcaactttctcttatgtctccttgattaacataataatcaactttttgaactctttatctggtatttcaaagatttcatcttgatttggatccactgctggagagtcagtgtgattgatttttttgagttgtcatagaacaactcaaatgttttttatgtttccagaattgtttttatggttccttctcatttgtgtaggctatttcttctaattattttaaaattagtttttgattcaattgggtttaaaaaaattttcctccttgaagatgtgactttaacatttatagtttatttacacttagtttcagctctgggtggtttcaagtggcaaagactgtatgagtttcttggttatagagaatcattgtgaagtgtctttctcagatgccggttgtagtggcagtgggctgggtgtgtgagtaggttcactgtctcctaaggggctggaatggcagaggtctcatgaagcttattttgttccccagtggtgtgcacctttaaaagtttttcttccagcattttattcaacgggttgagtagttcaggcttcaggccagtaggaggtgcccacagataaacacaggttgtggctaaagcgggtgggtaaatgtaatatccaacgattggatgaagtcccagctttgacagaggcagctggcaaagctctccgtgaaatacactgaggtcttttcatggggaagtgaaggagccaccccagctctccttccaggcaaagcaggaaagcaatccacctcccagtcacactgctgacctggtgttctagcttttcagatcaaacaggtatctctttctatctgcaagaatgctgatgttccctctaaagaagggttgtagctctacctcttgtgtaagtctgaacctgtatggcacacttcctgtggatagttaccttggagtgttccagaaagtctgtctacagatgcatccatgctgagctcccatgagagaagccccagctctctgcagtgttgggtgaggggaaaaagaaatcaccttctcaaacctttcatgagcgctgtttgactgttggggtagagctgcagactttccccactgagcccagcactgcacttgtgtctctcccgaaagaaacttctcacaagtgggaagttaagggactcaaggcccatggtctgctttcttttataccatgggatgctcccttaatgtggttcactactctttccccaaaaaatagtagtccctgaaagccaggctattctgaattctactgctcctctaggtctagctgtccagtggggctgccacagttcaggctgtactggagaatatctgcaagggatccagtgatgtgaactgtcctctagtttcccagcaccaggtgccagcattacctctgatgggggtgggtggggagtgacacagactctgagattttcttggttataaatagctttagtgttttggttttctcaaatgccagctgtagtagtagtgtattgggcacatagacagactcaagacgtcctatttagctaaggtaatactggcaatggcaatagctgaggttgcataaaagtttttggcttcctgagtgctgggttattgtttatgcagatgttttaatgggctgtgccggttggcctccagccagtaggtcatggcttgtagaaaagcaccagctgtggaggtagtggtagaatttgtgcttgctttatgtcactcaggggaggtattcctgtgtctcaggtaggtaatgggtagggccatggagctcccaaacatccctgtatattgcactgtgctaccagggcaggtggaggggcaaagctgggtatgggctaggtcaggcaactccttgctctggctcctcacatgcaggcacaagcagcggccccagtgaggatcataagtcaattccttggctactggggtaatatttcagggagtagcacagctgcctctgttgcacagaagaatccgcatgggatgcaggggttagcaagcagcagtaagccccactcagctcccatgcacttggcaaggcatgtatcccactcataatgttcgctaaaagcagcaggctgggttccaggtagtctgtacgtagaactaaaaactgccccaggccataagccgtcccagtggagaccagtgaaaccacagctttcaggccgcaccccttctggtctacctgtgaagcaggagtgcccagctcctgcgcccatggctatagcaaacttactacttgcccctcatttctggccaacagggtttatcctcactcaaggttataatctcatatctcagatgggagcttctctcaacctgtgactgcagcttgagttagctggtagacttctgtgaggtcccctgtgaggtaggatcaggaatggcttccctctgtccttgctggagtgtgaaagtgcaggcaatgtgcatcctgataccgcttcttctcaccccatcactcgctaaatcagctccagcactgggtagtgttaagatctgcctccatggcctgaattgcccggctctccggtgggagtgtgtgtcacggtggcagtctctccccctctcacacactctggagactcacagttttccatctggttcacagtgtaggctgctgtttcttctttcaaagggtctgtagtttctttcagtttttctgttaagttcctgtgttgcttcttagaaagaagtgcacattgtgaatctctgcacactattttgtctttccaagtgggagaggcaggctaacaatgcctccaaaccactgggccattttaaataacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatattaaatttaaagatataaattccaacacacatagatataactacatatagccaatgaagccaccaatcttgtgacacttctttgtagaaaaagaaatttccatgttgtagcatattgcattttctaaaaatggccagactaatattatgtctcaacccacataatctccctaaaatgggtctacactctttccattgaatctgggtaagggcttgtgactgctcctaacccacagaaactataagagataataaatgattgttgtcttaagtcaccacattttgggatgatttattatgcaccattagatgacaggaacagctgtgtgttatctttgttatttgatcttttgaaatatagtttaacttggaaactgaagacaagtttattcctttatttaaaacatatttaatatgtgcttactgctctttttcattgtgataaaaaactttcattgagagagaaacatctcttaatattagtttgtcaggtgttagaatccaggacccctgccctggaattgttcatgagtccaagcagttgtaactgcatctagcaaataatggtctgctttgctgtctccttgttaaaagtacttcaaaatgtatgcaaaatatgtcttatagccagcaggcttctcattccttgctagggactctgtaaatgaaaaacaaaacaaaaaacccaaagctacagcagaacacatttgaaattatgaatacaaccataaaaatggcaattctaaggtaaggtttgagaatacagaacttatctgagcctgttgccttcttctgtgcaaaagaaccattatagataaacaggcagcagatagtcacaattcaatgccatgatatgtggataaaacgaaacaaaggtcgagaaattagcttacttccagatgttctttgggtcaggctcatctatccctaacttctcatatgaaagttaaactgccacagcctgaaataatagataattgaaattctcattttcttcagaaaattctgcaattaaaatgttgatatttctttaaaatacacacacacacacacacacacaaacacacacacacacacacacacacacaaaacctgatatcaaatcttacattccctccacccagaaaacatgactaggtcatttaaacagtacttgaatatattcacagaaaatcagcaggtcaggtagaaaattactcaccctacacaccagttgtgtgagtgttgcagagtatgaaccgctgccaagatatctgtcattggcatatctccacttttcaatttgatacaatgtgtttaacctatcactgttattcagtgtactataactgctatacaagcacctgtgtgtttaccagagctttactattcccttggctagaaatatttccaaacaaggtactaaatataaatgcccgccattttcaaaaatatatatatataataaacattctccaaatattttaaaagcctacagttaccaataagcttttgtgtacataaattagagaataaggggcaaagaaaactttattagcataccattaagtacttaatttattatttttgcagtgacatccttgcaggatttcttctttaacatgaaaaagtcaacatcttaactgttgaaggctctgctttagaatcctaggggcatttccagacaagttctagcgattattgtgaaagtacctgtttctagaccaactctttaagcagaccactaaaaagaccttttcaaatcttccatgtaaaggaaagccttgaaagggagagagctagatagatacatagatacacatatatagatagatgatggagatagatacagagaggtcagatgataacaaagatcagattataacaaacttaaatgtaggtgctccagctagctaacagagaataacaaatcatcacacagtttagtgacttaaaacaattatcacataatttacaatctaaacttgtaaatcttgtcaacagcaatcaggagtccacattatcctttaaaccaaattttatttccaagtagaaaatattttcttatttaattgtatactgatctgaattcaatgtatcttgtacatgaaaatagcaacttggctctgctgggtaactgaagaccatgtttgtgactggaagcatgttattaatctacttaaaatcttcattccttaataaaatctactccctgtcaacatttattttagaaactgaaatctttgtgagcatagctatattggcatcataagctctaaatggaagactacttaagggcatcttcttatttctagtagagttaatatcattactaaccccaactattctgatgaaataggtatctagcataaacatcaatcatcttcttttataactcattgataattccccatggtcccttgctctatttttcatctgttgtaacacataaaggggttcaacaactactttattctaagctttctctgctgcaaaccgaaggttactaattcacttcattaacaattacaagtatttgtatctgtcctcacaaattcaaaattgaccattttataaaagacatatcccttctcttcattctacctttgttaggtatatttttctatttccaaatatttattttatttccaaatcatgattcattcaaataagttttacacaaagaagaaagtacaagatgtgtaacagctctagtagagaacatttcagctgtgccacaaaaagaaaacagcaatataatggtgtgctgacaaaataggccaggcatggaggctcatgcctataatcccagcactttcagagaccaagacaggcagatcacttgagcctgggagttcgagaccagcctgggcaatatgacaagcccccgtctctgcaaaaaatacaaaaattagccaggcatggtggcacatgcctgtagtcctagctacttggcggggttaaggtgggaggattggttgagcttgggaggttgaggcttcagtaagccatgatcatgctactgcacactagcctgagtgacggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagttgtaagaaataatatagagacatcccttgcaaactttatccccgtcttacaaaatgttaccacatcatccccctgtggtaacattttgtaagactatattttcagggtcttgacactgatataactcactgatcttatttttctccagttttacttgtattaatttttcttagtgtggtatgggtgggtgtgcaataagtctatacaattttgtcacctgtgtaggttcatggattcaccaccgcagtcaagatgttgaacagttcccacaccacaagagtattcatgttgcctttttataactatatccatctccctccttcaaaatcccacatcctcctgctagctcagtgcccccacacaaccactaactattccccatttctaaattttattatttcaaaatgttttataagtggaattatatagtatgtaatcttttgggatttttttcataacataattcttggagatttattcaacctaaggtgtttatcaacagtttattcctttttattgctgagtagtattccatggtatatatgtacaatacaaatatgttctcccattctttagcttgtaattttattctcacatggttttcacaaagttagcattttacattttgatgaagtctaattcatcaattttttaaattcacacttcatgattgtggtatcaaggactctgcctagccctagatcccgaatattttttcctattttgttctaaacattttgtatttatattataattttttaatattttacctttgtctctgatccattttgagtttatttttgtgtacagtgtgagacttcgttcggaactcattttgctgcctataggtgtcaaattgctccaacaccatttgtggaaaatgctgtctttcttctattaaattggttttgcatctttgtcaaaaatgtgttgaatatacagatttttgtgtggggatatttatgggtcccctattccagggctccccaacccctgggccacagacaactaccagtctgtggcctatcagcaaccaagccacacagcaggattggtgagtgaactttactgcctgatctttgccttctgtcagatcagcggtggcattagattctcatacgagctccaaccctattgtgaacagcacatgcaagaaatctaggttgcacgtcctttatgagaatctaatgcctgatgatctgaggtggcacagtttcatcttgaaaacacccctgcctccactcactatccgtggaaaaattgtcttccatgaaactggtccctggtcccaaaaaggttggggatcgctgccctattctgttccattgatctatgtgtctatgctctggcaatgtcacaccactttgattattgcagctatagtgtaaaacttaatatcaggtagagtacttttccccactttatttacctctttttattatttaactatttttgctattcattgtaaatttagaccacatgcatttatatttccaaaaacttgccaggattttgaagaaattgcatataaatccttttgggaactataatgaaattaaagaaagaaacagaaatgttctaggataacagagcaaaggcagataaagttctggcattggaggaagactaataaactaatacaatatgaaaaaaattgatgtgaaaaaatagaatatccacttgaaccatacatgcggacgtgtggataggcatcagcattccagcacaacggatgggacagaaacaaaaaatgagattatagcacaaagagttaactttaactatgtagtcatcacagaatgttatgggagcaaaacaataactcagtcacagcaatagaagtgtcaattttattataatagtgctgaccttttttggggcaagtggaaggggtagggagtagaagactgtcaataaagacatgtctgtatggaaatacagacatcttttgttggtaatctgctaaaaccacatacttttaaaggtgaaagagagatgaaaatacattatgttattaaggtatactctaaattgccaggcaagattgagaaaagtgatgaggcttccctgatagagactccacaattagaaccaaagcagtacagagcagcaacctgagcttccatcattcactcactgggattcccatcaacatacagcatccttggcaagtcttgttcagatggaaaagcagtcacaagaggagtgctcttctaatcctgtgctaaccaatctaaaagcatttgtgactgaagtagtggaaactctgaacaaaattaccttgtaaattttagtttatagtagcccagatatgtggccatgctagattccaaaaacttcagagaaaaatgggtataattaatgacctcttattctgacactttgagagggtttgaaggctatcaataataattctgtgatctcaagcaaaaaagaaaaaaaaaaagaaaaagaatgcggctgcacctcagactccatgagaagcttatatgtaaatggacaaaattcagaagaaataagtgcctcgcacaggccttaacacacaagttgtgctcaatcatgtttggtaaaagaatgaatggacattgtaaaaccaaaaattaacatctaaagggttcatacactacaagccaggagagtcaaagtatatatcatctgttcatctaatcattccatcattaatttattatgagcttcttgctttcagggtcccatagtccagagtgaaaaagtgatatgcaaaccaaaaaatcaaaatacaggaaagtaactatgactaggtaattgtttaaaatactttgggaacaggcaggctggagttattaattaactatatttggggaaaagaagactacaaaagtcttcacaatgtagttaacatttaagtaattttgaagaatagcagagatagagagttataaaaattactcttttttttttttttcttgagacagagtcttgctctgtcgcctaggctggagtgcagtggtgtgaccttggctcactgcaagctccgcctcctgggttcaggccattctcctgcctcagcctcccgagtagctgggactacaggcacctgccaccacgcccagctaaattttttttttttttgtatttttagtagagagggcatttcaccttgttagccaggatggtctcgatcttctgacctcgtgatccacccgccttggtctccccaagtactgggattacaggcgtgagccaccgtgcccagccaaaaagaactctttatatatgtttttgaaaagaagaagaaaagagaagcatatgctatcaaaaaagaaattcagtgctggaatgataatgagctcagagcaaaagtaaagagataaactgcctatagattgtttggagagcttaagttgaaccctccctagccattcccaaagatgcaagccccctataaaaatttggagcacctaacactacaaagtttgaaagaatattatctttgatatgattcctccctgtctgttaacttccatgtttccatcccattggccctgcttttatgtatcctccattggcctaacagctctcaaccagaggttttaaaccctgacagctcattagcatcaccagaagaacttttacaaaagccttccacttgtgtcccttccccagggattctgattccactggtttggggtaagggaccctgtgttgcccacagcggctgatgcccatcaaaagggcattaggaaaatcactctgcgggaaatcactctggcccgccatggtgaatgagtgtttttaagaggattaaacaaacatcaaaaagaaaaaaattaatgtcatggagttccataccatcttaagacttaatgattcatatgccattacacagaaggaatttgcccaagatagctatgaattgtagccatgatctctaaaaaagagtcgaatatgcgaatcctacctaaagaccggggacaagtgatccttaattcatacaaacagtaatggggagacactaaaatgttttctgaagaacattgacaaattaagatttgcacattataagaaatattctagctacatacaagaaaaaatgattgtaaaaaaatcaaagatgattcccagacttttgtttgggaaaccagatgaacataaatacaattcatcgagaggtaatggagaaaaaagtacaggcgtggcagcggaattagatgaggacagaagttctcctttagatatgctgatttttgggtatatatattacatagtggtttatacacaggttggaaattcaggagaaaaatcattacagatgggagatgtgtatttgagatccatctgcatatagctgggttgttaaggcaaagaaatagataagcttgttctgggagggtgtgtagaattctctttaggagaagaatacctagggcagaatttaaaggaacgctaacataggcagtagaaaaacacccacaaagtagattcataggaaatggccagagaggtagaaggaaaatcaggagagtgtggcataataggtgccagaagaaaagagtgtttaaaggaggaatgattgaacaatacttgcaaacattgcaatgatttcagtggagaatgcgactgaagtttgattagagtgaattaaggagtagatgggaggtaaaataaaaagtagaaataagaattagaaaaggtttataaagatggtggaagagaactttccagtgcttatccccacagagaaacattaatttgaacaaatatccatgcacaaacaaaagttcacaagagctaaagaaaccatgtgagagattacagaagctgagtggagcacagaaataagaaagacacactgataaaggtaagaaggacagttttaaatcacctgtgaagccgcttcacaaactgtatacagcacggacacagacagcagcaatacccaacccttacgggaaggaaagtgagcaccaaacttactgtggaacccaacactgggcctgctccagcaaaacccaacttcacgcaggcacctatggccccagactccaggctgatacctgcagactaagcttccaggcccacctggattctaggatagctcccacagccctgggatccatgcctgctcaatagactcaatctctgggcctgccccactgccaggctgaccccagcagccctaggctcgggaacagccccagtatcaggcaagccctaccagccctggcccttggtcagaaccagacatcacagatgtaggcataagcctgacccaggaccaggcctgacacaggccagcaccttgggacccagcctccaggttaagccccacagactcgggcttcaggcttaccccaggtttcagacaagccggaagctaaaacatcccatgcagtcccaggcctcaggccccaacaccagattagcactcctggtctcaatagcaggggactcaaatatcccactttcagcaatgaaaaaattatccagaaaaaatatcaataagtaaacatcagattaaaactacactttagaccaaatagacccaacagacatatacagaacattcccattaagcagcagcagaatatacttttttctcaaacacacacagaacattcttcagggtagatcatatgttaggtcattcacaagagcttaagaacccatgtgggagattacagaacccgggtgtagcacagaaatattggcaaaacaagtcttaacaaatttgaaaagatgtaatcatattaagtattttttctgatcataatggtaagaaattagaaatcagttaactggaaaaatttcaaaaacttcacaaatatatgaaacttaaacaatatgctctttaacaaccaacgaatcaaagaagaaagtaaaagagaaattaaaaactattttgagataagtgaaaagagagacacaaaacagcaaaactcatgatgtgtccggaattggtgggttcttggtctcgctgacttcaagaatgaagccgcggaccctcacgatgaatgttacagtttttaaagatggtgtgtccggagttcattccttcagatgttcagatgtgtccagagtttattccttctggtgggttcgtggtctcgctggcttcaggaatgaagctgcagaccttcctggtgagtgtcacagctcttaaaggcggcgcatctggagttgttccttcctcccgtccagagttgttcatccctcctggtgggtttgtggtctcgctggcttcaggagtgaagctgcagaccttcacagtgagtgttacagctcataaaggcggtgcagacccaaagcagacccaaagcttccacaaagaacaaggcttccacagcctggaaggaaaccccaacacgttgccaccgctggctcgggcagcctccttttattcccttatctgaccccacccacatcctgttgattggcccattttacagagagctgattggtctgttttcacagggtgctgattggtgcatttacaatcctttagctagacacaaaagttctggaagtccccactagattagctagacacagagcactgattggtacatttacaaaccgtgagctagacaaagagtgctgatcagtgtgtttacaatcctttagctagacacagagtgctgattggtgcatttaaaatcctctagctagacataaaagttctccaagtccccaccagattagctagatatggagtgctgattggtgcatccacaaaccctgagctagaagcagagtgctgattgggtgcatatacaatcctccagctagacaaaaaagttctccaagtccccacctgactcaggagcccagctggcttcctctagtggatcacgtgcaggatccctgggctgagctgcctgccagtcccacaccaagtgccgcactcctcagcccttggggggtcaatgggactgggcgccgcagagaagggggcagcgcccatcggggaggctcgggccttgcgtggggaggggggttggggggcagtgctcctgcatggcaggctaagggtcccaagccctgccctgctgggagacggctgaggccctgagagaattccagcgcagtgcccgccggccggcactgctgggggacccagcgcaccctctgcacctgctggcccgggtgctaagcccctcactgctcggggcctgctgtgctggcctgcggctccgagtgcggggccagccaagcccacgcccacccagaacccgcattggccggttcccacccgcgcctctccctctacacctccccacaaggaaagggagccggctcctgcctcggccagcccagagaggggctcccacagtgcaacggctaaaaggctcctcaaatggtggccagagtagatgccaaggccaaggaggcaccgagagcgagcaagggctgctagcacgttgtcacctctcaatgagatgcagcaaaagcagttctaagatagaagtttatagcaatagacacccataataaaaaggaagatcccaaataaacaaatgttacacctcaaggaactaaaaaaaaaaaaaaaaaaaaaactaagcccaaagttagcagaagaaaggaaataataaaaatcagagcagaaataaatgaaatagtgactgagaaaatgatagaaaaaaaatcaacaaaagtggctttttggaagttaatcaaaatggacaaatctttaagtagactaataaaaaagagaaagactcaaataacattatgaatgaaggaggggacattacaactgataccacagtaatgcaaaagagtataagacactattatgaataattatatttcaataattgaataacctagaagaaatgggtaaatttctagagatatcacccacccagattgaatcaaaagaaagagaaaatccaaacaaactcataatgagtaagaagattaaatcagtaataaaaagtctccaatcaaagaaaacccaggaccagatggcttcactgcttaattttatcaaacatttaaagaagaattaattccaatccttctcaaactcttctgaaaaacattgaagaagaaatacttccaaactaatttcatgaggttagcattaccaccataccaaatccataaaaggacactacaaaaaaataaaattacatgccaatattcctggtgaacatagatacaaatatcctcaacaaaatactagcaaaccaaattcatcagtatatttaaaggaacatttatcatgatcaagtaggatttattccagagatgcaggtatggttgaatataagctaatctagaaatgtgatacaccacattaacagaataaaggacagaaaaatatgatcatgtccatggatgaaaaaagcatttaacaaaattcaatatccttttgcaataaaaattatcaaaaaattagatatacaaggaacataccttaacacagtaaattccatatatgacaaatccatggctaatatcatactggatgcctctaagattaggaataagacaaggattcccgttcttttcggttctgtctaactaaagtgctgtaagtcccagccagagcaattaggcaaaagaaaaataaatggcatccagattggaaaagaggaagtcaaattgcccctctttgcagatcacatgatcttataaatagaaaaaattagtgacctcactaaactactcttaaaactgatacattcagaaagttgcaggatacaacatcaacatacaaaaatcagtagtatttctacagactaacaacaaactctccaaaaaagaaatcaagaaaactatcccatttataatagctacaaaagcaataaaatacgcagaaataaatttaaacgaggtaaaagacctgtggattgaaaactctgatacattgataaaagaaattgaagaagacacaagtagagttatcccatgttcaatgattaaaagagtttatattgtttaaaatgtctgtattattccaagcaatctacatattcaatgtaatctgtattaaaatgccaatgtcacttttcatagcaatagaaaaaaaatcctaaaattcatatgcaagcacaaaagatgctgaatagccaaagcaatcttgagccaaaataacacaatcagaggtatcacattctccaatttcaaaatatactacaaagctatagtaatcaaaacagtgtggtactggcataaaaacgtacacaaagaccaatggaatggaatagacagtccaaaaatgaacccatgtatatatgatcaactaatctctgatgagggtgccaagaatagaaaatgtggaaaagataagtctcttcaataaattttgttggggaaaatggatatctacatgcagaagatgaaattagacccttttcacacaccatatgtaaaaatcaactcaaaatggattaaagatgtaaatcaagcaatacctgaaactgtaaaactgctagaagaaaacatagaggaaaatctccatgacataagtctgggcaatgattttttggatatgatctcaaaagaaaaggcaacaaaagtgaaaatagacaaatgggattacattatgctaaaaagtttcttcacagccaaggaaataattaacagagtgaagagacaacctatggaatggaagaaaatattgtaaaccatatatctgataaggagttaataccaaaaatgtatgtgaaactcctcaatagaaaaaaacccaaataacccaattaaaaaaataggcaaaatatctgaataaacatttctccaaagaagtcatgcacactggccaacatgtatatgaaaaactgttcaacttcactaaccattaaggaaatgtaaattaaaactgcaatgagctatatcaccttatacctgttacaatggctattatcaaaaggaccaaagataagtattggagaggatgtggaggaaagggaactcttgtacactcctggtgggaatggaaattagtacagccatatggaaaataatatagaggtttttcagaaaattttgaaaataccactacaatatgatcttgtaatctcacttctggatatatgtccaaatggtatgaaattagtatgtcaaagagattgcctgcattcccatgttcctcacagcattattcacaatagccaaaatatggaatcaaactaaatgtttgtcaacatatgaatggctaaagaaaatatggcatatacacacaataaaataccatttggtcttaaataagaaggaaatcctgtcatttgagatgacatggatccacctgagggacattagtaagtgaaataagacaggctttaccacatgatctaacttacatgtgaaatctaaaaaggttgaaatcatagaagcaaagagtggaacagtggttaacatgggctgtgggatggggtggagttggggaaataatggtcaaaggatacaacattgcagctggataagatgaacatgttcaagagatctattgtacaacccggtgagtggagttaatagaactgtattcctgaaaattgcttagaaagtattttgtgttcttaccacaaaaaaatgttaactatgtgaagtaatgcatgttaattatctggattcagcctttccacaatgtatacatattttaaaacatcatgtggtacatgataaataaacacaattttatttgtcatttaaaaaattacttaaggtttagaaagtagaaattagaatagttacctctttaaagatatttgcacaattaaaaagatttttcatgtttcttttttgaaaagtaacatatatacaatctagtactaaaccttaacagatagttattattttaagacgacagaaatgtgaacattttacttctgatgaagagaatctataagagagaaagatggtgatgctaaacaaatgagaaattataattattaaaatacaacaaggtatctgggatagaagcaagacaggtggaaagattcactcatgctttgccctgccaggagggaatattccagtataatgggcagaaaggaagaaaacatggaatgaatgcagtatgattaaaagtctggtgataggataaggatgcatctctagtctagtggcttcaattttctcagcaaagtaggaggacaattctgatagtaaggaaggaatggcaggattttaggtttgagagggtgaagcgggtgaaagcactgcagagacactgagggagataactaggaattacagaagaattgccaaagagcattgaagtctcaaaactcatcttaagttggataagtacacaattttaggagcagtgataggtaaatggcagaaagtatatacaagtattaagtaacttcaggctcaattccatccaccgaaatgttgggacttacagaaaagcagattcaatatggaagacgtggctcatatctgtcataggaataacagaagaagtagtagtaaacgtttattgagtacttactgaatcttctgtttaaatgttttacataaattttagtacacggccagtaaatagtgttattattttcagtgttctaatgagaaaaccacagcacaaagaagttgagtaattttcccaaggtcaaccagctacaaagtgcagagttttaaacagtgaatccaatgcatgtccagagaaaagtgagcaggacagcaaaggatctctgcaatataaggaagaattagataattgaggatattttgcctaaataagacaggcagcagcaaataacgattgcttcaatacttaagtagttgctatatggaaaaggaattagagttttacattatgtttcttcagggagcaaaactaaaactaatatgcagaagctgcaatgaagtagatttcatctggaaagaatgatttttgtagccatgagaaatacaggtgaagtagaaggagcagcttcagaaagtgaagttccagtgaccaaggagtttgagcccagaaagggatgttaggaaggactttatacataggtgagagaggacttgctagtttatgtaaagttcaacacccattctaacactgaaagtctgcctctagtgtgcattttattaaccccaataaacatttacttttttattttctccccagagtaagcatgttggcagatacatgaagcacttggatccatgtcatgacaatatttggatataacagataagacataatgctttgccaggactgctagacctgggctttcaattgcttccagggctataataaattcagatgttgggggaagagagaggaaaggagagagtgctttttgttgttgttttttgtttttgtttttgttttttgcaatgtagccccttcccaagagtaagaaaaaatattcttctgacaattgtaaagctgtttcctgccaaaattgtcattgttaaaacttttaaaagataatccatatgtccccacacttcatactcttgcactttcatgcaaagagctcaaataagaaaatttgaagtttttctctgagtagaggtcagtgtttctgatgcagtgccagttttaatgagaagattttattttctctctctcttaagagaatggcacgaggaagctacatgttaagaagttaagatggtctctacttggacctgatgctaaaagaaggttcatgccatattttatttgacattgtaatcttgatttggctgcccaatttattgaaaagattaatattctctacaggttttagatagcaaattttaagttttgatcctgacttgccttagagagcctttctttataaagcagctctcgttctttaatcttatagcaaccttactgtgttcttgctcctgttcttcaatgtggtattgtttgtttacctgtttgtgta

SEQ ID NO: 887 - DNA, 225473 bp, Homo sapiens
atctgtgaaatatttttaaagaatgttcaacctgttaatatccagttagagcaaggatgtagaaaaactagtacaatattaaattaataaaaatatatcaaagcaaggaaaagtttgtgttttgatctagtaacttcattttttggaattcgtaaaataattctggatattgagaaatactttattgaagtatggtatttaataataaaaaacaaatttagaacaataaaaggttaagaaaaatataatttattcagttaatggtatagtttaaaatcttaaaagtgattgttacaaaactaaattgtatcaaaagctaacctactcatccagaagaaagccacaattaaattgcaacatgaaacaatacttttagtatacaaatattatggcactaaaacagcgatacgcattttttaaaattattattatactttaagttctgggatacgccaggtgcggtggctcacgcctgtaatcccaacactttgggaagccaaggcaggtggatcacgaggtcaggagatcaataccatcctggctaacacagtgaaaccccatctctactaaaaatacaaaaaattagccgggcgtagtggtggcaggtgcctgtagttccagctacttgggaggctgaggaaggagaatggcatgaacccgggaggtggagcttgcagtgagcagagattgcgccactgcactccagcctgggtgacagagcgagaccatctcacagaaaaaaaaaaaaaaaaagttctggtatacatgtgcagaacatgcagctttgttacataggcatacttgtgacatggttgtttgatgcacccatcaactcatcatctacatcaggtatttctcctaatgctatccctacccttgcccccaacccccaacagggtatgtgatgttcctttccctgtgcccatatgttctcattgttcaattcccatttattagtgagaacatagggtgtttggttttctgttcctttgttagtttgctgagaatgatggtttccagcttcatccatgtccctgcaaaggacagcaactcatccttttttatggctgcatagtattctatggtgtatatgtgccacattttcttgagccagtctatcattgatgggcatttgggttggttccaagtctttgctattgtgaatagtactgcaataaaaatatgtgtacatgtgtttttatagtagaatgatttatgatcctttgggtatatacccactaatgggattgctgggtcaaatggcatttctggttttagatccctgaggaattgccacattgtcttccacaatggttgaactaatttacactcccaccaacagtataaaagtgttcctatttctccacatcctttccaccgtctgttgtttcctgactttttaatgattgccattctaactggcatgaaatggtatctcattgtgggtttgatttgcatttctctaatgatcagtgataacaagctttttttcatgtttgttggctgcataaatgtcttcttttgagaagtgtctgttcatatcctttgcccactttttgatggggttgtttttctcttgtaaattcatttaagttctttatagattctggatattagccctttgtcaaatggatagattgcaaaaattttctcccattctgtaggttgcctgtttcctctgatggtagtttctttcaccgtgcagaagctctttagtttaattagatcccatttgtcaattttggcttttgttgccattgctttggtgttttagtcatgaagtccttgcccatgcctatgtcctgaatggtactgcctaggttttcttctagggcttttatggttttaggtcttacctttaagtctttaatttatcttgagttaatgtttgtattaggtgtaaggaaggaatccagtttcagttttctgcacatggctagccagttttcccaacagcttttattaaatagggaatcttttccccattgcttgtttgtgtcaggtttgtcaaagatcagatggctgtagatgtgtggtgttatttctgaggcctctgttctgttccattggtctatatatctgttttggtaacagtatcatgctgtttttgttactgcagccttgtagtgtagtttgaagacaggtagcattatgcctccagctttgttctttttgcttaggattgtcttggctatatgggctcttttttggttccatatgaactttaaagtagtttttttctaattctgtgaaaaaagtcaatggttgcttaatgggaatagcattgaatctataaattaccctgggcagtatggccattttcaagatattgattcttcctatctgtgagcatggaatgattttctgtttgtttgtgttgtctctgatttccttgagcagtggtttgtagttccccttgaagaggtccttcacatcccttgtaacttgtatttctaggtattttattctctttctagcaattgtgaataggagttctctcatgatttggctctctgtttgtctattataggtgtataggaatgcttgagatttttgcacattgattttgtatcctgagactctgctgaagttgcttatcagcctaaggagattttggggctgagatgacagggttttctagatatacaatcatgtcatctgcaaacagagacaatttgacctcctctcctcccacttgaatatactttatttctatctcttgcctgattgccctggccagaacttccaatactatgttgaataggagtagtgagagagggcatccttgcctgtgctggttttcaaagggaatgcttccagcttttacccattcagtataatattggctgtgagtttgtcatatatagctcttattattttgagatatgttccatcaatacctaatttattgagagtttttagcatgaaggggtgttgaattttatcaaaggccttttttgcatctattgagataatcatgtgtttttttttcattggttctgtttatgtgatggattccatttattgatttgcttatgttgaaccatccttgcatcctggggtgaagctgacttgattgtggtggataagctttttgatgtgctgctggattcagttttccagtattttattgagaattttcacatcgatgttcatcacggatattggcctgaaattttcttttttttgttgtgtttctgccaggttttggtatcaggatgatgctggcctcataaaatgagttattttatgataatttcttttctattgtttgaaatagtttcagaaggaatggaaccagctcttctttgtacctctgatagaatttggctgtgaatctgtctggtcctgggcttttttttggttggtaagctattaattactgcctcaatttcagatcttgttattgttctgttcagagattcgactttttcctggtttagtcttgggagggtgtatgtgtccaggaatttatccatttcttccagattttctagtttatttgcatagaggtgtttatagtattctctgatggtagtttgtatttctatagtattctctgatggtagtttgtatttctgtgggatcagtggtgatatcccctttatcattttttattgtgtctatttgattcttctctcttttcttctttattagtctggctagtggtctatctgttttgttgatgttttcaaaaaaccagctcctggattcattgattttttgaaaggttttttgtgtctctatctccttcagttctgctctgatcttagttatttcttgtctcctgttagcttttgaatttgtttgctattgcttctctagttcttttcattgtgatgttagggcgtcaaatttagatctttcctgctttctcctgtgggcacttagtgctataaatttccctctaaacactgctttagctgtgtcccagagattctggtatgttgtgtctttgttcttattggtttcaaagaacttatttatttctgccttaatttatttacccaatagtcattcaggagcaggttgttcagtttccatgtagttgtgcggttttgagtgagtttcttaatcctgagttctaatttgattgcactgtggtctgagatactgtttgttattatttccatttatttgcatttgctgaggagtgttttactttcaattatgtggtcaattttagaataagtatgatttggtgctgagaagaatgtatattctgttgatttgaggtggagagtttggtagatgtctattaggtctgctcggacctgagctgagttcacatcctgaatatccttgttaattttctgtctcgtttatctgtctaatatgacagtggggtgtaaaagtctcccactattattgttttggagtctaagtctttttttaggtctctaagaacttgctttatgaatctggatgctcctgtattgtgtgcacatatatttaagatatttaactcttcttgttgcattgatccctctaccattatgtaatgcccttctttgtcttttttatctttgttggtttaaagtctgggttatcagagactaggactacaatccctgctttttttttttttttttttttttttgctttctatttgcttggtaaatctttctcaatcccactatttttagcctttgtttgtctttgcatgtgagataagtctcctgaatacaggacacctatgggtcttgactctttatccaatttgtcagtctgtgtcttttaattggggcatttagtcaatttacacttaaagttattgttacatgtgaatttgatcctgtcatcatgatgctagctggttattttgcccattaattgatgcagcttcttcacagtgccgatggtctttacaatttgatatgtttttgcagtggctggtaccagtttttccttgccatgtttagtgctttcttcaggagctcttgtaaggcagacctggtggtgacaaaatctctcagcatttgcttgtctgtaaaggattttatttctccttcacttatgaagcttagtttggctggataaaaaattttgggttgaaaattcttttctttaagaatgttgaatatcagcccccaccctcttctggcttgtagggtttctgccaagagatcccctgttagtctgatgtgcttctctttatgggtaaccccacgtttctctctggctgctcttaacattttttccttcatttcaaccttggtgaatctgacaattatgtgtcttggggttgctcttctcaaggattatctttgtggtgttctctgtatttcctaaatttgaatgttggcctgccttgctaggttggggaagttctcctggataacatcctgaagcgtgttttccaacttggttccaatctccctgttactttcaggtacaccaatcaaaaaagtttggtcttttcacatagtctcatatttcttggaggctttgttaattccttttcattcttttttctctaatcttgtctttatgctttatttcattaagttgatcttcaatctctgatatcctttcttccacttgatggatttggctattgatacttgtgtatgcttcacaaagttctcatgctgtgtttttcagctccttcaggtcatttatgttcttctctaaactgcttattccagttagcagttcctagggagacctaggggaatcttttatcaaggttcttagcttccttgcatttggttagaacatgcttcttttgctcagaggagtttgttattacccaccttccgaagcctacttctgtcaattcatcaaactcattctctgtctaattttgttcccttgctggcgaggagttgtgatcctttggaagagacattctggtttttggaattttcagcctttttgagctgctttttcctcatctttgtggatttatctacctttggtctttgacgttggtgatctttggatggggtttttgcgtgggtgtcctttttgttgatgttgatgctattgctttctgtttgttagttttccttctaacagtcaggcccctcttctgcaggtctgctggagtttgctggaggtccactccagaccgtttgcctacgtatcaccagtggaggctgcagaacagcaaagagtgctgcctgctccttcctctggaagctttattccagaggggcacctgccagatgccagccagagctctcctgtatgagatgtctgttgacccctgctgggaggtgtttcctagtcaggaggcaccgggttcagggacccacttgaggaggcagtctgtcccttagcagagctcaagctctgtgctgggagatccactgctgtcttcagagccagtagacagaaacgtttaagtctggtgaagctgtgctcacagctgccccttcccccaggtgctctgtcccagggagttgagagttttatttataagcccctgactgtggcttctgcctttctttcagagatgccctgcccagaaaggaggaatctagagaggcagtctggctacagaggctttgctgcactttggtgggccccacccagtttgaacttccaggtggctttgtttacactgtgaggggaaaactgcctactcaagcctcagtaatggtggatgcctctcacccacaccaagctggagcatcccaggtcaacttcagactcctgtgctgacagcgagaatttcaagccatggagcttgttgggctccatgggggtgggatccgctgagctagaccacttgactccctggcttcagccccctttccagcggagtaaatggttctgtcttgctagcattccaggtaccactgaggtatgaaaaaaactcctgcagctaggtcagtgtctgcccaaacagctgcccagtttcgtgcttgaaatctagggccctgggagtgtaggcacccaaaggaatctcctgatctgtaggttgcaaagaccatgggaaaagcaaagtatatgggccagagtgcactgttcctcaaggcacagtccctcatggcttcccttggctaggggagggagttacctgaccccttacacttcccgggtgaggtgatgccccaccctgcttcgggtcaccctccatgggctgcacccactgtgtaaccagtcccaatgagatgagtcaggtacctcagttggaaatgcagaaatcacccaccttctgcattgatctccctgggagctgaagaccggagctgttcctattcagccatcttctattcctcatgatacacatttttaatataatggttgtaatctaattataactttataagataaaatacttataaagaaatacttcataaagtacaatatatcaaatagtactatttgtatttgtataatgagattataaatttatattttctaatctttttcttaaaaaaaggatactatttacatcatcacaacaatgaccctatgaagaacacacattaaaaaagctgataggttagcatgataaaaaataaagatttgaattttaatcacaaattttgtagagagtagttgttacctgaggattatgatacagaggttagcatgtgcatatttctgtagattttggttttcagattctctgacttgtgatctcaaagattccttatgataaataaaataattaagcaaatgaaaaatgaagcaaataaaaatggtaatataactttttacatagcatgtatgttacacattagatatagcataatagactatttcagaggaatatccggctaataaatcaaaatagtaattatataaatggtttaaattaggtcactggagggaaaaataaaaatcacaaaatagattcatttttacctcaacaataaacgagttcatcaatatgttacactaggttatgaaggactattagatcatatataagggctgtttataaaatgtcaacaaaaaaatcaaatcacaggtttttagaagtagaagctggtcaatacctcaaagaaaatctgtattacaactgaaataagaattaatattcttcccattaaatcacaaagcctttttatttcattcctataaaatcacatgaatgtgtaattgaatatcacaatcctttataacctcaggcaagcttcttaatgtctcagaaccatactctgttatcagtttctcatattgatagcatttatgttattgccagcttgggctattaaaacagtattccaataaatattattgttcacatagcttttgcaattatatctccactttagatatttgaaggtgaaattaatgcgagccaaaatgggctcaatgtgactgtcaggaaaaatgatatctttgtaatataatcaatttttctttgattattagtacagttgagcatatatatgtttatttatataaatcagggcatttcttaatatattcattttctatttcagatttgcctatttttctagtgaaatttttttattgatttgtaatattttgtatataaaacctgaaacactttaaacaccatatgtgctatatgcatggtattttctctgtgtctgcagcttatcttttcacttaatgtttatgttatcttcttcatatcaagttttaaatgctgacaaaataaaatctgtcaaattttccttagggcctcaagctcttacgatgatcaaaatgaccaatctttagtgacttttgtaactatacactacccatctgactccagattatatgcttttaaccacttcactattcttgtttgaaacttgagaatagggtagtagttaaaagcatcaaatctggagccagattatgtaggtttaaatcctggggcaccctcatctgactagctctacgacatgaaatgagttactcaactttcctgtgtacagtttcttgtttatcagttgagtaaatataattaaagagattagattagggcctggcacacaataagtgctaaataaacatttgttattatttgttccctccaaacatgtctgtttctctaagtagatgtttttgtataaattccaacaatgtgatgtttatatcaagattttattccatttttctcatttattaataactgtaagtgagttcctactatgtacttctctggcaccaagccaggcacaaaaaacagagtaattaataaatattagggttgggtgccatggctcacacctgtagtctcaacacctgggaggccaaggtgggagcattgtttgaggccaggagtttgagaccagacttagcaacacagcaagaccctgtctttacaaaatatttaatcattttaaaataattttaaaaaatcaacactaatggttgcttttctgatggtgcttgctgtctaatacaagaaagtaaaattgtaatgtgacaattgacagaaaagaaagataaaaatgttatgatagattgatctgttcaagactggtaagttgctttcctgaagaaataatgcttaaattgaaatataaggaataaataaaaatttctctggagaaaagggaaaggaagttcatttgtacaaatttagcaaggtaaaattaataaaattacattttcaatttattttgaaattagccttgcaaatacgaagtaatttttaagcaaaagttctaaatattgctttgctattccaagactaaataattaagaactcttccaattccagttatttgtgtgaattacataatgcaaacatttgtaaagaacagattgcttttagaaagtctgatcttgaatttatttttcttcgtttactctcttgcagacatatccattgtatgctttcaaaacattcttatatttttccagaatataaaaacactgtgtgcaaatgttcaatatacatgtagctggaaatagataacatttgggtggatggcaatctaatgtatacaaagagtagattcacagctgtgtatttgccagattagaaataaggctagacttctgatttctggagaattttggtaaagcaaaatataagagaaagaggtttagacttgttcagtgctatctaaaatagaaactcttgcagaaaaagaattacatttacttaatccatcctttccataattattcacactgaaactactgaaatagtatgtaaaatattaatagtacattgtttgaaaacctatacagtcaaccctctttctcctggggttctgcatccatggctgcttctgtattgaacacgtacagacatttttcttgtaactatttcctaaaaaatatagtataactatttacacagcatttacagtatattagttattataagtaaccctgtagcaatttaaagtatacagggagatatgcataggttatatgccaatagtacactattttatataaggaacttgaacatccatggattttggcatctgcagaaggtcctggaaccaaccccccatggataccgagggatggctgtataatatggattaggtttttttttcctaaagttcttcaaaagctcttgacctcaagctttttaaataaaacctacataaaatattctcaattaaaataactgtaaatatattttggagcagtacaaattgcttggcattttacttttaaaacctaaaggctgaattctatgttaatagattacaacataaaacagattcacttatatgaaacaagcaagttttttctcatattgtttgcaccaaagaaagttgcattgatgaatagaaaaaaaatagctttattcccctacttcctcaacacaataagaatgaaagacaactaaaattaaacttgtggtggagccaagatggccgaataggaacagctccggtctacagctcccagcgtgagtgacgcagaagatgggtgatttctgcatttccatctgaggtactgggttcatctcactagggagtgccagacagtgggtgcaggacagtgggtgcagtgcaccatgcacgagccaaagcagggtgaggcactgcctcactcgggaagcgcaaggggtcagggggttccctttcctagtcaaagaaaggggtgacagacgtcacgtggaaaatcaggtcactcccaccctaatactgcacttttccaatgggcttaaaaaacagcacaccaggagattatatcccgcatatggctcagagggtcctatgcccacagagtctcactgattgctagcacggcagtctgagatcaaactgcaaggccacagggaggctgggggaggggcgcctgtcattgcccaggcttgattaggtaaacaaagcagcggggaagctcgaactgggtggagcccaccacagctcaaggaggcctgcctgcctctgtaggctccacctctgggggcagggcatagacaaacaaaaagacagcagtaacctctgcagacttaaatgtccctgtctgacagctttgaagagagtaatggttctcccagcacgcagctggagatctgagaacaggcagactgcctccttaagtgggtgtctgacccccgagcagcctaactgggaggcgccccccagtaggggcagactgacacctcacacggccgggtattcctctgggacaaagcttccagaggaacgatcaggcagcagcatttgcgggtcaccaaaatccgctgttctacagccactgctgttctgcagccaccacggctgacacccaggcaaaaagggtctggagtggacctctagcaaactccaacaaacctgcatctgagggtcctgtctgttagaaggaaaactaacaaacagaaaggacatccacaccaaaaacccatctgtacgttgccatcatcaaagaccaaaagtagataaaaacacaaagatggggaaaaaacagagcagaaaaaccagaaactctaaaaagcagagcacctctcctcctccaaaggaacacagctcctcaccagcaacggaacaaagctggacggagaatgacattgatgagttgagagaagaaggcttcagacgatcaaactactccgagctacaggaggaaattcaaaccaatggcaaagaagttagaaactttgaaaaaagattagacgaatggataactagaataaccaatgcagagaagtccttaaaggagctgatggagttgaaagccaaggctcaagaactacgtgaagaacgcagaagcctcaggagccgatgcgatcaactggaagaaagggtatcagtgatgcaagatgaaatgaatgaaatgaagtcagaagggaagtttagagaaaaaagaataagaagaaacgaacaaagcctccaagaaatatgggactatgtgaaaagaccaaatctatatctgattggtgtacctgaaaatgacggggagaatagaaccaagttggaaaacactctgcaggatattatccaggagaacttccccagtctagcaaggcaggccaacattcagattcaggaaatacagagaacaccacaaagatactcctcgagaagagcaactccaagacacataattgtcagattcaccaaagttgaaatgaaggaaaaaatggtaagggcagccagagagaaaggttgggttacccacaaagggaaagccatcagactaacagtagatctcttggcaaaaactctacaagccagaagagagtgggggccaacatttcacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaagcaacaaccggtaccagccactgcaaaaacataccaaaatgtaaagaccatcaaggctaggaagaaactgcatcaactaacgagcaaaataaccagctaacatcataatgaacaggaccaaattcacacataacacttaactttaaatgtaaatgggctaaatgctccaattaaaagacacagactggcaaattggataaagagtcaagacccatcagtgtgctgtattcaggaaacccatctcacgtgcagagacacgcatgggctcaaaataaaaggatggaggaagatctaccaagcaaatggaaaacaaaaaaaggcaggggtcgcaatcctagtctctgataaaacagactaaaccaacaaagatcaaaagagacaaagaaggccattacataatggtaaaggaatcaattcaacaagaagagctaactatcctaaatatacatgcacccaatacaggagcaaccagattcataaagcaagtccttagtgacctacaaagagacttagactcccacacaataataatgggagacattaacaccccactgtcaacattagacagattaacgagacagaaagttaacaaggatacccaggaattgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaacggaacaacttgctcctgaatgactactgggtacataacaaaatgaaggcagaaataaagatgttctttgaaaccaacgagaacaaagacacaacataccagaatctctgggacacgttcaaagcagtgtgtagaggaaaatttatagcactaaatgcccacaaaagaaagcaggaaagatccaaaattgacaccctaacatcacaattaaaagaactagaaaagcaagagcaaacacattcaaaagctagcagaaggcaagaaataactaaaatcagagcagaactgaaggaaatagacacataaaaaaactttcaaaaaattaatgaatccaggagctggttttttgaaaagatcaacaaaattgatagaccgctatcaaggctaagaaggaagaaaagagagaagaatcaaatagatgcaataaaaaatgataaaggggatatcactaccaatcccacagaaatacaaactaccatcagagaatactattaacacctctaagcaaataaactagaaaatctagaagaaatggataaattccttgacacatacaccctcccaagactaaaccaggaaaaagttgaatctctgaatagactaataacaggctctgaaactgtggcaataatcaatagcttacaaaccaaaaaaagtccaggaccagatggattcacagcggatttctaccaaagatacaaagaggagctggtaccattccttctgaaactattccaaccaatagaaaaagagggaatcctccctaactcattttatgaggccagcatcatcctgataccaaagcctggcagagacacaaccaaaaaaggtaattttagaccaatatccttgatgaacattgatgcaaaaatcctcaataaaatactggcaaaccgaatccagcagcacatcaaaaagtttatccaccatgatcaagtgggcttcatccctgggatgcaaggctggtttaacattcacaaatcaataaatgtaatccagcatataaacagaaccaaagacaaaaaccacatgattatctcaatagatgcagaaaaggcctttgacaaaatccaaaaacccttcatgctaaaaactctcaataaattacgtattgatgggacgtatctaaaaataataagagctatctatgacaaacccacagccaatatcatactgaatgggcaaaatctggaagcattccctttgaaaactggcacaagacagggatgccctctctcaccactcctattcaacatagtgttggaagttctggccagggcaatcaggcagcagaaggaaataaagggtattcaattaggaaaagaggaagtcaaattgtccctgtttgcagatgacattattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaagggcctcttcaaggagaactacaaaccactgctcaatgaaataaaagaggatacaaacaaatggaagaatattccatgctcatgggtaggaagaatcaatatcgtgaaaatggccatactggccaggtaatttatagattccatgccatcctcatcaagctaccaatgactttcttcacagaattggaaaaaactactttaaaggtcatatggaaccaaaaaagagcccgcatcgccaagtcaatcctaagccaaaagaagaaagctggaggcatcacactacctgacttcagactatactccaaggctacagtaaccaaaacagcatggtactggtaccaaaacagagatatagatcaatggaacagaacagagccctcagaaataatgccacatatctacaaccctctgatctttgacaaacctgaaaaaaacaagcaatggggaaagcattccctatttaataaatggtgctgggaaaactggctagcgatatgtagaaagctaaaactggatcccttccttacaccttatacaaaaattaattcaagatggattaaagacttaacatgttagacctaaaaccataaaaatcctagaagaaaacctaggcaataccattcaggacataggcatgggcaaggacttcatgtctaaaacaccaaaagcaatggcaacaaaagccaaaattgacaaatggggtctaattaaactaaagagcttctgcacagcaaaagaagctaccatcagagtgaacaggcaacctacaaaataggagaatattttcgcaacctactcatctgacaaagggctaatatccagaatctacaatgaactcaaacaaatttacaagagaaaaacaaacaaccccatcaaaaagtgggcgaaggatatgagcagatacttctcaaaagaagacatttatgcagccaaaaaacacatgaaaaaatgttcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtagtgattccacagggatctagaactagaaatatcatttgacccagccatcccattactgggtatatacccaaaggattataaatcatgctgctataaagacacatgcacacatatgtttattgcggcactattcacaatagcaaagacttggaaccaacccaaatgtccaacagcgatagactggattaagaaaatgtggcacatatacaccatggaatactatgtagccataaaaaatgatgagttcatgtcctttgtagggacatggatgaaactggaaaccatcattctcagcaaactctcgcaaggacaaaaaaccaaacactgcatgttctcactcataggtgggaattgaacaatgagaacacacggacacaggaaggggaacatcacacttcaaggactgttgtggggtgggggaaggggggtgggatagcattaggagatatatctgatgttaaatgacgagttaatgggtgcagcacaccaacatggcacatgtatacatatgtaacaaacctgcatattgtccacatgtaccctaaaacttaaagtgtaataataataaaattaaaaaataaataaataaataaaattaaactttaatgaccttttgatctactctcatttaatctgcttttatattcctcatatttggcagaacccacaataatcagatgagattggctaagagtaaatccatatgtctctttctttttgaaagatttactagttcacatttttaaaaagttagaattagaaattttagtcattagaaagtaatgaagaaataatgacacccattggagtaattatataaaaaaagcaaatgtaaaaatcctagaaaatatatgcccaataaaatgagaatgcttaaaaaaatgaggaaaaaatgccgagcaaaatgagagatgagggacataaattacaaagtaaaggtgctggggggacattcatctacattgagtgctgaatccacagattacgggaaaaatcactgaaaactgcattatccattttttggtgtttcttggtgctgactggaaatctgtaatgtatgtagatgccaaccaacaaagaaacaagatgggagaagagtaagggaacgaacacgtcaaataccacaggcacggtgctggatcctttacagacattataatgtggtcaaaattacatgaaacaaattgtcattttgttttccaattgtttgatttttggcatttcaatacttgaaattaaaaatgcttttttattgttaattttagcttcataaataatgttagtaaaatatttcaaatgagtgcctttggaaagctttttcaattccaggaaaggctatgattttttgccttctataaattataaccttcagcaaaaggtagtaactactgcattaccaaagggcactcatccagaaaatctggattctggagaacaccatcatcttagaaaaaccatttaatgactcaaagtccggcaatatatcttttaaaataataccacataataaagaatattaatcagacatttttctagcaagaatacatgcatttcttttgatcttctacatgaaaatgcacatactggatggacaaatgacagtaaaatactgaaaattctaacttcaaaatgggtttcatttatcaatagaacataatattggctttgattttcagattgcctactggggaataaaattaagttatcatattctccatcagagatcttagtctaagttcataattttttttgaggtaattgtttcaataattatttttttaactgaccttcaaaaagtgaaatcttctatcattcctaacttccattctgcagtttagagagtaatgaaagcagttaacatccccacttaccccagataattgtctaaaaaatcccagccaaatatgtgaaaaggacaagccatttttagaaactcatgtaatttaaatttattttctcatttgatattttgcagttatgtttaagtcacatgctagaagagttttggtattttttccagaaaataaaaacactttgtttggagtactaacataaatatagctgggagaaataacctgtaaactgaaagcaaatctaatctatataaatatcagtttgttgttctgtttcccttgtataatatagtaaggctttagacctcactttactatactgatgttaaggggtcaccatacagcaaaacactaagcattttacatttcagctttttcagaaataacgttgtattcatttcacagtgaataagaagataaggatgatatcaaagaacatcacagaatataacaagaaattgcattttacaataggtaagaaaatgttccctagaatatttacacttaaaagaaaaatcttgctccattgatataacatctcaaggaagaactagcaatagaagaaaattgtgctaaactttagaccctgttgtagcaatatttaaaatgctgcctcatttcctcacaagctagagatgttactttgctccaacttattatttcttctttttcaagtaaatgttgctgaaatagatttgtaaagatttctgattaacccaattactttaaccccaactcactcttcaagacacaagtctaacttttttgaagataaagtaacataagactacaaacatttttccggttttagcagttgccaaaattgtgatcatgggccaggtatttgttctttccatatctcagttgcctccaatataaatggaacttaacaatagtagatatcatctatagcttttgagtggattcaatagcacgtgtacacacacatacacacacatacactcacatacacttaaagactatgccttcacatagtgaaggcaattgccttcgtgtgatagtctttaagtaaatctaaccaatgcttgattgcaataatgattaatagtggtagttttagttgtgtgagttaagacaagatgatcacgtaagtagctataacaaatatttagtgaacagttactatgtgcaagacactttttatgcttgacacgtgtcattttatttaatcatgtaacaacacaataaggtaaatgttattataattatccccattttatggataaggagagctgggatacagagattgagacagacaaatgaatataacaccagagagaaataagagagacctgttttagaaggcaagaaaacaagttaggaaataaaaacgtatctttcagatgctatataaaaatggtctagattcgaagcaatttgttaatcaagtgtaaaacataagggtaattaatgaaaataatattttcatcattagttttaagtttttaaaggtttttaagtatgttaagtattaagtatttttagttttaagtatttcaagtagttttaagtatttcaagactttaagacaagactgattttttggactcctagatacataattatgtgagttaaaattgggattatccatttttataagaaactactcaaaaattaaaatataaaaattttggctgctagccaatccaaaaactttcaatccttttaccatgtcataaagcaaatgctaactcctacttcctaagcatcccgacagggccaaactcttcatgctttcaaggatgttatctataagcatggtccacaggatagtttaaaatttctgattctgcttccaaatttgaactgcactcacatctcactcactctcatctcattttccccagcactttcttctccctcatcttcctatttctgaatggttccctggccagttctccagccaaaaagcctttggttacctagttttgctaaggactttcacaactgaggccaagtggcagtgtaattgcctgatgggtttgtatgatagttacatttcttctatatttttattttcaacttcagtagcattgagaaatttcatattagtatatttatgtgcaattggcattctttatattctattcatatcccatttatattatttcgtgtactgtattttttccattagactttttgtcaaggcagcctgaaacctagtaatgataataaatctgtgaccccaagagggtgggatgaacctatattacttttatttctcttgtgtcttcctggtgaaattgcctttacaaaaattatgacagtgaaataaatctgacctaagtgactccatcttgcttctaacccccaagctgcccttgcacattcctgggtgtgggcctagctaactacgggagaaacttagtttatggcctaactttggaacaaagatgataacagctccttcttggacaaaacccctcattgcttggagatcagacttcctttgtaaaactaacaaagtagccacaagattagaaattatttctcagaaatcatgcagccagaggccacaagattcctaacttctctgttcctgtgaataacattattattgtaaaacttaaggttgatttttgaggtattttttaggccctgccttctgatggaccaggtggtgccacccagactggtaaaccaacttacctgatctcacggcccccaggaactgactccatgcaagaagataagctttgactgcctataatttcatccctgacccaactaatcagcattccccatcccctagccctgtgtctgccaaactactcttaaaaatccgagcctctggctgggtgcagtggctcatgcctgtaatcccaacactttcagaggctgaggcaggcggatcacgggttcaggagattgagaccatcctggctaacacggtgaaaccttgtctctactaaaaatacaaaaaaaaattgtcaggtgtggcggcatgcacctgtagtcccagctgcttgggaagtataggcaggagaatcacttgaacctgggaggcagaggttgcagtgagccgagatcgtgccactgtactgcagcctgggcgacagaaggagactctgtctcaaaaaagaaaaaaaaaaaaactgagcctccaaattttcagggaggctgacttgagtaataaaactctggtctcttgtttagctagctctatgtttattaaactctctattgcaataacactgtctcagtagagcagcttttctgggcagcagacaagataaacccattgggcaattacactgccacttggcatcagttgtgaaagtccttagcagaaccaggtaactaaagccccagctttttggctggagatccggccagggccagggaaccatcagaagtaggaagatgagggagaaagaagtgctagggaaaatgacactgcaatgttgattgtgaacccctggcatcaactccaaaccatgcttatgtggatctgaatgtaatcagcctaatcgaaggaacagaccacctctcaggtcagagactaataaccactaacattggacacattggaataacacagcaaatgctttaaaaattgaactgacattggaaccacagacaataggatgctagatgtaattatcaactgaacttaagcatgttgattgcctgataaaacaacaatataagcattctccatagaaggtaaacaaagcctcttaatataatattaaatacctgtagatactttagtaggcagaataatggctccaaagatacccagattgtcatcctcaggacctgtgaatatgttaccttacatggcaaaaatggatttgcagatgtgattaagctaaggacctaaagatagggagcttatcctgaattatctggatggatccatagtcatcacaggtgaaagagagaggcagaagagtaggtcagcgtgatgagttgtgagaactcaaccagccattgttggtttggatgatggaggaaagaggccaagagccaaggagcacacaaaagtgggaaaaggaaatagattcccccctgcagtctctaggaaggaacacagccttgctgacaccttgatttagtcctgtgtaactagacttctagactgcagaactgtaagataataaatgtgtattattttaaacaactaagactgtaacttattattgcagcaataaaactgaaaagtcttttaaatgccactaaaattgataagactctagcaagattgtcaaagaaaaaaaggagaaagccaaattacaataatatgaatgaaatagggaattatcaccatagcatcataggcattaagaggatactgagagaaaactagaacaattttatggccataattttacttcttaaataaaaagaaccaaacactttaaagacacagattaccaaaattcaattaagaagaaatatatactctgaatatttttaaaaccatgaagggacttgaattcataatttaaatcttctcaaaaatgtcatctttggtgatgatgtcaattgttagtttctaccaaacatttagaagtaatgccaactctacaaaatctcctccaaaaaatagaagaggtaacactttccatttcattttatgagaccagcattacactgatatcaaagccaaagatagtataaaaatgaagatgaaggaggaggaaggagaggaatgagaggagggagaggagggggaggagggggaggaggggaagaaagggggaaaaggcggaggagaggaggaagaggataaaaaaatataaacatcatatattagcatgtgtgtatgtatgtctgtaccacaaccaaatgggatttattctaggggtacaagtctggccaatattttggcatcaatgaaatctgtattaatagtctaatgaaaaatgtaataattatttctttttttcaggaaaaatatgtaaaattcagtgttcattcattatagaaattctcagcaaagtaggaatggtaaggaacatcctcaacctggtgaagaacatctaagaaaaacctgtgactaatatcatacttaatgataaaagaatattggcttttctcttaagattgggaacaaggcaaggatgttcactctaacttctcccattcaatcttgtgctagaaattctaactactacaataacaattttaaaatataagaaataaaaacttaaaatgaagaaatataactgtccctatttacaagtgatatgatcatctacatagaaatcccaagaaatccacaaaagactcgtcaacccaatggagtgcagcaaggttatagtgaggtaggagaccagcaggacttattcctggtctcaacaggatgaagtgaagaaaccagcaagaatcagtagatgacaacagaaccaacctctaggtgtccccactgctcatcagcataagacactcccaccagtgccctgacagtttacaaatgcccagcaacacccagaagttactggccgttttctagagagttctgagtaacccactccttaacatgcatgtaattaaaagtgggtataaatactactagccaatagtccacatgctgctactgtggatgctcaggctctgggttagtgctgctccacaaggagctgtcattctgcggtacactgacacttcaataaataggctttctttcaccactagctcactcttgaattatcttctgagcaaagtcaagaacccttctggactaagccccaattttggggctcacctgccctgcatcaacaggatacaagatcaacatacaacaaaacaattttatttctgcacaatatgaatgtaactataaactgaaagtttaaaagaaataccatttacaacacctcaaaaatttggtataaatctggcaaaatgtgcagaatctgtatgcagaaaacaacaaatgctgattaaaagatatcaaagggccaaataaattgagacatatgatgttcatagattgaaagactcaacatagtaaaatgccatttcttcccaaatttagatttattgaaattccaaacaaaatcccagcagaactttatagatatagataagccaatttgaagattaatatggaaattcaaaggaattatcatagctgaaagggttttgaaaaagaagaataaaattggaggaatcaccctacctaaatttaaaatttactgtaaagctactgttatcaagacaatgtggtatagatcagctgatcaataaagcagaagatagtctagaaatatatggccaagtgaattctgtgcaaaataatccaatggggaaaagacagtctttgcaacaaatgatgttggaaaacctgaacatttatatgcagttaaaacaacctgacctggagtttgagaccagcctggccaacatggtgaaatcccgtctctactaagaaaaattagctgggcatagtggcacatgactgtaatcccagctactcaggaggctgaggcagaaggatcatttgaacctgggaggcagaagttgtggtgagcctagatcacgccactgcactccagcctaggcaacagagcaagactccatctcaaaaaacaaacaaaaaacacaaacaaaacaacaacaacaacaacctgacctaaacctcactttatccaaaatttaactcaaaaaacattatgatgtaaatatgaaatgaaaagccatggaactttttgaaaaaatcagccaggggtggtggctcatgtctgtaatcctagcactttggcaggccaatgtgtgaggactgcttgagcccagaagttcaagaccagcctgggtaacatagtgaaaacccatctctacaaattttttaaaaattagctgggtgtggtggcatgcactggtagtcccagctacttgggaggctgaggtgggaggatctcttgagcccaagacgtcgtgtctggaatgagctttgattgtaccaccccactccagcctaggcatcaaattgagaccctgtctcaaaaaatggaaaaaacaaaacaaaacaaaaaaacctttacaacttggtgttagtctaagagttcttagagataatagcaaaagcacaatcaataatttaaaaacagatcagttagattttgtcaaaatgtaaaacttttgctttacaaaagacactattaggaaaatgaaaagctaaacttcaaaattggagaaaatattttcaaaccacatgtctaacacagaacttgtatccagaatatataaagcactctcgaaactcaataaaaagaaaacaaacaactcaatttaaaaattcatgataatatcaaaaggctggtgagaatgtgcagtgactagaacactcctacattgctgttgggcactctcttgtttacacttcccatatgcctcagcaatactattcctgggaatttactttagaaaaataaaatttatgttcacagaaagatatgtacatgaatataaacacagctccattcataattgctgaaaaacgaaaacaagccaaagttctagcaatcaaagcctgacacatttgactggttaaaaaaaaaagtttatgttatatttagacagtttattacttagcaaaataaaatgagcaaaaatgccagatacccaagccccttatctcaaaggatgacactgaaacaaaaatagcgagtaatgtgatgatgtatcatcagtagtgggagcaacctgctgctgcagatccaattgcatcttgcagataagcagctttatactttgcagttgtgcccaaataacagagaggcagagagcctcaggcctcttcaaaacccatgaagtgatgagtaactgtctcatggcagcctccttggaagataggtagagggggtaggctcttcaaagcctcccacactctcatgttccaggaatatctcagagcattttaccaaaacttagatcagctgtagttaagccttggccaaatagcctctctagagacatgcagggaagatgtttatcataagcccagaaacccctctcctgggattagagagaccttagggagtgaaaaatgttgatcacacaaaacaattgtatgtcaatgtttgtaatagctctattataatcacacaaactgtaaacaatccaaatgtctttcaacaggtgtatgaacaaattttggtacattcatatcatggcatactactcagctctaaaaaggaaagaattattgatatactcaacgccataaatgaaatcactgtgttgtaaattctagatttgtatttcatttaatataatttcttcacttttaaaaagtgttaaacttatattttcttttgactattgaggtaaaatatacgtaacacaaaatttatcatgcaagtcatttggatgtgtacaattcagtggtattaagtgcattcacattgtttcacaaccatcatttctattcctcttcagaactttttcatcatcctaaactaaaactctgtacccattaagcaacaactttccattctcccctccccagatcctggtgaccactattctattttctgcctctacggatttaactattctaggtgtgtcttattagtagaatcagacaatatttgtccttttgtgtctggcttatttcacttagcataatgtcttcaatgtttattcatgttgaagcaatcagaattttattctttttaaaagctgaataatagaccattgtatgataagccatattttgtttaaccattcatcccgtgaagagcatttgggcggtgataatcttttggatattgtacataatgctgctgtgaacattggtgtgcaaatatctttttgtgtcctggctttcaattattttgctcacacagttggcccttgaacaacatgggtctgaactgcatgagtccacttatatgcagatattttcaataaaacttacactgaccattcctgtccctcctgcctccccttccacttcctcatcttctcccagagacagcaagaccagctcctcatctttgtcctcctccttagcctactcaacctgaagacaacaaagatgaagacttttgatagtccatttccatttaatgaatagtacatatatgttctttcttattattttaataacattttcttttctctagctttctttaagaacacagtatataatacatacaacatacaaaatctgtgttaaatggctgctatgagtaaagattccagtcaacagtgagtatgtgtagctaagttttgagggagttgaaagttaaatgcagattttcgactgcacacgggtcagcaatcctaacccctgaattattcaatgatcaatcatatacctagaagtaagatttctgatcagatagtaatctatgatgctttttacagtggctgtactatttttcattcccactggcaatacccaagggtttcagtttctcgacatcctcaccagtactttattttcttttctttaaaaacaaaataacagccatgcatcacttaatggtgggaatacattctgagaaatatgttgttaggtgattttgtcattgtgcaaacatcatagtgtgtacttacacaaacctggatggtatagcctgttgcttctaggctaaaacctgcatagcatgttgctgtactaaatactggaggcaactgtaacacagggtaagtgtttatgcatttaaacatatgaaaacatagaaaaggtacagtaaaaataaagttttataatcttatgggatcattgtcatatatatgttccatcattgacttaaacactatcatgtaatgaatgactgcatttagtaattatttatttatttttttaatttcttatattgttattgaaacaaaattttggttctttattttaaatggaactcactttttgttatgatgtaaatgacagatctaacatttttttcttccaaaatagacagccaattgccaaaacaaatatattatttttctagaattatccaaaatgctacctaaaattcctattccaaatggatctgattatacgttctgtactgttttccatagatctatttgattatttttgtgtcagtactatactgttttaatcatgatggcttttatgcttagtttaatagctggtacagcaagccttcactcacactcttctgtccaattgttttaaacagtttaatttaatgctgccctcaggctgagaaacttgtgccagaatgtaaattaagtacagcacttactataccatctactttacctgatagcaagacttttttcacaaattaactggtgcattgacctatattctgacacattctgataatgaactagttaaaaaataaaacagttcatgtaagttgcgatgggtggactgcacttgagttatattggtttagacttcttggctatgggtaatctaaagccagggaaccatgcttgttctagaaggttttttccccctgccctcctacccctcctaactttctatagcatgcacatccctgcaagtccctttcttgcattttctctctagtgtttctgatgacttttctcttcccatgctgcagcccatagagcgactgagcattaggactttctgaagggcttaggcagcatggaatcccataaaatctctggtatcatctctcacttaccaactagttaaaatttcatcttcttcctgagtggtgcaaaaactattctgaaatcaaattatgcattctttcttgctttattacttatagtttaaactctggctccttggaactcacaaatcttttttttctctcaagaaagttcactttttataataaaggcttgttttagactactgttgtggttattggcttaaaacattattcttgtagattttttaattcctgaagtttttctcagtcttttaggaaaaaagaaaaaacacaaaaatgtgttcaatgttagagtctgcttcgatctctacttatggttgaagtaatgaagacagagaagttgtagcatgggaaaataattatagtctggtaaaaactggtcattagaggagcctggagttgagggaaggaacaagagaatacaagtacaaagtagacatgcttgcaggatgtgcgcatttccccaggaatcactggaaacatttttggagggtatctgataaagactgagcattgtgtactcataatagatgagttatggatagtcagaccatgctagatgagcccgaaagggaagggtgactcctcagggtaaagaagttacagatatttgaattgcatgggcagtagaaacttacatgcagcatattattttaaaacagttcatttattcatagctattataaattgcataataaaaagaagtaaaaagtgaattggaagtatgtttctgagtgattaggtaatatatttcctacgaaattaacaactgatgagtagaagaggactcaagtagtttcggatccatccctgcttcttgggtagtgcgtcaataagactcttggcaggacacttcttaagggattattaggtgtcggtgcttataatcagcatcttatataataaggagatatcattatttcacatgtagagcttcagtttgcactcacgttatatatatatgtatatatatatatatatatcaagtggaatatattagtaatatttcaaaagtactgcaaatatttcctcatttcaaagagtgctcttctcttccttctactgctgaagtaatatccttgtatatctccaattttttttttttttttgagatggagtctccttctgtcacccaggctggagtacagtggtgtgatcttggctcactgcaacctccgcctcccaggttcaagcaattctcctgcctcagcctcctgagtagctgggattacaggtgcgtgccaccacacccggctaattttctatatttttggtagagacaggtttcatcatgttggccaggctggtctcaaactcctaccttgtgatccacccacctcgtccccccaaagtgccaggattacaggcatgagccaccacgcccagccatgtgtctccaattattaattctagaaaaagataaaggcttattttatataaattccctccatatagataacctttttatccctcagaaaatgtacttataaaggagcagaaatggggcaaaatggtttcacatgctacttattgacaggaaaagacttaaagttggggtggaaaagaggattcaatatcatgttacacaattcttcataagatttagtttgctttttcttggaagcacagattaatttggagtcttttacctttacatatggatttcaataacctttttttattcttagtgtataaaattgcctgccatttccctcccacaagtaatatcattataattttaatctaattagtttgcctacatacttgcattccttcatcttcttcctattccatttattaatatcattctttcctctctttattacctattttgtcataggaatatagttcaatatcaagtcagcatttacctgacaatgatactaaaaataataatacaacatttcttgaggacttattagctcccagtgtatatgttaagcatcttacaatcttacacaaattatttcatttcattgtcaaaacaactttataatatagatactaatagtatatttcatttatgaggaaactgatatttaatgatggagtagtatcatcaaggtatcacataacttgaaatggaagaatcaggatatgaactgtctcagttcacagtatcattataaatttaagtgatattttttaacttaaaagtaacatttatctcctataaacctttttattttctgaagtgtttttaaggatagttttctaaaattaaagttcaaaatgaaataattcatttacattcttggaggaggaatgaacgataggcagtttattaaattgatatttcctatcaaaattcttttagcttccatgttcatcttcttttctgcattgctattacttctaaatgatatagtcgaaatgatattctttcaaatttgaccgagtttagctatttatccactgaaaaatctcttgttgaaatttgatgtccaatgttggaggttgggccttgtgggaggtgttgagtcatgggggcagaaccttcatgaatggcctggtgcccttctcaaagtaaagactgagctcttgctctattagttcctttgagaacggattgttaaaaagaggctggcatctctctccctttctgaaaccatgtgatgcctgctccccttcaccttcctccacaagtgggggcagcctgaggccctcaccaaatgcagatatcagtgccatgcttcttgtacagcctgcagaattatcagctaattaaacctctttctttatcaattacacgctctcacatattcctttatagcaatgccaacagactaaaacaaaattgagaaacttcccaaatagatcactctgggctaagttgtcagtagaataacatgcagaaaactttaccagtaaaactgcatagaaattaccagaaaaacaataatatatgaaaaatcatttccatgactaaagtaagctacaaaagttatgagactcatgtataccctctattctggaaagaaatgaaataatcccctatactgatagggcagatcaggagaatcagccattccctcccttgctgcagcctcgtcaaaaataggtctaatgtaggctttgggagagcttaaagtcagaacagagaacgatgctctggcaaaagaggcaaaccatgtggtctgaacagagggagcagtcactttccaattttttttttttttttacaaataagcgtaagaaagaaacaagtttcaaagacagtagggaagaggaatggatatttaatagcttggtctcaggaccactcaggttccatctacaaattgtattgttggcatttgattaaaacttacttattactttttaaattaaatgactttattaatatgtctattttagatactcccaagagttacgggaaagggaaagtatgttcgttaggcaaaattccatgaaataaatccctagggaactttaaactttgtttcagttttttccaatgaacatgtattattttacaatggaaaatttcaactaaaattatttccagtaagatcataataagtctaaatttttcaactaaagaatctaaatgtagttgttattcagcaactactcttcctcctgctaggtttaatgctactggatcaactcaatcttttccacaatattgtcactcatacttgcttctttctgtgagtctttattcccttgacatagttgctatttcctcctccacagggagcaactgtatctcaggcagttacaaaatcaaaaattttctgtcaaacagcaaaatagggttgggcacggaggctcacacctataatcgcagcactttgtgaggtagagatgggtggatcactagaggtcaggagttcgagaccagcctggccaacatggtgaaaccccatctctactaaaaatacaaaaattagctgggtgtggtggtgcgtgcctgtaattccagctacttggaaggctgaagtataagaatcacttgaacctaggagacagaggttgcagttagctgagatcatgccactgcacttcagcctgtgtgacggagtgagactgtctcaaaaaataaaaaaaaaaacaaaaacacctcaggaaaataagattattaaactggaattaacaatttgtctcttacaggctaattggaatggagaatttttctgaagttggcggccagcctcattaaaaaaaaataagatctcaacttttaaacataagctctctattcagctagattacaaatatgaacttgtaaagtggtaatgctgattttcttccttagttccatatggtaattagtaatgagagtaaatgaaatagggtgcggacatagacaaatgatagcaaaatttcagaaacaagagactgcctaatgattaaaacagattttaaagctacagctataccacaaataaattgcctgttagaagctaacaaaatgtcccaatagatacattgtaaaacttaaccacacatagaacatagtgtgtgacaactcattttaagatttagtgtaacagtgactgatcaccaaacctaatgagtggtacaccatgaaatatccctcttgggggatcactgtgagtgtccttaaagggaagaaaatctcttctgagacttgtagttggttataaaattttcaaatgtttgaatcagtgttcagacttaggatcacttttgatgtgacaaaatacattaggtctatctttcagaaattacccagcactttgacccatgccataaaatttctatatcacattagaaagtcccattaggatacattgcagtgagaatctggttaagacctgcactgaagcgtgtttttcaatcttactgtacatgagggcaaatttttacttccttgcctctgcaatgctgaggcaagttaatttttacagccaaatctcatgtcactggtctactggttgagaatcagactcaggaagcacatcctgtgcattctggactgacctgctacaagaccctggtgacttgccatctcctgatgggaaaggaaacatcagatggatactcagaacatcactgggcattagtgtggttcctaaccagaattttgttcaatctgcacatggtccaagagattatctgatagggatcccacagaattgtgagattttaaaactgaaaggaatattagaaatcatatagtttcacccaaatacattatagatgtgaacaaaatttattgaatggagatagtacaatgagacaacatatctacatgtcctttgtgatggttaattttatgccacagtactcagatatttggctaaacatgtctggatgttgctgtgaatttatttttaaattgaggttagtttttaaatcagtacacttgagtaaaacagataaccctccatgatgtgaatgagcctcatccaataaattgaaggctctagaaaaatgactgacatccccaaggaagagaaattttggccaaaagcctgccttcacactggagctgcaacatcaactcttccctgggtcttaggctaccagcctaccctgcatattctgggcttgccagtctccgaaattgtacaagtcaatcccttaaaataaatttttctctctccacccacctacacccacacacacacatacacgcacccacctatacacacacacacacacacacacacacacacacacaatctattggttctgtttccccggagaactccgaccaatatactttcatccctgcaaggacctctcatcacagtaagtcattgaaaatccataacgtgacctataaattcctcatgatctgactgctggagacccctctgacttagtttactaccatttcccccctcactcattgtgtccagcaacactgaccttctgggtcagtttctatgttgagcttttgcatgtaaccctctcctgtggaatttccttccccagcaagagcacactctttcatttcactgaggtctctgttcaactctcactctaaatcctcacaacacaagtgggatttatgagctagtagcattgacatggcccaggagcttattaaaaataaagaatttatcacagatcttatcctagacctactgaatcaaaatctacatattagtaatatgccaggtgattcatgtgcatgtcaatgcttgaaaagaatagatgtaaagtgtcacctcccattgctctttggctctttgcctgcttcttcttcatggcattcattactaattgacattatattattttttatttacctgttgattgactgtttctctcactgtaaatcctaaatggcagggattctaatctcaagactggaatctgacctagcacacagtaggcatgcaatagatatttttactaactgaagaaataaatgtcaggcttggcagaatcttctttctcattgtgttttatgtctatagcattctttatcaactctatgttcctttaactcctacttagaatttaggtctcagtcaaggcagtgcttcttttgggaaagtcttttttgatccctccggtggtgactgggccctttggtgtgcattcatgcactgactcatcacagcacttaaaacacaagagagtaggtcctccatgaagaattaatgagtgaattcatgctggtcataacaaataattcttgactgaccactcaacatcctctacttgctcctttctatgcaatgactgatttttgtgcagatatctaatatcctccaatatgctgtgctacaaaccatatctcttacccactcccagggagtatgatctgacttgcccaagacaaaaaatggcagtccccttttccttgccagtgactggtttaagaacgggcaagtgctacagttctcattaaggagagaggagaccatgcccaggttcttagggagaggcacaaaataaggcaactcttttctccctctgaaaacttttgttgtgtatgtgtgatatcagattactataaccatcatgctaatagctattaagatgaagccaacccgcataaaagggtttagaaaaaacaatagcagagaagtgaaatcagaacttagattgtcctgctcttggactttgtatcatagcgtatggtaagtgaaattagcattgagttatttgaacctggaagcatcattttactttggtgatatgagtgtaaacttaaaaactacctccatagtggttgaaaagcaaaagtaattattagtctctgttaatgtacatattttcttttttttccccaactagaaaatttaatagtagtaggaggatcttcttagcgtaatagtaagtaacagacccttaaatttataaaacttatttgttactagacattaatcaacaagcatttactaaacgtataactattatactataatagagaaaatagcgattttaattttgaagcaaatcaagaaattcttatttgttgttggctgtccgaaggagcatgtttaggtcacttagttaaattctttaaacagtgatagaatcagtaaagatgttgaaatatccaaaatctatgatctccgaactcccaaaagaaaaaggaattaattgcgatgtatttcaaaaagtaagtgtacagagagattacaccaatttgttatctgactaaattgttgcaggactctgtgtaggaacagtacatacaacaaggcatcttttaaaggacagagtatttcctgaactacatattaatgttatttagacagattttttaaaagtttgatatgtacatcaatataaaatttaaaagggagtcatgggtgggggaaatgggaaaatgctggtcaaggtgtacaaagtttcatttaggtagcataaagaagttctggagatctaatgtgcagcatggtggctataattaatgatattgtattgtatctttcaaatttgctaagagagaaatcataacttctcagcacacacatgaaaataataactatgtgaagtaatgtatatgtttattagcttgattgtagtaagtattttacaatgtatacgtatatcaaacatcatgttatatactgtaaatataaaaaatatttgccaattataccttaataaagctgaaaaataaataataagaagcacttataacgccacagtccagagataatcacagtcgaattttctggtattttttcaatagttttatatgcatattttatgactttaagtataaatctaccacaatttaatcttcccatattttttgatatatattttgtttgactattataaatagtactgtaatgaatatgctttgcataaaactttaaaaaataaataaaacagtaaaaaagaaatataaatgaaaggagagtcaataaaaacctggatccaatgcacaaatgcatggtggcatctattaattcatttaatatttattaaatagtttgtgccaggtattgtacttgacacagggagtacaatggtgaacaaaactagaaacagtctctgaccttttggggctcacatattcaagaaggaaaacacttaaatagtaacacaaacatatgtttgaaagtatgaaaaaacattactggaagctgtcaaggaattttcaatgagtgcagaatatttgaaaagcttgagatataaaagatgaacagaagttgtaaggtgggagaagagatatctgagacaaagggtagagaataagcagaggtcctaaagtaggagcatttttggagtcttgtggaagtaaatgatttttttcgctgtaacccagagaacaagagtggcacaagaaaaatatggaagtatagtaggatattggaccctgaaattgtttgcaaactatgttaaatgtatgttatttatcgttaaaaaatagtgagatatctacttatattaagcagagggtgcaaggggtgcataaagaggtgagactgaagtctgtgcatgagaagttcaaatttgcattttagtataccctgcactacagacactgaaatacagataagcaaaaatggatgtaggtgcaccagttgagggctgttattgtgattaaggtgaaggataatggaagctttaactatgatgatagtaaaaaatgagagaagtgaacagaagagaaagatatctaggaagtagaatcaataaaatctggagatgagtttaaaagcagggtagcactgaatggaggcagatacgagacttaattgaaaacataaaacaggaagagaggaaatgagggtagtatcttttcttctatgaagtttgactataaaataaaaggagaaagacaatgagatagcttacatctaaaggaaattttgtttaagtgagggagacttgtgcatgtttaaaatattttgagaaggatccactttaagtagtaaaacacacatgacatataaaaatataatgaataaagtaagatttttgagaccaaaaatcaggaccagagtaagctggaaacatgggctttggataggaggaacaacaattcctctattggaactggaagaatgcagaatatattataagtgctagattttattgagaatattgctgtttgctgttgtttttaatctgtaaattaagagacaaggccatctgtcaaacatgaaaggggaacgcacgaacaggaagtttgaagactgtggagaaggtttgaaattgtaattgcaaggagtcaacatgatcagaatagacaaaatatctataggatttgtagataagatgaggttcaaatgagattggcaagcattaatttatagcaatgtcaatctgcctgttgtgctttgtctcttgaagctcttggccacctggctctagacatggaaaagtggatagttggaatcatccaagatggaagcatttgaatgaagcattctaaagcagttataaacatggattttggtggaaacctgaggcattcattgtattactcaaggagaatgggtagactaataaagaaaaaggaagaatatattagagttggacaagccagcaaaagagacagataagtaggtagaagtaggaagaaagccaagagagcctattatcatgcagaatgaaggagagaaagcaagaaaggtcactagtcagccgtgtcgatgtgaaagggaggtggaaaccagcactgaacatttagtaattaaaatgtcattaattctcttgaaaagaatagactgcatgaggtaaaaaaatatgtatatctgaaggactaaagtctgagcaagacaatttcaagaaacttgtactggaagaaaaaagtgagagaagcttgccatcaacttaacttttaccagcttaaaatggattgtttgttattcttccatctgaaaatttaaggatccagataaaatggaaggagaaaaaacggtcatcatcaaactgctaataatgataaattctggagaggaaatggcgttggaaatatgcaacatcccccattgtttattgtccatggttctctgttccttgaaaactgtcattgaaaaaagtagcattttttgtaattataaagtcaattaaaaattctagaatgcttctaataatttgacactttatttctagtattatctctatcatatttttataatgtatatctatgtcttacaacatatatcaatgcatatctagtattattatatctttcttatttttacaatgattcataaagaatacagctatagtaggcattccttcaaattgctcaagactgttttgatttctaacttaaatttaagttttcaaaagttcttcagcatattgagatgtttttgtcttctttttagcacagctaaaatattgcaaaatccctttctaagctaattttccattaattttccatgtggatatgagtcttttatgttttgttttattttacatcaacaattttcacgccagtgaattaaatacagctttttatttcactgctgaatgttcttcagttgtctgtaaaactgaatacattaaataatttattataatttaattaacaacatatgcttacctagtgacatcacatataaaggtcggctccaccgtgaaaatgctccaacttaagacatgctcagaagtcattttaaattttggttgtttttattgttgtttgactattcaattctgggtgataaataaaacgctttcccatgctgtccttacactgattatactcaagattgctttctacctaactcaaacaaaaccccccaaaacttacaaatatatattggttgctgaaaatgctcatacactcaatttgaaaatattccaaatcttttatgggttagacttttgtttcttgctcaatttcacactgacgtgtgtaaaagtattataagcatttgctatttagttcattatgggcaaaacagcagattgttttgtattttgaaagcatcctccctgggcttttaactaatctctcaatcacatgagaaaagctaaagaaagaataagatgctagcctatatacacatcatagaagcttgaaattggccaagtaccttggcagaaagaagggtgcttttattctagtgaacagaacaaagtagaatgaatttagatttttttttttaggagagaaaagtgtgatttacacaggaagagccatttcgtccaggtttgttgagatttgggcagtgtgttctacagcaaagacatctcccctgtagactctggaacattctgtattatcctataacagatgatcagccatatggtgaagggggaggaaaatcagggatataagaatctgctgtactagtagatgcatgaatgagaaaacaaaggttaaagccaaatttggggactgtggctggttttctcattttattttagagattttttattgagtagcacttcttggcatatgccaatatatttttaaagttatatttatgtattaagttttcttataaaaatatttttaaagttctctacaataacaaaattgagataaagtctcacaatttgttataatttggatacctctgaattattaaaattaactataaaaactcaaaaagtctagcgtttcagagatgttataaaacattttgaaatacttacatgaaataatctaattattccagtatgcaagttcctgctggtagtaggttagtaagttgttttagaaatctacagtaattctttcaaaacacaaaaatatagtgtggtagtaactcatgtaattttacctcagctgtttaaagtcaaaccaacttcaacactatctcaatatgttatgcaatcattcatatagcctaagagataaaaaaaagttttataaaatgacattggtagaaaagagatctgacacttgcctcccactttgcaaactttctccatgtttttggtatttatttatttaattaacatacaaattgtagatatttatggagtacagtgagctgctttgatacacatatatagtgtaataataaaatgagagtattagcctatccaacactttatacatttatcatttctttgtggtgagaacattttatatgcttaggctttgtgtccccagtcaaatctcatcttgaattctaatccccataatccccacatgtctagggagagacctgatgggaggtaactggatcatgggggcagttctcccatgctgttcttgtgatagtgagtgagttatcatgagatctgatggttttataagaggttcttcctgccttgctcctcatgcttctctctcctgccgacatgtgaagaaggtccttgctgcccctttgccttctgccatgattatagttttctgagacctttcaaccatgtgaaactgtgagtcaattaaacctctttcctttataaattatccagtctcaggtatttctttccttttttattattatactttaagttttaggatacatgtgcacaatgtgcaggtttgttacacatgtatacatgtgccaagttggtgtgctgcacccattaactcgtcatttacattaggcatatctcctaatgctatccctcctgcctccccccactccacaacaggccctggtgtgtgatgttccccttcctgtgtccaagtgttctcattgttcaattcccatctatgagtgagaacatgcggtgtttggttttttgtccttgtgatagtttgctgagaatgatggtttccagcttcatccatgtccctacaaaggacatgaactcatcattttttatggctgtatagtattccatggtgtatatgtgccacattttcttaatccagtctatcattgttggacatttgggttggttccaagtctttgctattgtgaatagtgccacaataaacatacgtgtacatgtgtctttatagcagcatgatttataatcctttgggtatatacccagtaaagggatgttatagcagtgtgagaatggactaatacaactttcaaaatcctctcttctagctattttgaaatgtgcaatacaatatagttaatcatagtcacccgtctgtgcaatagaacagaagttattctgtctatctaactgtaactttgtagccattgacgaacgtctctttattgattccttcccctctacactccctagcctctggcaaacactatgtctatgagatcaacttctttagatttcacatatgagtgagatcatgcagtatttgtctttctgtgactggcttgtttcactttatcttccagattcattcatgattttgcaaatgacaatatttcattttttgaatggctgaatagtatcccactgtgtatgtataacacattttctttacccattcatccactgatggacagttaggttgattctaaatcttggctattgtgaatggtgttgcaataaacatgggagtgcagatatctttaacactgatttcttttcctttggatgtatacccaatagtggaaatgatggatgatcccatagctgtatttctaattttttgagagacttacattctgtttttcataatggctgtactaatttagattctgagtaacagtatgtaagtgttctcctttctctgcatccataccagcagttgtcattttttgtcttttagataataaccattctgaggtgaagtggtatctaattgtagttttgactgaatttccctgatgattagtgatgccgaacattttttcatatacttgttagtgatttgtatatgattgtatatggtgtttcttttgggaaaactctttccagatcctttgctcaatttttaattagattgttttgttttgctttgttttttgctattgagttcagttgagttccttatattttctggatattaaccccttgtcacaagtgcagtttgcagacatttactctcattctgtaggttgtctccttattctcttgactatttccactgctgtagaagagacttggatacccatgtcttctagtttcatgtaacttaagttgttgatttgtttttgttgtctgtgcttttgaattcttgaccaaaccaaagtcataaggcatttggaaaagtacagtctcttcaataaacagcactgggaaaactggatatccacatacagaagaacaaaactaagctcttatcttttaccatatacaaaatcagctcaaaatggattaaagacttaaatttaggaccccaaaaatataaaactactagtagaaaacataggggaaatgctttatgatattggggtcatttattttttctcttgtacatttgtttaagtttcgtatagactctggatattagacctttctcagatggataggttgcaaaaattttttcccattctgtaggttgtctgttgctctgataataatttattttgctgtgcagaagatacttagtttaattatatctcatcaatgaacccattaaaaagtgagcaaaggacatgaacagatacttctcaaaaaaagatgttcatgtggccaaaaaacatatgaagaaaagctcaatatcactgatcattagaaaaatgcaaatctaaactacaatgagatatcgtctcacgccagtcagaatggcaatcattaaaaagtcaagaaacaaaagatgctggcgaggctatggaaagatagtaatgcttttacacagttgatggaaatgtaaattagttgaaacattgtggaagacattgtgacgattcctcagagacctaggacaaaaaacactatttgacccagcaatcccattactgggtatatactcaaagaaatataaatcatcctattataaagacacatgcatgcatatgttcattgcagcactattcacaacagaaaagacatggaatcaacgcaaatgccatcaatgatagactggataaagaaaatgtggtacatatacatcatggaatactatgcagcaatacaaaggaatgagctaacatcctttgctgggacatggatggagctggaagccatcatccttagtaaaccaaggcaggaacagaaaaccgaacaccacttgttctcactcacaagtggaagctgaacaatgagaatacatggacacagggaggggaatgacacatgagtcttatcagcaggaacgggggatgtggggagggagagcatcagaaaaaatagctaatgaatgctgggcttaatatttaggtgatgggttgacaggtgtgacaaaccaccatggcacatgtttacctatgtaccaaaactgcacatcctgcacatttaccctgaaactgaaaataaaattaaaaagtgagagacagaacacaattgacaacagatttcaatagtatattttattacatttttgcaacagcattcttcttggcttttccttcaaaaatgattttccaaattttgtactgagataattaaaaggcaattgagttttttctaaaatagttgattaaaacttgtttccattagtgtttatttttgttatgtatttatcttatttgttaaataatgaaaactatttactttttatttttaatatgtattattttataacatactgcagaaaaatatatttcatcttcattttataattcacaatgttatataaaacctctctaccaagttctgtcataaatgagctgaaaaatatcagaacatttgaagctgtcttctgctatgtctaatcttaagcatccttagaattgattattctctaactagtttgatattaatgactccttagagtggcagatttttctttgtgttatttcattgatatttgtgtttggtgtcaaattagcaagaaatctagatatttttctcatgtcctcctaagtcacattccttgtcactgactatcaaacattcaaaatgtatccattatttatgttaatatttaactctttctccaaataaattcctgctttgatatagtctgatattttattacaattggcttgcagataactttttgttgattttatcattcatctttataaattatatttcataatctatgacattaatgtcagtactctgttatttaaccaataaaagtaaagatgatgaaagataatatatttgatatacatcaatttttatttctacaaattttcctttgtgttatttgaatttagaacatttcaactaaaatggcatttctgggccttatcaatagtttgactaaatttttgaaatcttgtttgtatttgggtttatcttttgaatcttttatataatatttcagagcttttaaaatgttgatgtatctatcatgcaaaaattggacagaaggggttgtttttgacagaatctggcttagaggaagtaaatttgggaatgcattaagtttaggtttagtgagttctacttatgtggttgacagtaatttcaatgaatgatgtagaaatggcttccaggaatatttctacgacccactctgaaaattcactcaaactcatggcaggagagtacagaaacacatatcgtattgtaatatgaatgcattctacaaccccatcaactccagcaaacacaaaggaatgtgttgatggaggggaaggtatagtttatagtcatctttataggtctgcagaagcatttcttgcctggatcttagggcaatacaaactataacttcacacatcaggaggcccttcatatcacaaatactcacataaaatatttgttagataaattatgggcaattctcaaccaggatctacattcacagctgatatagtgcaactcctaactttaaacatccactctcataagtaacatcaacaggccccagggaaatacttctcatatcttgccttaacttctcgaaacaaaaggtagttaattttgaatgccttcaagacttgtgtgagtcagacactgcttctaagttcataaagtgtttgaatagataaagcatttaggtaaaagaagaaacaaattaaccaaatagtcaaatcttcctttcaagtagcaataatgcaatagattcttacataatgcagcattattttccagcaatgctccagcatgcacttttattctttgttctatgttccaatttgttgtttctaggtattcaaaaagttgtgcagtatgcccaagatgcaggctaagaatgatcttacagtattaaataatggacctgaatcttaaatttatgtacatgtgagtgtctattggtagtatgtgtgaagtatatctttacactgacaatgagatggacactaaacatttgaattgcaaacagattttacacttgaaaatatttaatcagatttaataaaatcttcaagaatattaagcatgttcagctttattaagataatttttattgaaaattttgaaatacataattggtatttttaattgaataaataattgaaatattttaaggactatattattttaaacatgtgtaaactaatttcatatgtaaacaaatttcactgtatgaaatttaaatttttgatgaaaaaatatagctaattttttaaaatttggaaaataatcatgcttttaatcctttagatcattattagtaataaagcttaacgctattacaattttatttcaacaatgtaactagtaattttgcaaatataatgtaattaaaataaatttcatgaaatatataattatttagaaatatctatgtcattttattcctcacccaacatccactggcccatctactgtactcccagacatgcagaataatgataatatttagtaattggtattctgcagatttttagttatatataattcatagctgtacacctgtgatttcttgctaaacagaatttttcaattttaaggtagatgaatttaccattttcccccttatagataataattcttatgtctggttaagaaatttttttcctaacccaaggtcataaagatattcaccttttttatttcctaatattatatagattttgtttctttatttagatctttatgtagaattcgtttttgtacagtttttgagatttgcatctagttacattttttaatatttctagaatcatttattgtaaagcctaccctttcccaacatctcataagaaccacctctattatctatcaagtctctacatatacttgtatctatatattggctcttaattctctttcattatctatattcatattgaagtctatatcctcaatttgtatgccagtaccacacttccttaaatactaaatctcatgctggctggtagggcaaatatgttcaaattattgttctacctcaagagatttttggcttttattgactctttgtactttcatataaaatcttagaataagccaatcacttttcacacacaaatcaaaaacatattgtgatattaatttaaaattctttaaatcaatacacaaatttttggaaatgtgacatctttacaatattaaatattataatcatataacatggtctattagcccatttattttttaaatgtctctaccagcaccccttagtcacaaataattatattttctttcaaaagtgtattaaaattgtgaatcataagtactttgaaattaaataaaattcaacacatatgttgatctcatactatattgtaagtgttgtggtaagacaagagtacggaaccaaggaaaggcatgcttattatgacagtgttttttaggtgtgtttttaactgcatcatttttgagtattgtttattctttttcgaaatactttagctgaatttgttatctggtttgtgttttatgtgccctacaagatacttatatcaatcgaacatctttctgcacattctcatcaagagatcaacagaaagacttcaccacaagataattaaaaataccaaagcattcacacacacacacacacacacacacacaccccagaactttcaactcagcccagattatgcaaattattaagtaaagctaatgaactgaaatctaatatcaatctggaaatgacaggctaaaactgaagctgatttagaaaacaatcccaaatggaaaatagatctgtttcaagacagttttcatttccaaagctatttactccttgtttgagtaaataaactagagaaattcaatttcttctctatttctatagctcatttagctatatatctcacagttgtagtcattttcaaactataattctggaggtggcaagatagaacagtatgttcctaactatgacttacttatttaaatttaagatttatacttttcttggaaattatgaaaagaagtaaaattatttatttgctaacttgatgttcccagctcctctaatcaatcatgtatttctgtgtcagtgtatttctttcagtacttttcatttgctcttttaattattcattcacttatttaactagtcatttattctttcgacaaataggcactggatatatgtcattataaaacagaaacttagcctctgtgatcagagactttacaatgactccaatgatattacataattttcagatgttggcaaaataatttatttatttatttttttttttgagacaaagtctcgctctgtcacccagtctggagtgcagtggcgcaatctcggctcactgcaacctccgtctcacaggttcagctgattgtcctgcctcagcctcctgagtagctgggactacaggtgcgtgccaccatgcccggttaattttttgtattttttagtagagatggggtttcactgttagccacaatggtctcgatctcctgacctcgtgatccactcaccttagcctcccaaagtgctgggattacaggcgtgagccaccatgcctggcctaatttaaatattttctaagtatacttaagtattattgcagaggcatgtcataacctttgaatttcatactaattcatgaatgaaaactgacttctaacaaattcatagattaaaaactattctcaaagcatacacagtgagtaaataaaggagaacaccaaaattagaagagaacatagaaaaaattccatgcagttcacaaagtttatatgtataaattggtaggcgtaaaggtatatgtctgtatatatgagtatatgtgtgtttgtgagagagcaattttcactacaaattcagggttactgtattaaaaattcatagcactgagagggtatttaaaaataaaatacactttacagttttttaatgcaagtttcccattaatttgatttgctgtagattatttaaaaatcagatattattgacaaaactaaaaataaatgaacaaattcattattcatccattcattcaacaaatacttactaattattataagtatatgctgttttaggtattgggtatacagaaacaaagcaaaaaccttattcccttgtttcttttttttttttttttttttttttttttgagacggagtctcgctctgtcgcccaggctggactgcagtggcacgatctcggctcactgcaagctccgcctcccgggttcacgccattctcctgcctcagcctcccgagtagctgggactacaggcgcctgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgttgtttcttgcattaaaatatcaaacactaaaaataataagtaatagttgttatataatcacgacatggtaggaacgacatgtgttggtccacgttggtccattttgattttatctttaaacagcacagcaacacaggtatttgtatacccatgttagaaagatatgaggatgatagtttttacatgcttgaaagaaaaaaaaagagagacatgagaaaataaatatcaatagggatgttatttttcatccaaattaggtctaaatttatgtgtatgtttttgtatgtattgggggaggaagatatattctagctgaaagtaagatttttgttaatagtttgaaagaacttcaaaatgctaacaatttttaacatctaagactggaacttaattttatgtctaacgcagactgtccctttgtgctggaaaaccaacacagttgagcatatcatattgaaaacaagtattcattgtttttggagaaaaaccaaaaacaatgtaacacgaaattctgactgaaaacttaactgttttgttttctaaatgtaaattgagtatgactatctttaactaccagtacctctaataactaaggcttactgagtgtagggcattttactgaggctttaaataaaatgcctcatttaatcatgacactatccctccacagtttttacagacattggatagatgaagaaaccaaagcttaggggaatttcagtttatcattggccgcactgcttttaagtaggagatttctgagctgatgcgttaaaccaatatattataataataatattcttaagataatatttcctttgtacaaagtatgcactaacaattcagtttacctgtatacgattgcttttttttaagtaaatatatatgtgtgttcttgtctgaacatttttcacaggaaaatggacatcacagtagtcaaaaacttcagcaaatgtacaggcctagtttgttttgttttgttttgtttttcagtcaactgaagaagaaattgtaaataaattagtaggatttggtataaaaacacagctcagttgggattgttgatgatatttaaacacagacaaaaaagcttttgcaccactttcctttgtgcaatgtgggaattaaggaggagggcctggtccaggggttgtttcatcctaaactgatggaaatcccaggaaagctaagcccaatggaatagcactctcatgatgaccagcatccagtgtggagcacaggagaggttggagataaagaaggacgttttcctaagccaatgagacagcactgtcagaaacagtctgcagtagctgggggaagacttggaggctaactatatttttcaacagacttgatggttattctaatagttaagaggacagattctgaatttgcacagcttgaatgcaaagtcttccctacttattattgtatatccttgggcaaattaattaatattttggagaagcagtttcttcaactcaagattgtggaaaacaagaatgtttatttgtactcctgagagaattaaatatcctgattttgataaagtaattagcatcgcacccaacacagatgaagtggccaagaaaacttggctttttttttatcattattatagatgtacatgtatgatttgtggccatgagctgcagcttggcattacatagaattgagggcaaaataaaaatattcatcctctggcgatcttcatttaactaagttttacttattaaaaaattatcaactacaatctcaaaaataggttcccttacattttagtctggctgataaaagagtaaaattttaaaaagggtctttatttgttgtctttacctcctacacctctattcagctttgagagatagagatgtaatgtacatgatattggagacatggacactggtttattggaggaactctgcagttcacggaattcttgcatatgttatagatcaggaatatgttaatttgtccctgaaattactctaacaccaatggcaattctcatccccactcacccttagaaatcgttaagactaagccagatggggctaatgaacactagtttccattgccaagaattagattaacttaaaagaagagaaaaaaacttaaaaaaataagatctatctgaaaaagtcactatgatattaaagactactctaatttcctcgtcatactgtactacaatactttttccccactttagtttattaaatgatgaaaaaggtaaaaaatgagaactacctctccaaggaagtaatattactctattttccttgtggttgctataagtatattagcacccttggagaccaagttaagcaaaataaaataaacaaataaacaaaaaccatgttgctaatgcaaccaaagctcctggaacttataaaagaatctgtgtccaaaattttgtgttcttatacttggaaaggaaaagcatgaagtatcattttaaaatatttcagtttatttttcttcttcaagaagcaaactacactgctagacattttttttcaaaatgttcaaacaattaaaactgttccaaattttctttgaggaagtaatttcagtttaaagttttaaaaatagccaaagaggataagtgaatgcattggtttacaaaatttcattttttattttatatatttgaaacttgtatattttaggatataaaaaagagaaaaagagaaagaataaaggagtgtctgaaaacatgcatggacatagtgtagtcccttctgagaagcaatatgataatgtgaaaagtataaaacagagaaagatatgcaatcagaaaacatgggattggttcaagaataacccttactgggaatcagaaaaactatataaataaaacctgagtgatagtgactacaacatgatgaactgcaactcctttaaatcagtaaccgaaaacctcccaaaaaagaaaagctaaggaccaaactcgttttacaaggctagcattacccacataacaaagtcagaaaagggcactgcaagaaaaaaacatatataggccaatattcctgataaatatacatataaaaatcctcaacaaaatactagtaaactgatttcaaaagctaattgaagggatcatgtgctatgataaagtggggtttatccctgggatgcagatgcaaggatgattcaacctatgtcaatgaatgaatgtgctacaccacattaacagaatggaaaacaaaaactatatggttatatcaataaatacagaaaatcattgacaaaattcaacatcttttcatgataaaaatactcagcaaattatgtataggaggaatgtaccacaacataatataggccatataaaagaagcccacaaaccccataatcaatgaggacaagctgaaagcttctcttctatgatcaggaataagaaaagtgtgcatacttttgccaattctattaaacatagtactggaagttgtatttaaggcaatcaggcaagaaattgtttttaaacaaaaggtatccaatttataaaggaagaagttaaaatatcactgtttatagataacacgattttatatatggtaagacctaaatttttcacacttgaaaacaacctgttagaaataaaaaacaaattcagtaaagttacaggatacaaaatcaatatacaaaaattagttgtgtttctctacgctaacagggaactatccaaaagataaattaagaaaacaatgtcatttcaacagcatcctaaagaggaacatacttagaaatatatttaaccaggaaggtgaaagatctgtttactaaaaattataaaacattgatgaaataaattgaaaaagacacaaataaatggaaatatgtaccatgtacatgaattggaagaattaatattattaaaatatccatactactcaaaataatctatagattccatgcaatttctatacaaattccaatggtatttttcacagaaatagaaaaagcaatcctaaaattgacacggatccacaaaagaccatgaatagccaaaggaatcctgagtaaaataacaaacctagaggcatcacactatctgacttcaagatatactacaaagccatagtaaccaaaacagcatggttggcataaaaacacatggaacagaagagacagcccaggaataaacccatgcatttacagtcaattgactttcaacaaaggtgtcaagaacacacaatggggaaagaacagtctctctaacaaatggcactgataaaactgcagaagaatacaattaggcccttctctcacaccatatacaaaaatcaactttgaatggattaaagacttaaagttaggatctgaaactttaaaactaacacaggagaaagctctatggtgttagcttaggcagtaatttttcagatataaccccaaaagtataggcagcaaaagcgaaaatataaaaatgggattacatcaaactgaaaatcatttgtacagcaaggaaacaacagagtgaagagacaactgtggaatgaaagaaaatattttcatatcatacatctgttaaggagcagatatccaaattacataatgaactcactgaactcaatagcaaaatacaaataagacaatttttaaaatgtacaaaaaaatgaatgggcatttctcaaaagaagacaaatggctaacagatatatgacagaatgctcaacatcactaattaaggaaaggcagatcaaagccacgataagatattaccttacacctattaggatggctgttaccaaaaagacaagagataagaagtatgggcaaggccatggaaaaacgggaagctttgtacactgttcgtgggaacgtaaagtgctacagccattatggaaaacagtatagaagtcaaaaaaactaaaaatagaactaatatatgatcccacaatcccacttctgggtatatagccaaaggaattaaaatcagtattttaaagagaaatctgaactcccatgctcattgcagtgttactcgcagaagccaagatatggatacaaccactcatcaacagacgcatggatgaacaaatacacacacacacacacacacacacacacaaaatgaaatatcagtcagtcttaaaaaaagaaaatcctgccatatatgacaacatacacggacccgaaatacattatgctaagtgacataagctaggcacagaagggcaaatcttgtatgatctcacttatacatggaatctaaaaaagtctaattcatagaagcagagagtagaacagcgattgccatgggatgggataaaggaaatgaggtgttgcccaaagggcataaactttctgttataagacgaataagttcagggaatctaatgtacagcatggtgacgatagtaataatactctgttgtttacttgaaatttaataaaagggcagattttttttttttttttttttttttttttttttttttttgagacggaatctcactctttcgcccaggctggagtgcggtggcgcgatctcggctcactgcaagctccgcctcccgggttcacgctgttctcctgcctcagcctcccaagtagctgggactacaggtgcccgccaacacgcccggctaattttttgtatttttagtagtgacggggtttcaccgtattagccaggatggtctcgatctcctgacctcgtgatccgcccgtctcggcttcccaaagtgctgggattacagacgccccaaagtgctgagattacaggcgcggagccactgtgcccggcctaaaagggcagattttaagtgtccccactccccagccgcctggcccaaatgctaattacaggtggtaatgaatgtattaattaatttgattgtggtaatcagttcacatctacatgttatcaaatcatcatgctttaaatcctgaatatatacaatttattatttgtcaattaaatatttaaaaacaaaacaaaacaaaaaaccttgcaatctcctgccaacagttaaacaacacaaactattcttcaccagtgtgttcaaatttattttgataacaagagactaaagtaaacgttaaatttacttaagaaatacctgaaaagagattttggtaaatactctttaaaaagcttggtggctgtctcaaaatccatctggaaaatcttcagaaacattttaccaggaattagcaaggtaagtgccgtaaaccaacctcatccaacagaagtatttgtgtatatgggtagaaaatcactgccatcagcagtcagtctgtgctcatcctcccatagctctgacacaaaattatactttaaaaagtttcccttcgaattctgccacccctccacatacttattaatatttattagcaagcaagcaaaagtcacttatacaatctttctataaattgacaaattcacagatctctgtcttttgatgcaattagaccataccttgtatgataaatcacttgaaataactatagcaatattccaaataaatgatttcattacctttatagttagcgataagaacctagaaatctccctcatgcatggacatagatgagttagagataaagcctaggcaaggctatctttgcgatagtctaactaatctatataccttgaattccacttattttaccagtgagagcccacttctaaaatccattatactaattaacaggccactaatttcaccaatgaaaacccacttctttcattttgctaattgtaaatgcctttggtgttgatcaaagataatgataatggaatggctattagtagttcctatggagtgagcatttcctgattagaatgccagtgtgaattcctgattaaccaaatgattgtccctacagtgcagcataaaccatttatacttaaatatcactgtctttaagttgaagtttttcaaattaagttataggcatcataataataaaaatattttaaacagctgtctaatagattatatatgagtaactggcacatgggaagaggtcatatgaaacatcataggagctagagatttttttttaattgatcatgcctctccaaaaaagcctagagcaaggtaggggaaagataaaattaagaagacctaaaaaacattttaagaactttacatgcaaggacatatgatctataaaagtagacttttttttttggtgtgtcaaagataaaagggtagatagggaataatggattataaatcattgagaagtaagtgaagttcctattgaaagttgaagaggagagggatttcagtcattgtggtttatccaggaaaaattaatttgatctttggagccgagaagacagacgtagtgaatcaaagactactacatacacagggtgcattgacgaaccaaggttagatcactcatcagaactgactgatatctactcgagagtttgaaaaaatccagaggtcagattatcaaaattttactcagaagctattaacctagctttataaacaatcaatgggacagagtaaaagcagctgtcaattcatctcttgtccataaacagttcatgagagagtttcagttacatttctaaatattccttggataaaaggacgttaggaattgattgaaggacagctaaatagctcaagtattctgtgtgtttttgggttgtaactcatgaaaatagatatcatggaagaagaaaaaataaaggaatggccaactggaagaattacagaaattataaaggggaggaaatttaacgcttaaagaataaaaactagtcactatttcttcctcttgatactccccaacgttatgtacacacacacacttgcgcatgcacacacacacttgtgcatgcacacacacacgtgcacacacacacaaacacacacagagctaaagaagcttcctaaatgaagccttccctctcctttactctttcatgaggctttaggtatacttatctcatgcaagttatgaagaactttgctgtgctgagattcaactagatacttcaggaaggagccagagtctccaaacccactggattctttgttaatgactggcaattacaggatgctggggcaagggattatgaaagtcagacgtagactaccatcacctactggtccaacttgtcccaaaaacttggaaaacttggccaaaaggccttctatttattgaaaaatgcctgcaacactctgggcatagggaatgctggtttccattttttgagtaaacaatgttggcgaaggcatattattgtcagcatagagtaaagccaatttatttcgatagtttctatcgagtgggaattagaaaaacggatgacccctttgtttaacacatttatatggataaacatatctattcaaattctagactaactttggtgcctcattttgtggggtctcttttctgactttggacacagccataacctctgaagcctttaccatttaacttcttaattttatattttctgaattttagctatttaccctactagaatgaattatataatattttttcataatatttttcacatagcaagtatgtcacatttgtttaatacacatcatttcaagtttgtaagacaaaagttgaggagcaatatgacatcaatctttaaaaataaatatgatgaagaagagacaagaacttgttctctcaatttgtaatgcttgaagccttttaacctgaaacagatcatcttccaacatataaaaagaagactatttaaagatagtgtaagcaatgcatgagcttatttttctatgatcttatacaggttaaatctgtaaccctattatcagagaatttatataagttcatgaaccagagataatttattagtgaggcaacaggagatttggggaacatttctacagtatcattagggcagttctcaaatgtgtcagttctctcagatgacatttctctgcccacttgaactcatgtggtagcagggccatgggaaattaaatgcagccaaaatagcaattcctagcagaagcatgtgtgtagttcgcatcttctctttacctggcctctatgcatgaggaagcaagtttcaagatatagtcttcatcagtatgggtctctgcgtgactaatacatgctgacaccccttgctgacctccaatgaacaacgaatatatgatgtagtgagaaataaaccttttcacttttcattttaagctgctgacatgtttcattatttgctaccaatcctttaatccagcttgtcccacatgatacaattctccaaatcttatgttactgatatcttgaaattcctcaaagccctttaggccctcaagtaaatggctgagggtaacagagaagaaatgcaattgaagagctgttccaggaccttagacatctagaaactcaaccatagccgctgcactttaatctattttatatagatatttatgttgctctcaatccatctcctccataaaaaattgtacaccactattgctagggatagatcttttagtctcggcctataatagcatatcatgttttattcattctacacatatttgataaggcctattgcaaacaaagataggttataaggtactgtagaaaatacaagaagaaaaaggtaacatttcttgttctccagaaccatataatccagctgaaacagtttacaaaatttctttcaaaatttctccagatggagtggaagaagcctatgaacttttaacatatttatttattcccaaagaaatgcacagaattaaatgtaatgaccattttatttttaaaattaatattctctgaaaaaaccctacatatttgcccatgagaaattagtactaatttcagatctcctatatgaagtcctttttatttcagaatccttttgcctgctcttttggtaaatagacatccttaaatggattagggaaaaatttgtctttttgtatctgaaggaggcaaaaggaattaaaataggatttcaaaaggtagccaatttcaaaatcaggcaggctaattttgttataaatagagtaattaaaaggattagaaaaagtgcttccctttgttagactgacactcttacaataagatgtgaacacacataagggcaaggaagtgtgtcataagtaccattagtggccatgatatcagtctctttgttttggatatcctttttcttcatccccattttagtcttctgagtagaatctatccatcatttcaaattctctctttttttaatgtttcctaatcaatccaccagggattgttcttattgtccctctgtacatatgaacacttcagtggttccctagttgtttcatgtgttttagcctcctttcctcaaacagaaattgatttgttacaaactcccatttcctacttttctcaatgtttcccacaagaaaatcttgactatacctaacacattgtaatcctctacacaccatccttttttgcataattcccttcatctcttaatctagaaacccagagaagaaaatacacttattataggaggcccaatttctagtgaattcatcatcttctttatgctttttgtttttgttttgagacaatgtctcactctgtcacccaggctacagtgcagtggtgcaatcatagctcactgtaatcttcaactcctgggctcaagcaattctcccacctcagcctcctgagtagctgggactacaggcgcacgccacaaggcccagctaatttttttttttttttttggtagagacagggtcttgctatgttgcccaggtcaccatcttctttgctgttcatgctcataaatgatttaaacttctattgtggaagtctgttgaagttcaacaatgatagcaatcacttatattttccccatttttttgacaacaggaagtggattttcctttcatttctccagcaccattgttattccctgtggttctgcaaaaataactgaaaatagttctacatcaacatcttccagttctctcagaattctggaatgtgatttgtctagcctagaggcttgaagtcatttaaagcagcaggtaattttactataccaccaattgggctttgattcccttaagcatagttattatactccatctagtttaaagatcattctccttgatagagaaggaagaaacaaaataggagttgaatggttctgcatttttttcctgtcatctgatttctcaccatctggcctaaacagttgggtttatcccttccttgttcttctttgacatgaaaggggactttcatgaattgtgttgaaaaaagaattgaaaactactgtgaacataccaaattgaattgaaaagcacagatcatatctagggaaatgtagtgagaatattactaattgctagatcaaatttacaaggaataaggagacaggaatgagacaaggagatgaaatattcatctggaacaattaaaagatcaatggtgatacaattacaaaacaggaaactaatgttctaaccaaagcatgttttcttcttcaattaataataatacagtgtgctgcactatataaaacagctttataatgtcagttgcatttcttttgcaaaaccacaatgcaggacagaccaaagagatggatgatttgcaacaaaggcaatgcactgaaaacaggagcttttaatagctttctaaactcataagagctgtaaaaatcctcttgaacctacatccatctactctcccaaagaatatgctaaaaaggttaagaaagcggtaatttaagtctcccttgtcatttaattctttgggagtctgtttgtgaactttcaaatctacctggcacttttaatttttttgttgttgttggggagaagggttggctaacatttaactacagtattttttttttttttttttttgagaccgagtctcgctctgtcgctcaggctggatggagttcagtggcgtgatctccggtcactacaagctctgcctcccgggttcacgccattctcccgcctcagcctcccaagtagctgggattacaggcgcccaccaccatgcccggctaattttttgtcttcttagtagagacggggtttcaccgtgttagccaggatggtctcgatttcctgacctcgtgatccacccgcctcagcctcccaaagtgctgggattacaggcgtgagccactgcgccggccttttttttttttttttttttttgagactgagtcttgctgtgtcacccaggctggagtgcagtggcgccacctcggctcactgcaacctccgcctcccgggttcaaacgattctcctgcctcagcctctcgagtagctaggactacaggcatgtgccaccatgcccagctaatttttgtatttttagtagaaatggggttttgccatgttggccaggctggtctcgaactcctgacctcaggtgatccacccgcctcgacctcccaaagtgctgggattacaggcgtgagccactgcgctgggccaaactacagtattattaatgcaaaaagtcccttcacggagacctgaagacataatttgttgctcaatagaaatccagcattttaaaaatccagaaaagaaaacttggtccgattaatcagttgaagattaaagtaatgtgtagcagatactgccaggtggtattccagggtattagaccctgttcattccatactttcacagagacagtagaaaacatagtaaaatttccaatatcataaatttcccttgtagaagctatggcttatcattcttttatttctactaaaaatattcacaagattgtgtctaagttttgtgcttgcattagcaaagaagtatgacattgggtaataggccacccacagtaatatcttccaaactcttaagactggtagcagcaaaggagtagaagatagaagagaaattgtctcacctgacacagaaattgttgagagtttggaagtttaggacataggaaatgtaatgactctacagaatggaaaagggatcaagccatttatttttaaataattttgatttagagtcaaccaataccgttgggaggattctatgccacagtcactctgttatgcactttcacaaccactgtctattacatttcaaaaattatcctgtcacttaggaattatcactcccattttacagaagaaggaatcaagggatgttaagcaattttcccaaggccaaatagttggtgagagagcacacacgatagaatgtgatttcccttgccagttgagggactacagctccccctcattgcgtattgaacgcagaaaatgcagaggggaatgggtgaatggtacccacatttcatgttgtatcgccaacccaccaatcagtgccaaatatttgccattgcacaccccatcagcctctagttaaatgtatctatttatcagtatattaacatattcaccacagtagcatggcatatgcataaaccactatgacttagaagaataaaattattctttggctagcccataaactctcagagttctttatacatcccaccgccttagcagccaaactccgggattattttataagaggagagaaaagaaaccaaattttatctgaaaaaaatcagattaataaatgtaaaggaagctgatattaaactttattttaaagatcacatatagccataacgagatataggcttgaacttggtgtaatcaaagaggcattaatttaaaggaactatggctaagggaaaaaaaaattctattgtttatatattttgttagtatctggagatacaaagatcaatgtagtaatcaatgacatagctgtgattccttacagctcacttatcaatatcataacacaaaagtatctacgtaattgggaagtttagctaagctttattgtagaaaaaggaaatacatactggaagtcattttggggtgttgttgttgttgttgttgttgttttgagacagagtttcactcactctttcacccagcctggagtgcagtggtgcagtcttggctcactgtagcctctgtctcccaggttcaagtgattctcctgcctcagcctcctgagtagctgggattacaggcgtgcaccacaacaccaagctaatttttgcatttttagtagagacagggtttcaccatgtgttggccaggctgatcttgaattcctgacctcaagtgatctgcctgccttggcctcccaaagtgctgggattacagctgtaaaccaccactcctggcctggaagtcattttgtttagcttatttatagaaactatttccaccatgcagtaatgacaacaatctaaggaaatgtcctaacaaccatattagcatagagtgatagataaaaagatattatttttattttctatatcattttcacattctccttcagttaactgaacatttagctgagcaatatatgtcatgtgtcatatattgcatgattaaaaccttttactctaaggaaacaggttttagtatcaccatatcgaacatgaaaatcattctaataccaaaatgtcaaccttgattttttaaaattccgtagtataatctgattaataggtgtcataaggaaatgactgaactattgggtacacaaaataatgttctaaaagttgtattttaaaacgatatatctacataaagtgtgacaatataattatttccagtttgattaaatgctataatcactatctcattactagaataatgaagaaaaaatatagaaatattatcacatgatccatacgagaattaaattaagtagacattacataaaccagaagattcttacgcaatttcaaagttgtcacaaataaattcaggtttgaaggacaataaagaagtaatgatgggaaggaaagcttgataattatagcatggttgctatttatttattcagtgtaaaggatcaaagaaggaattgtcttagtattctcctacttcactgaaacaaaacttttagttgacagtgaacacacgacaaaggaaatcaatttaacgacctttattgaagcagtactggatacaaggtattgtgctaggtcgttcagaacaacggtgaataatagctatactagtttgtcagtgcattcataacacagtatcactgattgatgtggcttaaacaacaaaaattcattttctcacatttctggaggctagaagtctgagattaaggtgttgaaagggtttgttttctctgaggtctctctccttgactgacagatggctatcttctccctgtgtcttcacagggtttccctcaatacatgtctgtatcctaattccctcttcttgcaaggacatcagttatattggattgaggctcatcctaatgacctcattttaacttaattacctctttaaagaccctatttacaaatacagtcacattctgagttacagggggttacgatgtcaatatataaatttgggtggagacataattcagcacataataaagcgttcttgccctccaagactttcaacataatagagaagaaaatatataaaaataactatcatagaaggcagaaagtgataaaagttatagtgcacagtcaaaattattaggatggtgcaaaagtagttgcagtttttgtcatcactttgatgacaaaaactgcaattaaatttgcatcaacctatataaaacatagaaaatgactggataattaagaaaggtttaatggagaaagtagttttctaggatgagatttcagcatattgagataaatataatgaaaaagataggaaacaacaaattaaaagaaaacactgtatagggctaatttttcatttaattataattcatttcaccatattgagataactgtagtggaaaggataggaacaaacatgattagaaaagagcactgtatagggctaatgtttcatttaattataatcaaactgtactctgattgacatggcatattttgtatttaagacaataaagatcatttgactgctgatagaaaagcagaaatagaaaatcatgttttcttcagttttcaatgtaaaatacaccacaggccaataaccagacaaataaaataattctccaccatcttccaacatatcatttgtatttatggacatttttcagaagaaataaaatagggagaaaattagaattgtaccaatcataagccagaagaagacatagataataaaagtccactagcgattggattgtccttttaggaaatctatctatcaaaaatctatgcttatagctctttgttcagagggtcagttcccaaatttatgtgctacaacagtattttaaattctttcctgtaataaaatgtcactgagattttttttaagtagaaatgtgatattttatcaccatggagtacaatgtaagtttagctgcctaactcattattcttagtcctgcttgaaaagtaaatcatatttctgacaatgacaacgaaatctcaattttgattacttctgttttaaaagagcataggataatagtaaggaacctatacaaaataccattttaatatttatagaggggaaaatactgaatttttatggaattataataaatatatacttccttatgacttcttacacgtgggtcactggcagataaacttaatatttacttactacctaaaacatatgacaattcaatggtgctcagccaggttatattaacagtgtggcaaaagtaaaggattttccttttgttcatacaacttatccaatggcacattcaagtttttctcctctactattatggcaataatttaggttcatgtcagcaaatgtttgaaagacatataaatcccacatttcgtatcacttgttagtgtctaattaagcagaaaattttgagttcagtgaattacaaaatgaaatttaaaacacatcagattttacattaggtaataaagatcttggcacgtaaacctttagcactgtgggaaatgagcttcatcttttacattggtgaaaggtgcagagtgatcattctgtgcaattacacagctagaagaagccttgatttggaaacagtgctataccaaggagaaaatcacgttgcatagttgtgcttaatttttgcagtctaactagaatagttatgctacatacatacatctggctttgctctaaagcctatgttgggcatctctgaaacataaacagagtaaattttgcccttgatcactttggacgttactcctgtaaaaatcatatacaagtttatttgagtaaaacagatttaattaaacaaatgtttattaggcatctgcggtataccatatattgtgtaaagcactgcaatgaagtaaaacctaaccatctgtacaaatccacagttgtcggttcttctctttctttgacttcattttttactaatctgatgttttgcttgtttccccctacccattcccacatgtaaattttcttctagaatcctactaacttctggtgggagaggaaagagcctcatttgccaccaaaaccatatataatctaggtcaaaaggatttttatattgccttattaaatcatgcaaaattatccagctgtgtttgcatggacagccaaagaggaagggacttcagcttttgttcattatttgatttaacagctgaataagtaacaaataaaaaactaggcttaacagtcaggtaaatatttttcctgatttagaaaggttccagatggaaaaacttagaattatgatctaaacatggcatccatattttgacattaaaaaagatacagaaattaatttgagaggaaaaacaatttttttttgacacagggtctccctatgtagctcaggctaaccttgaactcctgggacgacagggaaaatcaattttaatagagaacaataggctgaccagactagaggatatataaaactaatatcattgttatttattgtcttagagaatttgagcaattaaggaattctctgtgacagttaatattatgtgtgattatactagccaaataccttccaagtggagcaataaatgagaaaatatctatggaactcctagagatcttgggataaatggttccacacattaacagttgcatttccttttttttttttttttaacagagtatcactctgttgcccaggctggagtgcagtggcacgatctccgctcactgcaaaatctgcctcccggcttcaagcaattcacctgcctcagcctccggagtagctgggattacaggtgcccgccaccatgcctggctcatttttgtatttttagtagagatggggtttcaccatgttggccaggcttgtctcaaactcctgacatcatgatccacctgcctcggcctcccaaagtgctaggattacaggcgtgagccactgcacccggccaatagttgcatttcttaagaaaaaaagattttaaaagccacaaacaaaagtaaaaaacaaaactcacacatacactatttattataaatccataaaaaattcagctattcaaaccaaaaaaaattgatactagcaaattataaatttatttagtgaaatagtgatagtataaatatatatcatgctttaataaagtattttaattaatccagtcaccacacatgtttttgctaaatatgacagacagaagataataaaataataattggcttaccaccctagataagttttaattattccatggtagttttacatactttgaatatgatgttagcttaaaattcagtggttgaaaacaccttacagaattttaaataagtagattttctgatctagtttaagaagaaagggtcaagtcacaaggccaaggctgaatatctctaccttcatgaaatttcccatatagttaggtgaagagtatttatatgtaatttaggtatgaaacataaagtacataaatcactatcaagacagtgaatgcatatttgcaagtaaatattaaatcatggcatgggaatttaatgttgccatgtcaaattatttagatacacaaaaaggacgtatttttctttcctcccatgaccattttccacatacagtattacaactgtgcctgaaaactatgtttcacctacaactgaaagtctctgaagttgattaaattataaggttatgggggattgtagggtagttggtctggatgtcagtgaatattttaaaattaatatttataattaagacagattttatgaagtgtcaaatatatcattttttctggtttagaattttaatagttatattctactgttagcatgtggcagttactgccctaatgcgatgaaagcctgaaatctcaaagccactgattccctacaagaaaatctgacagagaaaacaagcatttgcaaaattatttataaatgaatgtaaagtgttaacttatttataaattcctggtaattacacattttacaaacttatgaagaaccagattgaaatttgattattatacatctgtaattactatagagatgaatgaaatctatcacagtgaacatggattatgttttgcatcttatttggattgtcatgtaagtctttataatgagctactaattgccaatatatgaaatagtgatcacaaattcaaataacaatgaagaatgatgaggtttcaaagactggatgtcacagaattactttgttgatagaaagatagccttggtgtctttcccaacagaacctattttaacacactgtaattatcaggtgagggcttgtttcccccattagactatagatctcttgtgaataagtccagtaggctttatccaccatttcatctctagagtgaatagtaattgctcaataagtatttgttgactgacacaataaatgattaacttgtcaacacgaaagtgttcactgggcacttggcttcaaaggcattcattccccccatactatcaagattgctataaagatggcagaacagaatatcatttaaatcttgttgtcatgcgcctgtgagaaacttttcagctttagctttgagttttcatatactcagagtaagaatattctattgcctgagggagattctgattattttgatgccctaaatctcctaatccaatagatggaaaatgtctgtcatgcagatttgcttatgaaggggcaaaggctttcatcaaaatctttagtactaaaaaagaaaaatagtaaaaacctgagaaaggtaacacaggggacatcaattatacatgtaataacaagtatgagaaaagttaagactcagtaagacttcaccgtaagattacattgtgattctatatgctctaatcttttatggatgcttgaaatatttcagaataaaagtatttttttaatctagctatcctttcctcacactcaccaacaaaactggaatgaaaaatgacataaaacttcagaaagtattattctattagagtctgaccctgggtgataaaggtttaggtatttttcattttcacaaagcattttttaaactgtattactgagattcacagtcaagtgaaagaatataggataatcacaattcttaggtgagtttcaggtactgatatgtgttggtctggcatgatctctctgttccccaggcacagactcatctatgtcacttggctttgcaccctgacatctacttctcctattcaatatgtattttttattataaatgtttaagaaaagtagagatcataaaatatagaaaataatctatctacctcaataataacatgcactttttttcccattggattttgctctaatttttaaaggataaagcattgtagataacactgaagtcctatatgaactcttcctcagtctcgtacctccctctctaaagttaatcactgttatgtatttgatacacatggcatttatgacatcctactgtccataaaacttgctcatccactcaatattactttgaaaatttctctttttaacatatgaaactagctcatttgtcttaactactgtgtttgctgctatttgctcatttccccattgatggaaaaaaaaaactctataatgatcatacttgtaccgggttttccttatgaatatgtgcacaagtttcttcaataaacctagagggggattcctggcaacataacccaggtgccacatattgttattttgttcttcactgagattgtaacaatttacattcccagaagtattgtatgagcatactcttttaagtatatcacatctaataattgaaattatcagattttttttacttttaatatctgatagtcatgcaccctagctcttaagataattcttcagttattttggttaactatatagtctattattgggacaggttgaacaaaagtgctccttaaagagatttatctttctcatactggtttaaattttaacactggcctgccaataatgttagtaataacagttatcttttactaggccactcaatatgtcctagacactattcaaaacatttaaaatatgtaatttattcaattcttccaattgtaaaagaatgtgagctctaaggatgcagagagttttgtctgttctactggttgttctatctttaaaacagtcctatcacctagtaggtgctcaccaaatatttgttaataaatgagtacatgaataaataaattatataattaacattttcaaagaggcatttagggagtctgagtggttatttcccaaagagcatagatttttgtaggaaatgacagaattatctatcttcaagcatacataactccctccaaaaacagatttttttttttaagatggagtcttgctctgtcacccaggctggagtgcagtggtgtgatctcagctcactgtaacctctgcctcccgggttcaagcaattctgctgcctcagcctccctagtagctgggattacaggcacatgccaccatgcctggctaatttttgtgtttttagtagagacggggtttcaccatgttgaccaggctggtcttgaactcctgacattgtgatcctcctgcctcagcctctcaaagtgctaggattacaggagtgagccattgcgcctggcccagatttttctttttctatgttccacgtagtctctaaagagaaaattcactatcttcctgtcaaatctataagaattactttagcggtgaaattttagtaagaacgataggcagtttgtaagaacataattctttttcttttaaaattatttcttttttaattaacaaatattagttgtatatatttgtggtgtacaacatgatgttttgaaatatgtatatattatagaatggctaaatcaagcgaattaacatatacatcacctcacatacttaatcatttttttatagtgagaacatttacttgttctctcagcgattttcaaactgacaatatattgttattaactatagtcagcttgttgtataatagatctcttgaacttattcctcccatttaactgaaattttgtatcctttaaccaacatctccccagtcctctccctttaccagcagtccttggtaaccactattctactccctgcttctatgagttagactttttaggacaatgtaactcctagatgcattttaaaaacacgtagaacttgttcacagcacaggctctggagccattctccaagcaaaggtttttaccggtttgttaaaattccccaggatgctttctaagtccctaagtctattgcaacaacaactcgtaaaatcagatacatgattcctgttttcaaatttcctatctagacccacttggatagcaagattgatgctgttctcaccagcctaaagccccttcagctctagctgaaatctttgttctctcacaatgcccaggaacatgtcttgggctcattggtaggtaggaacgtgctgtgtggcaaggagaaaatttccctgtaatccttcatctaatctataaaatatcctaaaggattcaccatattaacgatttttcctcatccaatttatactgattataggtggttagagttgagatacacccctaaataactgaatacacataaaattgtgagacttcctttgactctctattgctttgttgaaagtctttgtcaatatatctggccattgaaaataatatggtttattaacaatgcacatacactcactgagacaattctaagcaaattgtttataaacagtatattttatcattcacagcctttgtcagtacatagcacatgcatctgaagtatttagaaactattatattgttatgcaagtctaaaatgcaaatccttagggctatttactttatcagtaagattattaatcattactctagctataccttaaagttatagcaaaaattttcaaatctgacttattaagacagtcaaaaaaggactcccagttatggcttttctaaagatctaagtcataatactcaaagaacagtcctgcagtctacttattgtttattcaaatgaaagcaccttaagtgaacttacctgttagtacatgaaatgatgtgtgataaattccagttgacatgcccaaactactcttcagtcatgtaagtacaggcagtaattcaaaacataattaccaataaagcaataatggattactttggggaagcctattcaatcatttctgaatacacactttctctctgtctttcaccatgacctacataaagccatgtgtacatttctcttcagtctccacaatgatccctgaacaatatactgtaacatgaaaatgtaatcacagatgactcaggggaaaaaaatcttacagctatgaaatcactgtctcttaattttagtcaatgttatagaagatcctggctgcaagtcatcactggcctgtcctgacaaggaagagcttcttttctcggtaaatggaaacctaggttattcggcttgagctaggatgcagttatcaaactggttctcaccttcctattgtaacatcttgaatgtgtcagtcatgtgctttcattttttggagatagaatggagaaaacgagggaacacctgttttatattggatttactttcatttctaagggccattaaggattatttagcactacatcacttacttctacaagaagttggcgtctggagatggtgttctaaaaactgataaagtatacaacgttactatttaaaatttcagatggcttactgtcttagcctgtttgtgttgctataaaggaatatccaaaactggataatctataaagaaaagaggtttatttggttcacaattctgcagactgtataagaagcatggcaccagcacctacttctggtgagggcttcaggctgcttccactcatggcagaaggtgatggggagccagcatgtagagattacttggtaagggaggaagcaaagggtgcggggtgccaggctctttcaaataacctgcccttgcaggaataaatagagtgagaattcactcattaccaagaggattgctccaagctgttcatgaaggatccacacccaaggcctaaacacctcccattaggcactgcattcaacactggggatccagtttcaacgtaatatttggaggggttgaatgtccaaaccacagcacttgccttttcctatggaagttcaggaccctatatgaagccatctgttgactttttaagctcagtaccaatcctgatgtagtctgtgcttcttttatactggccaacttgctgtccctcaaacccaccttgaattttcacagtttttccctctttatgggaggcttttccaattttctaaaggttcaattcaataatccagctgaacagctgtttctttaaaaatatttcctcagtatcctgacagtacagcagcattaattgtaaaagattttgtttacgtaacaaatacaattcttttgaaatctgattcatatacaccagattgtgagttctctcaaagcaaattctgtgtatttttcttcattgtattttctttcattccccagcatactgtcttgcacataatagatactcagtttaattttatcaaaatcattttttcaggaaatgattaacaatctccaatttaaaagatatatttgtattgaaccacttcatggcttgatgcttttaatcaaactaaattttgactaggtataggttgaagaataatgtataagtgcaatgtatggtaataggaaattggttataattatattgtataattaatatttgcatagatacatactatattggtcatcttttatcccaactcctattaaataaatatcatattgagatttaatagtgcttagttttgatgcagttaattttaacattttgctcttgctaacattattatgtgttttttggcatcagcttatgaaagaacatggaaaatcaatttattttccattttctttgtcaaatttagattaaaactttgtagaagccaaaggtcatgctcactatgatgtcatggacaaaaaggcctttgttattacattttgttcatttttctctttttttctttcaattttacttgacacataataagtgaaacatatttatggggtaccaagtgacagatacatgtatacagtgtgtgattataaattcagggtaattaaaacattcatcacctcaagtcattatcatttgtttaatgagaactttcaaaatcctctcttctagctttttgaacatatacaataaattattaactatattcaccctacagtgccatagaacactaaaacatattcttcttatctaactggaactttatatgcattgaccaacctccctctatcctccttctcccttactgttcccagcctgtaataaccagagttctactctttacttccatgagctcattgttttgctcctacatgtgagtgagaacatgcaatatttatctttccacgtctgacttattttacttaacataatgtcctccaggctcatccatgttaccaacgacaatatttcattttttaaatagctgaacaatattctgttgtgtatatatatatatattacattttctttatttattcatctgttaatggacatttaggttcattccataccctggctattgagaatagtgctgtaataaacatggcagtacagatatctctttgctatgctgacttcctttcctttggataaatacccagtagtggcactgctaaatcatatggtggctctgtttttagcattttgagaaacctcaatagtattttccataataaatagctgtactaattaacattcccactaacagtacataagaattccccttactccacatccttgttagcattttttttaaatcatttcctttcatttagattctgtggaagagtttcttgggtttgtttcttaaataactaataaaattatattagtgatgttgagcataataaattcttacaatctgatccaatctttgtccaattaagagtgtggtggtgcaggagcagctcttgttttttttttttgttttgttttgttttctgttttttttttttttaacaatttcgttgactctcagagtctaagacttcagggctgggacctttgtccagcctgcacggtagagtgaggctgcctctcccaccaggcattgggatcctatttagaaacggcgttcacttcagaaggtactttttaactgctcagtttttgactattttaaatagtttgctgaaaactcctgataacacttgcagctcttgtttttaaagttgctttcagtttgagtatggtcttaaagacttctgttgccacactcctggtgcaacagcttccctatatgagccacaattttggtacttgccacttttataatgtataaacttctgggactttgttatatataattttatactactttaactgtggctattttccttttttaaagctttcatatctgagtgagaagatatggtgtttgactttatttttctcttatttcacttaatgtcatccagttctatgcatgttacagtgaatgacaggatttaattatcctttatggctgactagtattccatgtgtatatataccacattttctttatcaattcaacctgttgttgaacacgtaggtttattccatatcttcgctcttatgaatagtgctgcaataaacatggggttgcagatatttctttaatacaatgatttcccttctttgggatagattcccagtagtgagattgctagatcatatggaagtcctatttgcagttttttgaggaacctccacactcttctccatagtggctatactagtttatattcccaccaacagtatataagagttccatttcttctgcatcaacaccagcgtttgttatttatttttgtctttttgataataggaattctgacttgtgtgagatgatacctcattgtggttttgatttgcatttccctgatgattagtgattttgagcatttttccatatatttattggctatttgtatgccttcctttgagaaacgatgtccagataaatcactcatttttaaattagattattgtttctgtgctgttgtttgagttcattatatatcatggatagtagtcccttaccagatgaatagtttttaaatatcttccctcattctataggctgtaacttaactctgttgactgtttcatttgctgtgtagaagctttgtagttttatatagtctgatttgtctatttttgtttttgtggtcttaaccataaagtctttgcctggatcagtgtcctgcaacatttcctttatctttttttactagttttatagtttcagtctgatatttaattctctaatccattttgagttgattttttaatgtagtgagagatggtcttctagtttcaatcttctgcatatgaatatccagttttcagagcaccatttgttgaagagggtgtcatttttttcaatgtatattcttgacatctttgttgaaaatgagttgactgtaaatatatagatgtatttctgggttctctatcttattccattggtctgtgtgtctgtttttatacccataccatgttgtttttgtttttgttactattactgtgtattatattttgaactatctatattatattttaactaactatattatattttgtactatcgccagttttacccttttggcttggtattgcattgggtatttggggtcatttgtggttccagacaattttaggatgtttttccatttctgtaaggaatgacagtgttattttgataaggattgcactgaatctgtagactgccttgggtgaaatggtcattttaacaatattaattctttcagtccaggagcatggaatgtttttcaatttctttttatcctcttctatttctttcatcagtgctttgtagttttcattgtagacatctttcaccttggttaaatttatttctaagtgtctttttttgtagctactgcaagtaggattgcatttttaaattctttttcacctagttcattactggtatataaaatactaattatttttgtatgttgattttttttatcctgaaattttaatgaattcatttgccagttttaagagtattttggcagagtcattacatttttctatttatgagaacatgttgtttgcaaagagggacaatttgacttcctcttttccaatgtggatggcaatttcttactttctttttcctaattgttatgtgctaggacttctagtactatgttgaataagagtagtgaaagtgagcatccttgtcttcttccagttcttagagaaaaagcttccagtatttcttcattcagtataatgttagccatgggtttgtcatatatggtctttattgtgttgaggtatattccctctatgcctaatttgttaagaattttttatcataaagggatgatgaattttattaaaagatttttctgtctattgagataatatgtttttaaaattttatattgttaatgtgatgcattacatttattgatttgcatatattgaactatccttgtatccttggaataaattctacttgattaggttcattatgtttttgacgtgctgttgggttctattttctagtatttggttgagggtgtttaaatctatcttcatcagacatattggcccatagttttctttttttgttgtgcccttgtctggttttattatcagggtaatgctagcttcacagaattaattaggaagaatttcttaatcctcaattttttggaatagtttgagaaaaaatggtgttagttatttaaaagtttgctagaattcattagtgaatccatctggtcttggacttttcttttttgagagactttttgttactgatttaatcttcttatttgttattggtctgtttgattctgttcatttttggttcaatcttggtattttatacttgtgtctaggaatgtatccatttcctttatgttttttaatttgttggtgtatagttgttcctaacagtctctaatgatcctctgtatttttgtggtgtcagttgtaatatctcattgttcatttctgatattatttatttaggtctttttcttaatctatataatagtttgttgatttggtttacttttcaaaaactaacttttttcatgaatcttttgtttgcttttttgcctctaatttgtttcattctgtgctgatctttattatttattttcctctattaactttgggtttggcgtgttcttgcttttctattttttgaggtgtatcactaggttatttgaaatctttttttttttatataggtgcttattcctttaaacttccctcttgtactattttttctgtgttccataggttttttggtatgtcttgtttctgttttcatttctttcaagaagtatttaaaatttccttcttaatttcttcattaactcatttgtcattcaggagaatgttgtttaatttttatgtatttttacagtttccagtgttcctcttgttattgatttctaattataatccactgaaacctgagaatacatggtataattgcatttttgaaaaaattatttagagttgttttgggcctaacatagggtctaccctagagaatgttccatctgctgatgagaagaatgtacattttgtagccattggaaaaaatgttctgtaaatgtctattaggttcatttggtataaaatgaagcttaagtacaatgtttctttgttgactttctgtatagattagctgtgcaatgctgagggtgaggagggtgaggtgttaaagttctcaactattattacattggtgtctctatctctctctttaactataataatatttgccctatatatctgagtgctctggtgttcggtggatatatattaacaattgttctttcctcttgctgaattgattttttaatcactatataatgacctctgtgtctttttatctttttatttttaataaaagtctattttgtctgatataagtttgctacttttgcacactttttgtttgcatttgcagcaaatatcttgtttaatctgttctgttatagtctatgtgtgtttttaaatgagaagtgagtttcacaagcagcaaatagttgggtctcagttttttaattcagccagtttatatatttcaattagggaatttaaacggtttacatttaaggttgttattgataagatgaggatttattcttgtcattttgttagttgttttgtaattgctctgtatagccttagttcctttcttcttttattatttttgtggtttggtggttttctgtagtgataaaattttattcctttctttttctcatttgcatatctgctttaccagtgaattgtatactttcatgtttttccttaattgataggtaacatctaccaatgatatagacacatatctgcttttgcttaattgatagataacatcctttcgctttcagaggttggagtcccttaagcatttcttgtaggttcagtttaacagtgattaattccctcagtctttgtatgtctgggaaaattttatgtctccttcatttctaaagaatagctttatggtttatagtattcttagttgaaagttttttcttttttttattccagcaatctgaatatatcatcctatcctctcctagcttgtaagtttcttctgagaaatctgctgttagtcggacaaagataccctcatatgtgacttgatgctttcttttggtgtttttagaattccctttttgtctttactttgacaatttgactatcatgtgcctcatagaagacctttttggatttaatcgatttgggaacatttgagctccctatatctagatgattatctcccaagagttggaaacttttcagctattgtttcattaaataagtggcctatttattttctcactgcttttccttctggaatttctaaaacaggaatagactatttgtttgcatagtgatatcccatatgtcatgtaaacttttttcatttttattcttttttctctttttgcctaattcgcttatttcaaaagatctgtcttcaagatcacaaattatttcttttgctttatctagtctattgttaaacttgagtagggtgctttggctttgtttctgggagaatgcagtactgtagtcaccatatgatttcttcagcattagtccaatcagtagtatctatggcttcacagtgtcttatgctctagttgttcctgaaagctgtgatgtgactttactggagatggggcctccaggcaagcagtccttggatccctggggagtgcacacgcacctctggtggtacacattgcatggaccagttctcaggatcctgggtggtacacaaaggtacatagtggccctgttattgctgggccaagtttgctgggttgtgatggtggcacatcccagacagggcagtccttaagccctaagtggcacgtttggggatcagtgttcatggcagtaggtcacaagcaagctggtcctcaggcccctgggcattgtgtgcaggcacatgatggcccaattgctgcagggaacaaggtcactgtcatcagggaaggtggctctcaggctcttggaagcatgtgctttggatttctatgtcctggggagagcctccctgacgtgcaggactgcctattccctgggatttaggtctctgtgtgggctcaggtaacagagaccctgtggcaccattaggttcagctggtaatgtaacactgcaaccttctgggatggtgtcgggggatgtaggctgtgcacctgtgatgtggagatgcagcagcaattaggccccagggcaggatgtagtctggtgtgacacttgttagtgcatttttgatggcattgaaagttaccttggtgttactaagccaaggtcaaagaacattgtgatgattaatgctgaaagttattttttcataatttgaagattttttaaaatattaatcctggggccaaacacattaaaggaattaagaagaaataaatctggaaaattaatgtagacacagaatttaaaatgggaataaatacttttacacattcagcaaatacctattaagagacttcaggcaaaactatggaagtaagaggtcctattaagattctacagcaacttagggaaaagaaagttacttgaactggcgtagtagcagtgaatatgggggaaaagtgaacatatttaagaaaaatttaaaatatagaataaaacacatcttcaactatccttcaatactacagttcactaaaggtcaatgtgatattataatcagaacactccacaataagggaataacattgctaattctaatttagaagtggtcaatctctttttcagaaaatccaaaaaccattgtcaatcgcttccaccaatcctcatttgatctccaccaccacagttcttttgcaagtaatctcttccactaccttttactcattgttcaatttccagtacctttcatgggatttagcactcataattatggaatattaaataaataaacgaaggaataaataaaagaaaggttgtatttttacaaacccttatatttaatcagttcttagtaattgttgaatagttcttatggtccaaatcattcatcccttctatcaaagtttgtagctcatgatgagtcagtttatgcaaactgacctctgaaaatatatgtttaactatcatgagacatttgttgatggtatgaataatttttaaatgatcattgaaaaactttcagttttaaatatataactgcaatggataaacagaagacatttgtcattagagatacccttatttcaagaatctttagtcaatattggaccattgaatcatactaaaacataattataagcaaatattttaccacatgtgatcttcctctgtggtaataacaaaaaaatagtttaaagtctaagagtcctttaccattgattttaaatttttatttgtatttacattttaatgtagagagagctgatattctgagaattcacacgttttcacaaatgattcagaagaaaatggaaatctgttttggacccttattccctatatctatctatctatctatctatctatctatctatctatatggaaaatagtctctccctctctgtctctctctctctctctatatatatatatagtattagtattgactcctgaaagaaagcccatgagaggttaaatgcttataaaaaatttgaaagtaaaattttccctaagtaattcacaacacagatacgctaagaactaacttgtcaattgatctacctgacaaaagaggaaccagaagtctctgaatacaaaacaacatatcactctaaaagatcattgtattagtccattctcatgctgctctaaagaacttcccaagactgggtcatttataaagaaaagaggtttaattgactcacagttccacatggctagggaggcctcaggaaacttacaatcatggtggaaggggaagcaaacacatcctttttcacatcatggcaggaaggagaatgagagcccagtgaaggaagaagcctttataaaaccatcagatctcgtgagaattaacctcactatcacaagaacaggatgggggaaaccacccctgtgattcaattatctctacggggtccctcccacaacaacatgtgggaattatgggaactataattcaagatgagattttggtggggacatagccaagccatatcaatcattcttcacaagtaccagataagttatttgctattaaacacatctgtaacttttctaagaaaatctgtcccctacagaagatgcaagattgtgccaattctcatcacagctattcaaactatgattaattatctggaaaaaaaaaaaaaaaaggtaacccatctattcattggttttattttggacctacagcatctaggctggtacaaaaaagatctagagggccagctagattctttctcttttgtttgactgggaaaattctgagagaagatgccataatctgtgggagcagatgttgaaaaattatgatgttacaaaaagatcactggtaaagaatcatggctaaactaatataagataagcttatgaaggcacagaaacttgagagagcagtggaaaccactcagtattttaggcaaacatgtctgcttgactgtttaatggccatttctctttttttactaacaaatctctgattttgtttgtgtagtaagtgactagtaataaaggttaaattgtggctggtctaagcctagtgttcaattagaacctgtttattccagctcacaagagccgattctatgcatttcgtaccaactcagagttcagtgacatcacattggtagcttaaaacctgcaaaggtgggggtatttatgccacagaaataaacaaatgctacaaattaggactaccactccctctggcttctagtcagttgttaatcacttatcagcaccctctaaactcatcttggaaatctaattttcttttgccggtaattggctcaagattgagagaggaaccaagttttgacctatgacaagtaagagaaactgatgaaaatcatctgggaaagactttcttctctaaagttaaagctgcaagccagcttctttttccgttttaaattgtgttgtgtaatgtttggagatgcaatgctttaagatgcaaccaagagggaacatgaacagaattcagagatgcttacacattaataaccttgaactgggccgggcaaggtggctcacacctataatcccagcactttgagaggtcaaggcgggtggatcacaaggtcaggagttcgagaccagtctggccaatacagtgaaactccatctctactaaaaatcaaaaaaattagccaggtgtggtggcacatgcctgtaatcccagctacttgggaggctgaggcaggagaattgcttgaatccgggaggtggagttgcagtgagccaagattgcgccactgcactcaagcctgggtgacacagagagactctgtctcaaaataaataaataaataaataaaataaccttgaactgtcagaggcatgtgaatcagaacaactccatcttgaataggagcttggtaaaatgattttgaaacctactgggctgcattcctagacagttaatgcattctaagtcacaggatgagataggaggtcggcacaagatataggtcataaagaccttgctgataaaataggtttgcagtaaagaagccggctaaatcctaccaaaaccaagatggccacaagagtgacctctgctcatcctcactactacactgccatcagccccatgacaatttacaaatgccatggcaacatcaggaagttaccctatatggtctaaaagggggaggcatgaataatccaccccttgtttagcatatcaccaagaaataaccataaaaatgggcaaccagcagttctcagggctgctctgttaatgaagtacccattctttcatttctttactttctcaataaacttgctttcactttgcattgcagacttacccccaattttttcttgcacaagatccaagaaccctctcttggggtctagaatgggacccctttcctgtaacagaaatattaccaaccagggcaaccaaaatgcagaaaatcatgagcagtccaccatgggcatagaaaataatgtgcgttttctgtacagaatttaaaaataataattaaacatattaaccatcagtctactttttattatcctcctgtacggacaattctaaataatgttagccatgaaaatatccctctccacatagcttaactgctcctacccaagtcctccgtttgctagggctagtaaccctaaagccaagtatatcaaacatctaggtatatgagataaggaagggtttttgttatttaagtaacctttacatgagttttctgtttcttgtttatgttttgaactgcttaagttgtccatgaaaagaagcagatccagaatatcggtatatcaggttaatctagcactaaagggaaaaactattaattcctgctttaaggacctacaatatccctggatcccaggcctcccccagctctaatcatgcaaagattggtaaattatggttccccttgttgcatgtccagagtattctccctatgtgctgtcagtattactatgctaaactacctctacattgatgaatgtaagtaggttcctttgccttttaaccaaaagaaccgagaaacagaacctactattcaacagtcaaattacaaaaggcttttccaatataaggtgttgactgaatttactttgtgaagtctatatgaaggagatagcaaatagacaaaaatatgcttaatgttgttcataataattaaaattactgtttaaatgttaccaaaagagcacataaatgaataagttcttgaataatatacaatcatgcagaaatatgcagccaaatatgtgtaaaaaggcaagtaacataaatatgcatatatacatgcatgatacacatttgaaaatataaatatatattagaaaaatggtgaaaggaaaaaaaatcagttagcagtgattattattcctgagtagtggaatcaaaggccattaattttttttcccatacattttctatatttccaaagattttgattctataaaaataaagtagtttaaaaatatgtaattagcatacatttcattttcactaatgtatcatgaaaatatagttggtttctggaataatttttcattatgagaatgtatacatacatgaaagtaatgaagtcaataggttagactggaacaaatcaggtaactttaaaaaatgaagttggatattcatgagaatttgcattttataagaaagaatattatcacattccaagaaaatccttctcttacaaaaaaggaaaaatgtatatataatttattttagacagaggattactttttgagagaataaaaaagacgaaaatgtgttcacttctttgttcttacaacacaaacaaaacttgaattatgcttctgaggatattgatttatgagtatcttcacaatcctgtgggatattattctaatttgtgatgagataataatctgggcttcacatggaatctcaaccttgtctgttgtagttagatatttagacttgtttgtttaattctttagattagcactgtcaaatacatataatggttgttgaattatcatattgcatctgtgaaaggaaaataaatcttggagccccaaaattactaagccaaagggaaaagtcaagctgggaactgcttaggacaaacctgcctcccattctattcaaagtcatctctctgctcagtgagataaatgcatatctgattgcctcctttggaaaagctaatcagaaactcaaaagattgcaaccatttgtctcttatctacctatgacctggaagcccccttcccatttctacttgtcccacttttgcttcaatttgttccacatttctagactgaacctttgttcatcttacatatgttgattgatgtctcatgtctccctaaaatgtataaaactaagctgtgctctgatcaccttgggcacatgtcatcaggaacttctgaggctgagtcatgggtgcgtgtcctgaactttggcaaaataaacttcccaaattgactgagatctgtctcagattttgtggttcacacatttcaaatcgatgatgttttctcactaatatgtttttttccatgaggggagaaaaatttggttggaaaagaagcgcagggaaatcaggatttatttgaaaatctaggaaaaacctaagattctaggtattattttctaatatgttttggccatgaataggagtttcttttatagactcagtgtaaattgttaaatttaaaaagattacaagaggtcaggctcataatcccagagtagaccatggatgacacaactgctgctaatacatagcaacatattgcatccaaaaatacaatcaattaaatgtttactggattaaataaaattaatcttatttagtattattcttttttttttttttttttttttttgagatagagtctagctctgttgcccaggctggagtgtagtgacatgatctcagctcactgcaacctctgcctcctgggttcaagcaattctcctgcctcagcctcctgagtagctgggattacagacgtgagccatgacacccagctaatttttgtatttttagtagagcgggggtttcatcatgttggccaggctggtatcgaatccctgacctcaagtaatccacctgcctcggcttcccaaagtgttggcattacaggcatgagccaccatgcctgtcccagtattattctattttataaaattgacaagagaaaataaacaaattaaaagaataaaaacataccagatacagcaaggaagtcatcaatgcttgtaatgtcatctacggcttcagtgaggacatgtatatgattctcccatgtacgcttgtacatttccatggtgtttttgaccgcttgacttttgggtcttgcagccaaagcaagtgcagcattaataatctataaagataaggattgaaaaaattacctattggttgcaatgttcactatttgggtgatgggcacactaaaagcccacacttcaccactatgcaatatattcatgtaagaaatctgcacttataattcctaaatatataaaataaataaaaaatattaaaacaataaaataaaattaattaaattatactcattcatgttaaacataaaaaatggaatttaaaaaaatctgtaaagatgtagaacatttactcagtgatttatttcaatacattaagtgtattaaaattagattatttaaattaaattatggttaaatacattcatcatcgacaataggaaaaacagtaaaatgtctccatatatacagtttatattgaaaagtacaaaacgttttatatttattagtataaattatataggtataaataataatttttatttttaaaattttcctactccctctattattgcagagtgagttttttaaatataaactttgttaccataagctccatcaagttcaagacacttttctaagtgatgatatcaggcatttaatcaatccttaactgatgattctggtaatttaaacatgccaatccagtcttttttacattattaactggtgagaaatggatgcctttaacagatttttttttcaaattagtaaacaaaaagaaatcagaaagaaccaaattaggactgtaagttgaatgcccagtgatttcccatggatattcctgaaacattgcccttgtttcaggagagaaatgagcagaagcactgtaatggtgaagaaggacattctgttgacacattcttgggcatatttctgttaaagttttggttaattttgtcaaaccactctcaaagtaagcagatgttatcattctttggccctccaggaagtcattaagtaaaatgcctttagcatatcaaaaaactgttgccataacccttgttcttgactggtctgtttttgctttgactggatcacttccaactctcagtagccattgctttgattgtgatgtcttcagaattgtacttgtaaagccgtgtttcatctcctgttacaattcttcaaagaagcaattcaggatcttggtcccacttatttaaaaattccatcgaaagctctgctgttgtctgcagctgatctgggcaaaatggtttggatactcattgagtggaatgttttttcaactttaattttttagtcagaattgtgtaaactgaaccaattaagatgtctatggtgttggctattgcttgtgctattaatcattggtttccttcaattagagcatgaataatataatatttttttaatcacaaatggatgtggatgggctgcttctgtgagcttcatcttcaacatcatctcatctcttgttaaaataagttatcagtttgtaaactgaagatttatttggggcattgtctctatgaatattttttaaagcatcagtgatttcatcattcttccactcaaactttgccataaatatgatgtttgttcttcaattttagcagagtttatgttgcctttcataggggtttgatatagtttggctgtatttccactcaaatctcatcttgaattgtagttctcataattcccatatgtcatgggagggacctggtgggaggtacttaaatcatgaggacggttacctccatgctgttcttatgatagttgagttctcacgagatctgatagtttcataaggggattttccccttttgctcagcacttctctttcctgccgctacgtaaagaaggacatgtttgcatccccttctgccatggttgtgagttttctgaggcatccccagccctgtggagctgtgggtcaattaaacctctttcctttatggattacccagtctcagttctgtctttattagcagcattagaacagactaatatagggctcttttcaaactgatgtctctgatttttaacccgtcaaactagatcctgtccacgcacgttatcacaagttagcacaagtttatttttgtgcaaaaatgttgaattctatgcataattttttcataaaacacattttcagtaaaggttttgaagacctctcatacaatgacaacaataaaaagaagctttttctactgaatatcctaaagactgtaccttaagtcacttcctgtcaccacattattggaggtagaagacggaaaaaattagttgcctgagaataatatatttaaatcctctttttttgtttcttttctacaaaagaggaacatattaaattttaaggaaacacactaactttagaaataactactgtgcagtatgccttgacttcagttttagagttttattaacctattaacttacaatgtaccttcgtgtatactgcagtggctctggtccctggtgtttcattgttcttgcaattggacagctacgtacacatgtggttgtactgaaattatgccttcacagcaaagtatacttttaaagtactggtgtaaaaccctcagtggagatatgaagttatgaatataagacaggctacattttataagaatattttcagttctgctgctgatccaatttatctgattcaacactgcacactatgaagaagctttatcctacttgactcttgtgatatttagcttaaatctaaaagaagacacaattcagaagaattcttctaaccctctttagggcagaaaaatgttcatcccaatgtcacactcctagaattttagccatatatctagagaaaataaaataaccattcttaaatcttcttcacgtaaaactaaagcttttttttaaaatgaattatgttgctttctgaggcattttgtttctttaaattatggttgaaatatttacatgtcggtcacttgaccctgataattatctagtctgtcagtttacctttgaaacagtctcttttgagttcgggccttattatatcttaactgggccattctagtagccttgtaggtttctacttccagtctctatttgctcttagacattctccttaatgcaaacacatttctttctcaaatgccgaagtgatcatgccccccacttgctgataacctttgataaaatcctagttgactaaaaacaaacaccatatttcttttcagtaattcatagtctaaaaccgtccccaggttggtccttacctacagttcattctgctgtaataatcttactcattttagtctttgttccagccacagttttaagctccatttccttatcacaccactcatctttgtacctctgtgactgtttttagagctgaatctgccttaatgcccttgctccatccctttttctgctctactccgtctcaggaaacatttttcatacttaacatatccatggaaatatcaccacatactgtgaagcctgtttaaaaaatattttgtccatataaataaatagtagttattctattgcatgattgctcgtacacatgtctattcctgggtaatgagctccattataggagggactatgtattattcatctttgcttcttggtatactaaacatgttaattaccataaatgctatacttacaaactgtccctaagagaaactattctgctcgcagcccacactgagaggacagccacaggagggcaggtttggtattattttctcccacttcaacactatttaggtcataggcaggtacccaattcaagaagagttaatctgttggctggctggtgatggttatgaggtttgacataaaaagttgtgttgtgttaatcaatcttgaaaatttgaactagaatttatggagaaatcattagttagcagtcaagatcaaagctgaaagtttctgtaaagagcagccatcttataaaatcagaaccagagggggccaatggaactgaggctacaaggaaactagagccaaagtgcaaggaagaagaaactgtaaatagactgaacctataatgtttaaaaagaaaaaaaaataggccaggtgcggtggctcacgcctgtaatcccaggactttgggaggctaaggcaggcggatctcctgaggtcaggagtgcgagaccagactgaccaatatggagaaacctcctctccactgaaaatacaaaattagctgggcgtggtggtgcatgcctgtaatcccagctacttgggaggctgaggcaggagaattgcttgaaccagggaagcggaggttgtggtgagccgagatcgcaccattgtactccagcctgggcaataagagcaaaactccatttcaaataaaaaaaagaaaagaaaagaaagaaagaaagacaaaaataaacaggcaaaagcaaagtgtggagtaaaataagccagtgggtggcaagaggagaatggggaaaatatatcaagagagtcaataacatcaacagagagaaaatgatactcagataaaagaaaaaaaaagaactaggagttgactgtttttgagagtatcctattttggattacaaggccacagaaatgctaataacgataataataaaatactaacaaagtccatactttgcatcatgcaccactgttccaaacactttctacatattcacctaatttttttaacctaatttttacaccacaatgaggtaggtaggtgttgtcatctccattttcaggtaaggttaccaagttattaaggagaagttgtcaacttgacctagacttcatgctcttaattgccacactgtactctcttctataacaatattatactaatttatgatgctgtgagtaagtgatgatccttgaaaccataaagccatcactgaaggaaacattacaatgcctggtgtaaagaaaaacaaaagagagagagtgtgtgtgtgtgcatgtgaaagagagagagaaagaatatatatataaaattcgctaagttaaccatttataaaactcagtggcattaagtacattcacatagctgtgcaactatccatctccagaactttttagcacatcaaactgaaattctgtactcattaaacaatagcttcccattcttccttccccctagtacctagtaagctctattatactttctacctcttttgttgactattctagatacttcgtataagtggaattatacaacatttgttcttttgtgtctggcttatttcccttaacataatattttcaaggtttattcaagttgtagtatgcatcagaatttcattacttttcaagattaaataatattctacagtatgtacatactatgttttgctcacccattcatctgtcagtggacattgggttgtttccatattttggctgttgtgaataatgctgttatgaccattgttgtacaaatgcctgctcaagtcttggcttgcaattatttggggtatatgcccagaaatggaattgctggattatatgacaatttttttaaaaaggggtctcactctgtcacctatgctggagtgtagcggctcaatctcagctcacagcaacttccacctctcaggctcaagcgatcctcccacctcagcctcccaagtagctgggaccacaaatgcgcaccaccacacccagataattttttgtatttttgatagagacaaggtttcgtcatgttgcccaggctggtctagaactcctgagctcaggtgatctactggcctcagcctcccaaagtgctgggattccaggcgtgagccactgtgcgaagactgacaattctaaatttaatttatgaaatggccacattgttttccacagaagttgcaccattttgtattcatatctgcaatgcccaagagttcctattttttcatatcctggccaaaacttattttctcttttgttttttcttttaatcccaaccatcctaatgggtgtgaagtggcatctcattgaggttatgtttgcatttccctaatgattaatgatgctgaacatcttttcatgtgcttattgacgaactgtttatcttctttggagaaatgtctattcaagtattttgcccatttttaaattgttttttcttgttgacttttaggagtcctttacatattctggttattaatctctgatcatatatatgatttgtaaatattttctcccactctttgggttgcctcttccctctcttgctaatgtcctctgatatacagaagttttaaattttgatgaagtccaatttttttttccattttttgtgcttttggtgtcatatgcacattgccaaatctgatgtcacgaagtgtcactctatgttttcttctaagagttctatatttttagtcactatgtttaagtctttgattcattttgagttaagttttgtatatggcacaaggtggggcaaacttcattcgttgccatgtacttgttttcccagcaccaattgttgaaaagactatcctttacccatagaattatctgggcagccttgtcaaaaatcatttgactgtaaatgcaagggtttatttctgggatatcttttctatgccatttatctatatgtctgtatcacactgatttgattattgcagtttgtaatgaattttgaaattagaaagtgtgaggcctccaaatttgttcttatttttcaagattattttggctactcaaggtcccttgagattccatatgaaattgaggatgtgtttttttctatatgtgcaaaatacattgttggtattttgatagggattacattgaactggtacattgctttggttagtattatcatcttcataatattaaattttataatccatgaacatatgatgtcttttctgttttttatgtcttctttaatttctttcagcaatattttgtagttttcagcaaaaactacaaaggaaaagacattcaggtaaaagtctttcacctctttcgttaagcttattcctaggcatttcatttcgtatgatgctattattaagtgaaattgttttctcaattcccttttcagattgttcattgttcgtatacaaagacacactgatttttgtgtgttgattttgtattctactgaattctgttattagttttaagatttgtgtgtgtataatcttcaggattttctaaatataagagtatgtcatcactgaacagtgataattttatttcttccttctcaatttggataccaccaaaaaaatatataagtttttttattcgtttaaagttggattttgtcaggcaagtaaaaagaaaggaattaattggattgattgaggttataggaggagtacacagaactccaaggaactgctgaaagcactcaccagcctccttttaaatggggcttctgttattccaaggacattccctgcccacgctcgctcataagggctgtgtttgatcctcatttctctttcctcatagaggcctgtccaaattagctcctgttagaccctgtgcattaggttgtctgacaccccagaccaaagccagtttagttagcttcagctggtcccattctatcttctttaggcttctccccatttttactggtatatatggccaagacctcaacatgcttcaggctaagcttcctcatatttttctattaaatcagatagacaacttttactacattctaaactcatttaccttgggaaacccttgaacatctaaactacgttcagaatatttaggattttcagactgtctcaagattttctttgtgtccctctaggtattagaagcttgtatttacaggcatctcatttgtacagacgccttctaagacccataagagactctagaaatgtgttcacattgtcatttattctagtaaaacctgccacaaatagttttgggatccagctaaggggaagttgagttgaggatacatttagtttgtgtttagtgggtaatttcaggtgttttacagtcacttccctatattttttaccaccttcatacttgtggtattgacatcggatcatgatagaaccaatagagactttgcctgtcctaattatatgtgctctcctttctgaaacaccccccaaacaaactatgctaaaacaaagactgaattatcttctcagtttctacatagaaagtgacattacaaaataacttgttgtcattttagaggtgatcaagagtgtgcagtgaaagacagaaaaaaagaaaagaaaaaagttttatgagggtgtatctgacacatcatttatacaaatgtattatttttctggattttgctatattttgatatttgacagcattttaaaattagtatctagttggtttttgttttctaaataaatattcactttttcttaaggccctcaaaactctgtatactttaggctccacacagcctggcctatcacaatcaatgtattatttatttattataatttttttgagacagagtttttgctcttatcaagcagactagaatgcaatggtgcgatcttggctcactgcaacctccacctcccagattcaagcaattctcctgcctcagcctcctgagtagctgagattacagatgtgtgccacagtgcccggctaattttgtttgtatttttagtagatatggggtttcaccatgttgggcaggctggtgttgaattcctgacctcaggtgatccacccgccttggcctcgcaaagtgttgggattacaggcgtgagccaccgagcccagccaaacagtgttttttttttgttttttttttttaataaaaaaacctatcttctgaaatgataaaatgaacacatattcaactgcaatatttttattctttacagagaaaaatgacttctttcccttcaccttccttttgatgtgacagtggttttcttcaaaaaagttattttgcttttactatatgtgtaaaaatggaagaatagtgtaggagttataaaaataacattactgaggacctgcaatgtgccgggcatgtttctaattacttgatttgtattgtttttcatcccctgagaaagatcttatcagtatctccaatgtgctgacaagacaatggaggcacaaagagatgaaataacttgcccaaaattatagaagaaactctagattggaagccaagaggctcaagttaaagtttcactttgctttaaactgattttatgcccataaaaaaagtcatattacctctccaggacctattttcacagaaatacatgtatgcatacactgaggtggggtgtggagacagggtttgaattagctcatgccttagaggttcttcagattttaacatttgatttaatgctgatgtatatacttctcttgaaagatttctaaaaacaattacttaaaaggtgaaaataaatctacgtaatttaatttttcccagagatagttcaatattggcattgatacaaataatcttaaaaattttacttaatataacaaaagcactttgtggattaaaaagatgatttatatgtagtatctataggtctgattacctcagtggcacggcaagtagagaaaattaaaataactagatatatgatgcctcgaatacatctaaggttgtatgtgaggtgaatttatgtaacaaccacttaaattggtaacatcatcataatttcagaattctagcaactggagtaatggcatcaaattcaatgctctaactctgttcatccttttctcagttgcttaaatgatgttctactactaccaaatatttctcactttctacgtagtttttccacatttctttattttgataactttttctattttacctgctctcatactatacttcatctatggcaaattacctttacacttcaaattacggcatgtaatacttcccaccatgaatctccatgtcagaactttatgttaaatgataaaagcatttcagagtaggggagggtgtggtgctgaggagacctaacctgccatggactccaggtttacaattaatgaaactgcattcaactttggcctcacaaccttttttgtaatcttcttactccatgaagggatgatccctgcatgatgggatcactcacacggaaacttctcacaagactctcatttgccttggataaacgtataagaaaccaagctatcctattctaggggttaaaagtattttttaagaggagaaggggacaaagtttatttctgggaggatagagctttctgtgaaagtatatgccagtataaattttcgtatctcataaaacatactgctgaagaggaaaagttcaacctaggactatttcggttatggaaaatgtaataagtgggaaaaataatgctcccgggaggtctgtaaaaggcaataattccacatgaaaatcaaaacatttattttactgtcttttacactaaatattaagattggacaaccttccaaattaaataagtaaaagaggaaaagaatataaaatgcattgcttgtgatgataaaacaaaatcaccaatacgtagggtttgtagactaataaaaatagaatttggagtgaggactcccattttaatccagctccagtacttagttttgtgtggttttagacaaattgcttactctctgagcctcaatttcctaatctgtaatgatcattaaaatgcttgttacaaaggttgttggtagaattaaattagattatggtttgttcgtttgtttgtttgtttttgtgagatggaggcttgctctgttgcccagactagagagcagtggtgcagccccaaaaattcaagcaatgctcctggctcagcctcctgagtagcttggatgacaggcacttgccaccatgcccaactaatttacaaatgattgcttctataaagataatttgaaaataaaatacaagaatgctttagggatttaaaagaatactatacacaaatatatatacacacagaatttacaattttgttgaactcaacaatcattttaatattccaatttttttaagtctgagttaaataaatataaataagaaaaattgaatctacacacaattttttagggttttcctgtaacataaaactaaaataagagaaaaattgccttaaaactatctgataccaataacacatattacagtttaaagtaataaaaatactttaactggcaatgatgaaaaaataaatataggcaacagagattttttgatccattataatttgctactcagagatttaataagtttagaatttggagtggaaaaaaattggtactatctcccaaatcatttcagttcaaatggagaaatttaaaatgaatttaatatttttgccaaatctcctttttttaaaggacttttatgtcagaaacatctacaaagtttctctttaatgtaccatccaatttcatatagacataaagtcaaaatgtaagctattcattaattgccaaagtgtgtttcatataataagaggttggcaaaagttaaaaagaaaaaacaaggcctggcgcagtggctcacacctgtaatcccagccttttaggaggctgagggaggtggatcacaaggtcaggagatcgagaccatcctggctaacatggtgaaaccccgtctctactaaaaatacaaaaaattagccgggcgtggtggtaggtgcctgaagtcccagctactggggaggctgaggcaggagaatggcatgaacctgggaggcggagcttgcagtgagctgagatcgcgccactgtactccagcctgggtgacagagcgagactccgtctcaaaaagaaaaaaaaaaaaaaggcatgtatttgaaatgcctgacagcttgggattagacatattctttgtagacttggattcagctttggttttagcactaagaagagttcacataacattaagaaatttaactttcttaattgtcaaatgatttttgctctgtgtctaccatttatctaagttagagagcataagacaggagaaactcagaaaatatttcactttaagtgttctaagggagaaaagtcacgcataaatattcaataaaggacaacacgtatatgaaatctatgtaagcaatgttttccctgagttgcaagggcatgttaagaaaatatgagtacaaggtacaaatagggtcgaaatagttagggttgacttctctttctcattcctctctcattgttcatgctcttgcatggtctccttctctctccttctgatgggttcctagaaattttattaatatccttgacctagtattttgacctccaagatactatgtccactgccacaaccccactctacacgatcattatctctcagtgacaactgaggtagctttagttctgttcctagccactctctacaaagtgatatttccaaattactaatttcacaaaattcctgcctcctcttttatcataggatcaaagtcaaagtacttaatttagcctaaggccctgaaatatttggcccctgtttatttctctagcattatttcctatcagcacccctcgatttccactcttctttgtctaggggcatttgtctatgcttttctttctgtagggatttacctcttgttaggtaactccaatttatccagcagggctcacctaaagcattattttctcacgaaaactttattaaatctaggtcagtttcctagattgtcacggttgagcatttatcacactacctcaaatatatcaaatctaggtcaggttcctggattgtcgtgggtatttatctcaatatctcaaactttatcaaatccaggtcaggttccatctagggtgagtattgatctcactatctcttctcattaacgagatgttcattagagtgatcatctgatgaatgactaatctctactttccattgttataaaaaagcagtgatcttaatgtctttatgttattttcccagggtacgtggaaagtgccaaatagaatccctcttcccatgtaaccagggctccagtctaaggctccttctactttgcaagcctactaatttattaaaggcttttcccaagtgatcaagtctatccctacagcgaactcttataccagtagctatggtgatgaaaatatgtctatatggtcaggtatggaggttcacgcctataatcctagtgctttgggaggtccaggtggaaaaatggcttgaggacaggagttcaagaccagcctgggcaacatagcaagaccccatccttacaaaagagttaaaaaattttttaatgtacgtatcattttattttatttataactctgcagtcacaaaaaatagggccactactaaagtgcatattcaacagcaaagtgttcatcaaatatccatattaagctattctaaagattattccaagtgaatcaccaggctttccttgttgatccatcctgtgctcaactctagtgagtctcgagttagcaaaaggtaaacattaaagtgtgatttcccccatggaactgttatgctcaaaaactgaccattttgctatttcttcagattttaattatattacttggttagctagaggtcagaacaggaaaataagaatgaattcaagctggaaaggccatttagaaatactgtagcaattttaccacacatttaaggtaagaaaagctctataatctatttaaattgacctgaaacaaagttctttattaccagtataggtggtagattaaaaatagagtataataaaaatagtcagatgctactattaaaagagaatattggattttcccaactaggataggattttataaaaatcatatatatatatatatatatatatatatatatgtatatatatgatttttatcatatgtatctataaatcatacatttatgtttatatatataaaagagaaataaaattccctgagaatagaataatgtctttcttaaattagaagctttgtctatagtttgggcaacccaatctttgtatctttttattttaatcagtcaaattggtaatatataaaattattcagtaaattatatcatttataataatttaataaattatagtatttactgaatagcaaagatcattgggagtgattagaaaacataaattaactatacgaacttcatgaattactatattaaaattaaattatttattttctaaagttatgaagtattaaagtttggaaagaacatattttccattctggaaatggaaaaaaaagcatgttttctcattaaataattacaaacatttccatttaaaatttactactctattggagaattcttcttggcctcaacagattgcaaaaattgctaatgtttatttcattctccaggacctggagtccttaattgctgatgcatattcactggcgcatgcaaagtactgcagtgatgcactacttattgtaataattacatattaaagaacctatggcctacattcagtcagactcactttgtgagtttacttcttaagggggaaaaaaaaaaccctgaattaccagttacaaaatgagttagttgatagacaaaaattacccaaggaaaacataatcaataatatacactggaaaagagctcctctttgttgagcacagatctgcaatttgtaatttaaagtgttatttattttgttcagggcaggttgagctgtaacatgccgtgtaagagataaatacggctatggttcttaattacagactttaattcaatgggctatgtatagaaccaggaataaggtactactgtttcctgggagttggactatgtaaattagattgagtagtaggacacaaagctatgaataagaaggaattatctccggggaaatataggtgacaaacctacaatggcttttagcatctggcaggttctatttgaagagctaatgtcattctatgtaatggattaggaagaactggatgcactccataatgcaggccaagcataatttccatgatgactgagtcttctaacatatcagacactatagctgccttcaattttctagtctcattttcaaccctgtggtgagggatggggagggagaagtctgtatttctccatagtcagctgaggctacagcagctgtgaaagcaggatttgagggataattaacatgtagaattcatagaatcatgaccagttgaatgtgagagataagaattatgaaggaatcaaggacagtctcaaatttatggcttgatgatttaattaatgattatttcagtgatgaaaataaagaacacaaaatatatggtttgggtgagcaaaattattagttgagttatagacatgatgaaattaaaatattgcagcaaatctatgttgagatacacagatatcagaaacaaaatctggggaagaaaaatagatttttagagtcattgacatagagagctatagattgttgttgaaacagggtgatggattcagtaccaggaggtgaaacgacatgagagagagagagagagagagagagacagagacagagagagacagagagagagaaattaaaaaaggtaatccttgtggctcacacctgtaaacccagcactttgggaggtcaaggtgggcagatcacctcaggtcaagagttcgagaccagcctggccaacatggcgaaactccatctatactaaaaatgcaaaaagtagctaggcatggtggtgtgcacctgtaatcccagctactcaggaagcagaggcaggggagtcgcttgaaccccggaggcagagattgcaatgagccgagatcacgccactgcactccagcctggtcaacagagcaagactctgtctcaaaaaaaaaaaaaaaaagtaattccagtattcatgaatgtagacaaataaagaaatgcatccaaaaggaaatgctcagagtagtaataatctcaacaagaagatcatggtcaataggatcaaatactgaagactagtcaaataagacaaagaaataggggttcctaaattttggtacttatgcagatactaatgcctttaacagagaagttaaaggtagaaaacctacaacagtagcctgaaagtaacatgatgagaaaaaaatggatgatagagtagattatttgtaattgaacctaagtttatttcataggtacttattcttcattgagcgttgcactaaattatacactgtagttctttgtacctctctctttctctctgtcaaactctctctcttctattatacaactgggtatataggaaggaattttatgtatcctaaaatgtttaaagtgacatttatgcggtgaaaataagcttcactcttctgggtcaactgtgaaatagcataaaaagtccgaggttaaattagaagcaaagcattttctgtcaaacacagtttttactgaaaaaaaaaaagacttacataaaatatataactatgggtggctcatttagttgtatatggcagaattttttctgtcctctttccaaataactcgagtggtttcttcagtttgacaaatagttataaaaacaagtttgcagcataaaagaaaaggtggcaatcagctcctgcacaaaaactgattattaacttaaacaagtcatagaaactaatggtcaggattgcaattacagtcacaaagaccagaccacatctttatgtcagagggcatagagttcactcacattcaaggttcaatatgtttgaatacaaacacaagatgggtgattacacagaacccagtccatgaggtgacttcattcattaaccttggaaaatcctccattgaaattagacttttcttagtttatcgatgtttatgtgagataaactcaaggcaaacttgtatgacctcaaccatttcccttgtcactcaaggaaagggaattatttatttattaaattataaatgtatttataataattataaataaattgttataattttatttttaatttatattttatattgttataaataaattataacaatgaaaacattcacaatgctttaagaatggagtcttagccaggtgcagtgctcacccctacagccttaatactttgggaagccaaggctggaggatcacttgagaccaggatttgagaccagcctgggcaatatagtgagacccccatccatatgaatttttttaaaaaacttctctgtgaagttactaaaatcagcaaaaatgggttaatattctcctcaaagcagaaaaaaaaagatctccatagttcccaggtttttctttaagaacttttactatattgaaaggataaaagatctgtcattcctcagagcatatcacaaagttatcttccaaaaacaccctccacaccatcactacatggcataacttccctatcatgaagtagtaaagaatcaatcatagatattttcttaacattggataacacactgtttctcagggactgtctgcttaagggttttctaagacactatggcctcattgcctgaaaacaaccagttcctcactggctactctttaataacacaattttttattttcctttttccctccctcttcatttaattgatgtgcacaggagagcagataagggtgatgttcggctagtgatcaaaaaaatatttttgtcataaaaatcaacagaagcctctattctagcattttcaggtggtggtttcagagtctttcgggtaattggttttcttggactcagcaaaggcagacttgctttttctggggaagatatatttccagaggttagtgcttgtaaatctgctgttaggtgctggtatatttagtgactttggatctatggaatttgaacttgagaagtccttcctgtggcaaatttaaaaatagagcagcgttgcaacaaacataaccaaaaagaaagtgcttgcctttctgacagttcagcttgagtgcttccagagcagatagatacgtgactctcctgaatcaggcatttgagactttactgacgaaccttttaaataattatcaaaaggtcacttacatatgctgttagatagactaaccattgaaagcatgagaaaaactgctgattttaagtagtctgttgataggaactgctgtggatttaaagaaaagataaatgtcttctgtcacaatactgtcttattgtaaacaaattctatcctagctagagattcactgaacagaaaaggagcatttttagagacagttaatgtatcaggtttaactgattttcataatggtgtttttaaaaaattttccctagctttattattttatgattttctaacttatcagtatcatttgttcacacattaccatctatcttacctaacctgtagaacttccgttcaagtaatatggtgtatgttaaatgactattgttgtcatcattgctgttattgtcataattatattactcatagagttgtttaaaaccttgttgttcaaagtgtcatctgctgactaatacgacattggaaatgagtctcaatcatcaaggtttattagccagctatagtgtacatccggaaaaataggagccacagacacttttgtttttccaaagaggctttatgtgggtatttataaatttccttgaagtgggagagggcaggtagaaagaggggcaggtgagcaggaaggcaaatggctacattcccatgagacttgggttagtgcccagtaaatctacatttacataagattaatgaatgtttgaagagaaaaagagagtaaaggaagaagaaattatgcagatgtctctgggtaggtggaggaatgagtcttgacattgttctgcacctgggaagataagctcatactggtctttatcagtgtgaaatccaacagactttagttttaagagctagacttacattgtagccctgaagttacaattggcattcccttgtttatatgagaggccagcaaaaattttacttttgaatgatctatagggacagtccttttagatgcttgaggccttttaccttcccatggggatctggctaaagaataatgttagtgacagctattcatttggaagagggtgtggcaggacaggcttcattctcctttttgcataagaagtttagggttcctgagattttaaattttttcctttacaaaaaacatcagcatcacctgggagcttgttagacatgcagaatctcaggttctaccccagacctactgaatcagagcctgcattatagaagaaccccaggttattcataggcacattaaatatttaaaagtactaccttaaagggataaaattacttaggtaaaatacctataatagtcctggtcaatgtttgttaaatgttgtcttccctccctaactcagaaaatggattaactcattttctgtctatcttagaaagctgaccttcttttgtttgttatcaccaaacattatcatcataaataacaataataagaagaggtattacatccttactgttataaacattgggaatataagtacaagctatgatccctgaaatagaatatataatctatttaggatggcaggacattttatagaaagtacttaaatatgaggtatctatgtagaaaaactaattctctgtctatgaaaaatagcatcccaacaaaatgactagatagctggaacagtctcacttgaaatacaggcaatttgttgtacatgaaattcactttggaagtttctagtttagacgagttaacttctcagaaagttagatggttatctgtgagatgagcagaaactgagggacagtacaggaggaccacttggccactgattgagagagacttgccacatgtatctgctatcttggacagaaaagaaacaaaacagtttctgtaatgagtcaaaaactgaaagctcttagcctggatgtcctgaagtgcagaaataaagttgagccgttttttcatgtaaactgccataaacgtgagcataaaaagcagtatctttaggtcccctcccctcccctcccttcccttcccttcctctttctcttcctttctccctttcttcctttcttcctttcttcctttctagtacagagccaggcacctagtttaaggttatcagaaatttgggagagccagggttgggtctaggtgagggctgacaaaagaaccgctgcattccaagttctagtccatgaattgataagcctgtatctaccttttacagagctttcaagactgtatgaaattagatgttattccctctcaggctttatcttttaaaagggatggtcttcatgtgtgaattcttccaactcattatattccttaactttacgtaagtcttttccatatccactataaaaaaagtcaaagtatagcaatcagatctacatggaatatttgcggaatctgataacctgctttgagtttttttctctcaaaaagaaaaaaacctgttaataataatcaactattttagcccatttgtctgcatcaatttggtgatttcaatggagaatctacagggatgctcaggtgcctccttattgttatcccctgttcaaatctcatcattgtataggtgtggcttcaattattttctcttaagccaacattgtatttataccaaaggaatctgacttgtttcatttctgctcagtcttccagagctctaaatacttcctcaaatttaattacatcaatttggcatctccctggtgttttcattctgcactttctcttctggatcatttgcaagaatattcgtgtattagaaactcaacaattttttttctgtcaagtaaagtcctgattagccttccattgcttcccttcatctgagctacttccatatatgattaaaatctttctcagtataagaagtaaagttcctatattgaatgcatttctcaccaattcctttactaatctattaaaggattttaatgtattgttaggtaaaatgttctacagaaatcatccaagcttttctctataatgcatgtttctttagatattgtatgatactaaaacttgaaagtggtctggtcttgacattctacaaagtcaaaatttattttttctaatagataaactcttagattgtgaaacatgcacttaccccaagagagaagtctcctcattcttccccttactactcagtggattctaactttacaacacgtaagagatttatactattaaatagctgttaaagactaatttaagaaacttccatatgtctgtaaagtgtttttgcaatgcgtatttaaaacttgaaatttgcataaactaaagagcttttgcacagcaaaagaaactaccatcagagtgaacaggcaacctacaaaatgggagaaaatttttgcaatctgcttatctgacaaagagctaatatccagaatccacaaagagctcaaacaaatttacaagaaaaaaacaaacaaccccatcaaaaaatgggcaaaggacatgaacagacacttctcaaaagaagacatttatgcagccaaaagacacatgaaaaaatgctcatcatcactggccatgagagaaatgcaaatcaaaaccacaatgagataccatctcacaccagttagaatggcaatcattaaaaaatcaggaaacaacaggtgctggagaggatgtggagaaataggaacacttttacactgttggtgggactgtaaactagttcaaccattgtggaagacagtgtggtgattcctcaggggtctagaactagaaataccatttgacccagccatcccattactgggtatatacccaaaggaatataaatcatgctgctgtaaagacgcatccacacatatgtttattgtggcactactcacaatagcaaagacttggaaccaacccaaatgtccaacaatgatagactggattaagaaaatgtggcacatatacaccatggaatacaatgcagccataaaaatgatgagttcatgtcctttgtatggacatggatgaagctggaaaccatcattctcagcaaactatcacaaggacaaaaaaccaaacaccgcatgttctcactcataggtgggaattgaacaatgagaacacttggacacaggaaggggaacatcacacatcagggcctgttgtggggttgggggaggggggagggatagcattaggagatatacctaatgtaaatgatgagttaatgggtgcagcacaccaacatggcacatgtatacatatgtaacaagcctgcacgttgtgcacatgtaccctagaacttaaagtataataaaaatatatacattaaaaaaataaaataaaacttgaaatttgcagactttaaaatagaaattctacttttagaaatgtattctaatgaaataactaaggtaaacattgaaatttagcttaaaaaggctacagtattttttaataaataaacaccatatagtaaattaccaaaatgtatatccactaagtaagttagagtgcagaattttgtttgtttgtttgttttttcttgctgtgctgcccaggctagagttcaatggcgcaatctcggctcactgcaatcaatccctgcctcccaggttcaagcaattctcctgtctcagcctcccgagtagctgggattacaggtctctgccactgagcccggctaatttttgtatttttagaagagacaggtttcaccatcttggccaggctggtctcaaactcctgacctcgtgatccacccacctcagcctcccaaagtgctgggattacaggcgtgagctactgcacccgcccagaatgcaggtttttaataaaatgctatgcagccatgaaaaattacattaaacaatatttaataacatggaaaggggtttaagttattttaagtgaagaaaaaaataaattaaaaatatatgtgatacattttatagagacaactacctacacagaagaagctgaaaggttatacaccaaatattattcatcatgatttctggtagagaaattacaagaaatttctactttaaaatttttgtattttttaatgaattacatttctaaagatagtagaaaaaatgaagctctcttagagctgattcaaaatctttcctattagaacctctgttcatctctgaatcttatttcaattataaggaaagctgtgaatagcttgtaacaacatccaattcaccattgtgagttaattttttaaagtttcttctcccactgtatatggtgaaataggtgaatgtattaaaattgctaaattttgctttttctgaatttagctaatccttcttgagatgtgtgtgtgtgtatatatatatatatatatatatatatatatatatatatatatttgttcttcagcatttttctttattttattctatctccttttgagctaaatggatgacctatctgccagctccattagtaattttatttactgcttcagcctttgaaacaagttaatgcagaagattgaatagtattttagaatttacttcacacagtaatgtgactcaaggcttcattggctattatgtcccctttggcattaaatattttaatctgctaactatgacagatacaggatggccaatttcccagtaaatgtattagcctcctagtaaattaccctttcccaccttataccatgcagcctattaacctataaaatcccttctcttccaatataggcaagatgtcttaactgaagacttaatgttgaacacatcctaaagcttgagaagaccttatttcagagggttgggaaaggaaaactaatcattgcaagcaaactttaagttgctgagactacagatgtcactttggttcatttcctattaccatcgtttgatgaggatatagcccaaaaaccaagctagatgagtattttaataaatgtggactgagattgctttaacagaaaatataagaaatttctgtgtttttagtaatatatcctaggttcaaattaataaatctcttgattattctgtgccttaaacttgtatgaccatctagtcgtaccatttgagcaaataagttaccacctcaggaaaaatgaagtcagcactcaatttatatctataggataattgtgttttgttttgcttttatcttaagcccacactctagtaaacaaaagctatcagaagaaagctttgtaaaatattacagattgtgttgttaaataatactaagaactttcttgcatttcatggaaaagataatgcatattgtgtacttttcattattttaaatgtgtctaggaccaaataaaccaacggtgttctctgtccttctactggtttgggaaaagatttatgtaacaaaccattatcttctagttagaaatcatgaaagatgaggactgttgttcctgtaattaatcaccctatagtagaactctctcacagtgacttaacaaaatacacttatgtatgaatcttaaatatgcagaaggaatactaaagttgaacgggtaggatattttatcttcttttaagctttcatatggttaaataaaacaaaaattaaaagtctataaaacagaatgtatagctttacaaataattataaccaatacccaagttgtggaaaagaatattatcataaattacacacccttatatgctaatttttctttttaatgttaccgcataaacgtccctttctaaacagtataattttatttctttctgaaatttacaaaaacagcagctttatttcttgcttattttagtcaatactacacttgtgagattcatccagattgctatatgtacctataaatcatttattttgttgttccttttttcattatataaatataacacaaatccattctactgtcaaacatttggattgcttctaggaaattacaattaatgctgctattaatattttctcattcctatatgcatcagtgtcttcagattatgtgtctgggagtggaatggttgggtcacagagtgtattaacttttcatttcagaagacaatgctaaacatgtttctaaggtgtccatactgatgtagtctcccagcaacatatgagtatttttgatatttcacatcttcaccacttgatattgtcaatcttttaaattatagccattctggagagaatacagttgtgttttttattcggagttaccaataactaaagagattattctgttttctatatgttcattagatatttgggttttgtcatttgttattagtatatttaagtcacttgcccattcccaagtggttagcttctgtctttgtatattttgtatatctatatctacaaacatatacgtatgttttatctacataaaattatgtatgtacattatatattatatatttaaatataatatatttatcttctggatataaactcattgtcagttaagtattttgcaaatatatttttccatgtgaaggcttatactttcactctcttatggatgtattttgataaacacaggtccttagttttcatgcagtataattatctcctgtttatttttatgtttactactcttatttcctattaaaactttttcatatcccaagcttatgaagatattctacactatcttctaaaaacatatgtttttgctttcacttttaagttactaatccacatggaattggtttacatgaaagatatgagggagaactcaaatttcatttactttcacatgcatgtaattgtcacagcatcatttactgaaaagaatatattttccccacttttgtagcatcaaatcatcatcataataatcataataataaatgtatatttctgtatttttattccatttgtttatccttgattcagtacaacatggttggatcagtctgttttcatactggtataaataactgcccaagactgggtaatttataaaggaaagaggtttaattgactcactgtttagcatggttggggaagcctcgagaaacttacaaatatggtggaaggtgaaggggaagcaaggcaccttcttcacaaggcatcaggcggtagatgtgagtaagtgaaagcaggggaaatgccagatgcttataaaaccatcagatcttgtgaaatcactcactatcatgaggacagcatgggggaagccaccctcatgatacaattacctctacctggtcccactcttgacacgtggaaattatggggatcatggggattacaattcaacatgagattttgggtggggacacagccaaaccatagtcatggtcttaattactttatttttatcagatttgatatgtcccatggagtaattccttccatgttacactttgtttctgtcagagtagattatactgcaataacaaagaattttaaattgcagtgacttataacaacagagctttttgttttgtttttcttgctctctctagttgtccattttgggttgtctggagaatatacttgatttcttctaattctggagcccacactgattgaacagctactctcttgcacatattgctaattaccttagcagaaggaagtagatagagtgtggtgaattattaattggctcttaaatcttctagccaggagtcacaaatgtcactttcacatttcattaacaaaacacgtcacacgaccactcatcacctcaaccaagaggagaaaataaaatattggatagacagcactaatgattaacctaatcttttaaatgagtatataacttattcttgttcctttgatttttctttctttcttttttttttttttgagatagagtctgctctgttgcccaggctggagtccagtggcccattcttggctcactgcaagctccacctcccgggttgatgccattctcctgcctcagcctcccaagtagctgggactacaggcgcccgccaccacgcccagttaattttttgtatttttagtagagacggggtttcaccatgttagccaggatggtctcgatctcctgacctcgtaatccaccctcctcggcctcccaaagtgctgggattacaggcatgagccactgcacccagcctgatttttctatatgaaacttcttattaatttgtgaagttcataaataaatattttaaagattttggttggtattgcattaaatttataggtcagcctaaggttatttgcaagctttaaaatatttggtcttacaatccataaacatgaccatagttagattgagaaatacagatatagatttcggtcttcacacatgtttctttcaattatgatttttggttttctgcatacaggtcttgcataactttttgttacatcatttcttagtatctgatttttttttttttttaagatggagtttcactcttgttgctcaggctggagtgcaatggtgcaatcttggctcaccacaacctccacctcctaggttcaagtgattctcctgcctcagcctccccagtagttgggattacaggcatgtgccaccatgtccggctcccattttgtatttttagtagagatggggtttctccatgttggtcaggctggtctcaaactccgaacctcaggtgatccgtccacctcggcctcccaaagtgctgggattacaggtgtgagacaccgtgcctggctgtatttgatatttttgatattattgaatatattatattttataaaacttcattgcttatatcttttttctagtacatagaattgcaattgattttttaaaatactgacactgtatccagaaactggctaactcacttattaagtattataatttgtctttgcattgtattttctctacattaaattatttccaattcttcctctttctgttctttttctcatatttcatcctcaattagaatctctaggacaatagaaaagtgtgattgtaaacatctttattttatttccaattccaaaggaaagctttcaagtatcattattccattagatgttatagatttttttgtcagatgtcatttatcagctgtgaacattttccattgattcctaattggctaaaattctgattttgtcagatatttttctgcatgtattcaagtgatcatccaatattttagtattttgtaaattcatatgtttaattaaatcaattaaaaatcaattacaacaattgatttttgagtcttacagcaactttgcacttcctgaaaaatatgtatctttcttataatacatttttaaatgtttctagttggtcataacatattatccttttatatactattggatttttttgctaatatttattaaggatttttttgcattcatattcacgaagaatatttctctgtaatttttataatggaaaggttttgctattaaaattattctggcttaaaatatgacttgcctttctccatttttttttttttttttttttttgtttgagacggagtcttgctctgttgcccagcctggagcacagtggcgcaatctccgctcactgcaagctccggttcccgggttgacgccattctcctacctcagcctcccaagtaggtgggactacagtacaggcgcccgccaccacgcccagctaattttttgtattttttagtagagatagggtttcaccttgttagccaggatgctctccatctcctgacctcgtgatctgcccgcctctgtctccaccaaagtgctgggattacaggcgtgagccaccacgcccggccgcctttcttctttgaatgtctaattgaattaaccagtgaaatcatcaccactatgagattttttgtaataaccccttttctatttctgatattgattatcgtttttattattgatctgaatagttagaattttgtcagttttgttggtctcttcaaagtgagctgttccctttctcatctgttttctatttcattgatttctacttttgtcttcactgttttcttttacctgcttacttgctcacttactttcaccttgttaaggtgaaatcttaggactttagttttagattgttctccttttcttatataagcatttaaagctatgaatttgctgctaagcattaccttagcttttcctacaaattgtaatattttatattttccatgtcattcagtttgaaacattttctaattatcttgtaattttgttttaattcatgaattatttagaagtgtgctgtttaatttatagatattgggtgttttcttagatatctactttgatttctactttaattatgttgtggtcagagtgcacacctcgtatgattcttttttaatttattgagacttatttatggcctggcataggatctaatttggtttatgcactatgcacatgtgcaagaatgtatattttccagttgcatatactactctattatactaataagataaagacgtatctttaatgtcttcattgatttttgtctaaatgttctatttattgctgacgtagaggtgttaaatttactacaattatgaaattgtctatctcttaaattctatcaatttatgctccataaattgaggcctattatcaggcacatatacctttataaatgttatgtcttcctgatgaatgcctattttatcatgataaaatttttacaatctctcattatacacattgtcttgaagtctactttaactgataaactatcccctcaattctttttatgtttacagattccatgatatatcattttctttttacttaccttcagtctgtctttatagatctgtatctttatacttgaagtagcttagagtaaaatcttattttattttatccactttggcattctctatcctttaattggaatgcttaggcaagggatatgcaaaataggctcacaggccagccacctaatttagcaaaaatcgttttaaattggacacaaccgtgaccattcatttacatattttctatgactgctttcatgcaaaggtgattagctgagacagacaccatatggcctgcaagatgaaaatatttactctttggccctctaagagaaagtttgccaactgctagtttacatcattagcactcactgtaattactgatgtggataattttagatctaccgttttattattattttgttgttcctctattcccacttctttgttttctttttgattatttgaatatttttattatctcattgtaatttctgtctactggctgacttttttttaatctgttgattttctgcttataaatctctgatttttttttcagtttgttctagagattacaatatgcatatctaagctgtcatggtttactaagagttaatattgtattagttaatataaaacgtagaaatgctgctactttataaatccttttgccccattgaattttaggttatactttattgcttttatatacattgaaaaccccaccagataattattttttctttattaagtgaatttaaagagaaaaataactgttttctgcaattactctaatatttaccctttccaattgttctcaagacatgacggaaggtccagatatcactttggcatcattccctttcctttagccttttgttagccaatgttcggggcagatctggaaggtaataatttttctcaatttttattttacctcccttcctgaatgatatttttagtggatataaaattacggcttgacagttctattctttaaaatgttgtttccctgtcttctgaccttcattttttctgatgagacattctcatcagaaaaatcttattcaaatcactgcattcctgtaagtaatatacgtatcagtttcctctagctgttttgaaggtttttcttcatcttagagttttaggggtttatgatgtgtctatggttttctttggttatactgtttggggtttgctgagcttcttgatgctataaacttaagacttccatcaattcaaaaaaatttaagaccactgtttcctcaacttctgctccagtcactctcttgtttcttgtattgttacattagtaattccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctgagtaggagtctggctaatcatccaaaaatgtcaaaagagaaaccaaggtgaatttctttcccaagctgagatttgaaataaactgctagaagttgtcactgaatgtggatattagcaaataactttaagctacagaaacatcacagatttctgctttactacttttctgaatttgtaaaacacaaagagagggagagaaaaagagaggtggagaggtgggagggagtgggctagggtgagggcaagagcagggagcggggagaagaggatggtagggggagggggagagagaggaagtgggagaaaagggacaaagggaaggggagggggtagggagaaagaggggaagggggagggagggagggaggagtggggaggggtttaggtggcttttgaagtctaaagttcatttttcaatatcactatcactcaatattatgaacagggaactcacaggcagttgacagacacaggcaaggaatcatatgattagactaatcagtggaaggtgcaatgacagaggatggcatgggagcctatgaagaaagagatgatgtttctgtatattatacattctccagaaactaagagctccaatagtctatcgagacttcatttccctggcctggcgaggtggatcacagatgtaattccagcaatttgggggccaaggcaggagaattgcttgagcccaggagtttaagaccagcctgggcaacatagtgagaccctgtctctgtgaaaaataagataattagctgggcatggtggtacatgcctgtagtcctagctattcaggaggctgaggcaggaggatcatttaagcccaggaagtagagactgcggtgaatcattattgcatctctgcactctagcctgcgtgacagagcaagtctctgtctcggggaaaaaataaaataaaaataaacgagagagagaggaaaatttcatttcccttaacagcgaagggcttcactaaaaacaaatttatcatcctgccattttactaagatattgttttcacacatccccctttcaggtcattgccactcaaccatgttcaatctttaccctcctcatctctgagctggcatccatccatcttggttgatgattttttccagctcagagactcagtgccccagcacagcagttctccaagttacaataataaacttcatttgctcttctgactactctgggtcctgaaaatgttataactgacacagttgcagagccatccattggaacaactacactaaaatatagagattgtgttcaaacatgtatacttcacatttacagtaattactatggctttactttcatttgcttctctcagttttccttcatcttgcaacaagacaatcaagaaaaagcaggtagtaggtagcttctaacagaagaacagacaaaagagagcataaagaagatattagccaagaagtgatgcttgacatttttttcaaatagaaatctattaaggaccttaaaaaatcatctattatagccaaactggtgcctaactgaagtagtagctgagagtgcttcattgaaaatcaattagagtccaacctgattgtagacagtgtcccttcaacaaaactgacaagcattctatctctactttgataacatttgtatccaaaatgagaaaacactagagaaatatgaaaataaggcaatttcaatgtatgagttatatcccttaagttcatggatgacattaactaagttctgacaccaatacccctagggtgtctttatttcactcccccttctggaaatgattgaataatttataaaggatatatcttgggggtggccacttctacttcctgagctgcatacagaacataacatttttagagctcagaattgggttcaccaccttccattgcacagttaaagagactgcagtccaagaagggtaaggggtttgcctgctgtcacaaagctagggagcaatagaaccaaagttcaaatccagcaatgctggctgcaactctggtatcttctttgcattcttctgcttgtaccaaatcagatgttagcagaaacgcatggaatcctaggaatagtaaacaaagagaaactgataacaggacaatttacatacatggggcagaatgacaaaggaaaccaacctgggaagcgaagtctgccagggctggcagcagagaaagcctttgcttcctatctctacatcctaaaggaatgaggaggaggaagagagaagtaactgaaatccagaaagtactctgactatagcaaaggatctgcaggagctgtggccttggaaaggaacatgccctctgataaactgtggctttgtcaggaagaagctagagaataaaagctagacatcattttgctcctggcctctaatcacctcctagtgcctctcattagccttgcccaaccagaagccagagaacaaaggaggctgccccatcgatgttctcctaggaccataggaggagagaaaggggatgtggagggacaaatggaaaatattcagccaatatttcttagctgcgccagccttttgctttgcaatttagtcttccttaccctcctctattttctttcattgggacaaacattatcaaggttaataagagataatggcccatgtaaaaagagtattgtattcttttatggactttatctaaaatttactcaaatataacagaatcctgtagatgaagcataatatgcaacagatatactttgcaatatttaaaaatgattaatctcaaaagtaatcatctcagtactatgactcattagctggaagaaaacagtaataacatgttttgtgcacagaacaattttaattaataagcaggacatatttattcaaaaattataataagacattattattctcagaacatgaactttgatggtaggtgttagcatcctgttgggtcccagagaatgcacttctggatattaaacatgatggctttgagacctcaaatatatcagcttgtacagtcagctattatctacactgacaattgtttatggctacaaatcacccacgcttgatgtgatatctgaaagtacctcagtaagatattatgagcaatatcaggagtgggtggtgtaaaagtcatttcagtaataaaacagtattcaaagagttgattcaaaaggcagagccattactaataaaaataatataggtagatatttgttaaatgttttctttcttttgaagggcaatactatgaaaggagagtgagcatagggaagttgtctgcaacctctgagccacacacctttctttggtctaccacatatctgtgcagccattaagaatgactctcatctcttgcctttccaaaatgaggtgtaagagaagtcattctggtatagacaggagatatgttaccaaaacagtccaatggacccttttagggatacttcagttagaagttttagctctgtgtgggttcagtgtctctccacattacccctgagacctaaatcccacagaaaatcttaaaggcaatagatgctagttttccttatacctttcaaaaatatgatttgttttgttttgttttgttttgttttgttttgacagagtctcgctctgtcgcccaggctggagtgcagtggtgcaatctcagctcactgcaacctctgcctcccgggttcaagcgattctcctacttcagccttcccagtagatgggattacaggcacatgccaccacgcacagctaatttttttatttttagtagagtcggggtttcatcatgttggccaagatggtcttgatctcttgacctcgtgatccacccacctcggcctcccaaggtgctgggattacaggcgtgagccaccgcacccagccgacaaaatatgaatttttaaagaccaaacacatcagaacaaaccagctaacttgacttttaaaaaccacttgatttcacacaggtctcagatggagcaaaagtaaaaaaaaaaaaattaaaaaataaagacatcccacttgaattctagacaaaattttatattatctaatggaaatgttttttaaaccacataaactgatgagacatatcctttatcctctgaaagaaagaagaaaaaaacaatatttactagctgaacaaaatgccttgagtgaaatatctgtgagcatacatttttaatttcctaagatgaaaacagttttgagcaaggagctctcaaaaaaatgtcctgatgttctcctaatacaccaagaaataaaatctgtcaaagtgctgagattcttataggttttggtacatgttcccagttgatttgatctggctccagatgaaacatattatttaagcaagatagtaatcaaggtaactaacaattttaaaaattacttcaaagcatatactaaggcttgactagtgtgtatttattctctttccattatttctagacggagaaacaatttcattatattttaagttgtatcgaagcatttgttctggaactttctgatgcattagcagattctacctttaatatagtcatatgtgtaggtgtattatcatgcctgctagaccagaagaagtgaaagcctgaattggttatcgcattcccttttggagattaaaaaatagcattacaactatctgtgttgcatttcaagctaaacccatactttcatataaattgtttcacttggtctacataataatcctgtgaggaaaacagggcagcaattactgccccatttcatggatgaggaaattggcttagaagagttaagtggcttactcaaaggcacatggctgagcagttatggacctctgactcataactaagcccagttcaagaaaacacgtatttattcagtgttttaaaattatcaccctaagtcttttgggttcaaggtagtatacatatggcagactaatgaacaaaaagaaaagtaacatttatacagtatttattatacaagagtccctctcataagaactttatagataatagggtcattatagatttatctcatttaaccccatagcgaccttgttaacagtgagataaatctgtaatgacccataacaaccttgttatgcagttaaataagataaatctataatgaccctatgtcattgtcacgtcacagatgaagccgccgaggcacaatgcagatgattaatttgtatagaatcactgacgcattttttaaagaaattaaacaattaattagtgtgtattcatactagttgtacatatttatgaggcaattttgattttagagtccatgttcttaaccactatacatatttgcctccagagattccaaaacttacggacatcttttcattatgctacacagtctcccatgagcagagtatgaaaaaaatccagatatgaggccgggagtggtggcttatgcctgtaatctcagcactatgaggggttggggcaggtggatcacttgaggtcaggagttcaagaccagcctagccaacaaggtgaaaccccgtctctactaaaaatacaaaaaatagctgggtgtgggggcacgtgcctgtaatcccatctactagggaggctgaagcaggagaatcgcttaaacccgggaggcggaggttacagtgagccaagatcgcaccactgcactccagcctggttgacagaggagactctgtcttaaaaaaaaaaaaaaatctgaatatgaatctaagcaaacatatacacacaaacaggcatacatacctagacaaactatatgtctatctctacatctacctatctatacatacaccttatgctgagggtcttgaatatgattgataatcacattctgtgtggctaattgcatttaggccaggactcaaaaaaaaaaacaaaacatgaaataaaccaaaataacctagatgagtgagaaattctaagtttgaattttaactggggaggaaaaaagataaagaaaacttcacagattggaggccacttatctccacatttaactttcaaaacctttctcaaaatatctttgtatttaaaagaatccatcagtctttgcaaagagaggagagaaaatagacttgaggaagatgtttccttctgtgtgctgtgtgactcaggacacatgcttcttctgtgcaatgctttaccatcatctgccaaagacgtgtgtgcaaatatcagtcttgcaaacagacaatatttgcactacattgaggctaacctgccatctgcttatcagatgttcggagtccaaattgtacagttttccttgtgtttcccctaatgaaaaatggaatgctggggctctgattacaagtgtctgtgcacaggactaatactacatccctaggtagagtaatggaaacagtgcatctaggggaaatggcttatatattgacattgtttaaagaaaacagaattattttctgtggctcaggttcacatgaaatataaacctcctagttcactaaagtgtgatatatttttctcaaaatttggagaaccactgatgttctggacaactgtatttcagtgttaggcctagccgaatatatcaactaaaaatgcaatcacagtgaaaaattctaatgatatgcattatttctgaataagcaaatgccagaagcacaatcccaacatattatgaatgatgtgattgactaccagggttgctcgcagcccatagcttcaggtaacacagctgtctcctcccattaatgagaaaagagatagcattttctgtttaaaattaataactgtaacactccaggattataggaaaaattctaagtgtttcacacaaagtgcttcacaaaattttactgaagttcaacaaaatcattatataacaaatacatatgagaaattcttctttatggcttattctattgaattgcctattcatttttgccttcccagaatccacaattttcagcaagatgaatatgagcagaaataaaaatgccctttctatttaataccccctgctttcaattaaaagaaaactggttagtcatttagtatcttagaatatttcttacttataatgaattaggcattaattatattcttctatataaccaaaacaattttttagcaatggacaacactattattttctaattcatgttactttttttaagcatgcctttgggcattggatcactatcagcaatgtgcagagaatatcatcatcctttgaaaagctgtactactgatgtactttacagataaatagtaaaaatgtttaatgtacacctaaaacacaattgaaataaatgccatttcaggaatttgaaagtgtgttgaggttaccaagattatctgtgatccttttcaaacagcaataatttactcaaaaggctgtcatgtctgcttacaagactgtgcagatagttgacatagatgaaattagtattaatatattcattttaatttctacccatttactgtcttactaagggtaatttaactcagaaatgccgtcataatagggtgataatctgataatccggggtgcagtggaggcagggaagaaaggaagaaaaaaggaaaaacaatgacaataaatggcacaggcaagaagaaagcaataatgtaataattactaccatgttttgttcaattatcaccgaaaaatccagaaagatatgaaaggtgagcaaaggttctaccatgtttttgtaaagaaataaaagctcactgaaatattagggagaaatggaatcaaaagtaccaatgaaaaaagcaaaaataagataatttaaaaagaaattagaataagaaaaaactaggaaataacgttctttacatgtgaataatttctttttggttgagttgtaaatcacatatctgttattcaaaaatatttcctgattcatttgaaaagaaaacatattgaaaagggatctaaacaaaggttgtttttttttcccctctttaaatgttgctacctcaaacaagctgtaatctgagtattaaagtacaaaacacttaggaaatataattttccatgattactttgagcttcctgtaagtgtaacagtttttttactacagttttcctctctaaagacagaaatgcaccgtatgggcgcaaggatgctcatgccatagcctatgctcaaaagaggattcttagtctacattccagattcagctggagtctatattaactgcatccattcttttaatgttggccatcttgtatgggttggatgtcccaagaagccacttaactatgggtgtgattgtctattcaagaacctagaaaaaatggtaaactggttacataacaaataacacatcttgatctaagttgagaggactggagtcttctagctatattatttgaaaaaatgcaatcatgatttagtgacaaattgaatagcaacttcattaaccagaatttgactgtaaacccatgcaccgtcctagccagtatctcttttctccggaagagaggcatgggaggaggggagagaaaaaggtgagctatactactttagagtcttatgctagttctgtgaggtaaatgtaactactatttcctttatttaacaaacaaaaaatgaggctcaaaaatttaaacaacttgtgccaaagtcacagaggtaagaaatactagggcaggaattgctcccatgtctgtgtacctttaaaattcactttgcagctgcacagctgataagtctgctcagaagatttaaattataagaggaaaaaatgccttgcatccctggcactgtgcctagttctttccccaaactgaaaatgatacttgcaattttttgagccctcaccatgtatctggatcatttcaattaatcttgacaatgctggtcaagggactattattagtctcattttgaagatgaagcttagagaggtaaaataacttgccccatatcctacagctggtgggagacagagatggcattctcaccagctctctctaaactccaaagcctgtgctcttcccatttattccattctgctttctctccaggagtcttcataataactctgagttcagcagctgttttcaatgaggatataggctcaaagcaaatacaacataaccggtacatggttagatttctaagcctcttgccattccgccttgtggacaaggacatcaaatacaatgaaaaatgggtgccccgcaaatcaatacatctgttctttaatacctgtgatcacagctgtgaaataggcttaatacacagcctgaaaatattgttgtgaaaataactgtgtgtttggctgttaagtaaagttcagctggacacatgatctagtaagaggtgctaggctgctgcatgcaaaggaattccattagaaaagacagagaggtatgggaggaaaccgagcacaaagcagtgtgtccattgatgagagaagtcactcccacttcgcccacagatggtggcattaataaagatatcttgtacaatccaatgatgtgaatctcaatcttcagcatggataagaatcactggggagcttgttaagaatacagttttagtgtcatctcacctaagattctgattcaattaagtctggggtggtgcccaggaacctgaattttataaacatcccagctggttttttaattattattactattggtttctactttattctaggtttagtggttacacatacaggcttgttacatgggcaaattgcgtgtcactaaggcttgatgtatgaatgagcccatcaccaaggtagtgagcatagtacataacaggtagccttccaatccatgcccccccaccaccctccccaatgaagcagtctccagagtctttgttcctatctttgtgtccatttatattcaatgttgagcttccaattataagcgaaaacatgtggaatgtggttgtctgttcctgcactagtttgcttaggataatgacctccagctacatttcatgttgctgcaaagaacatgatttcattcttttttatggctgtgcagtattccgtggtctatatgtaccacaatttctttatctggtccactgtcaatgggcatcttggttgatgccatgtctttgctattgtgaatagcattgtgatgaacatatgagtgcatgcatctttttggtagaatgatttattttcctttgggtgtatacccaatagtggaattgttgggccaaatgatagttctgtttcaagttctttgagaaatctccacactgctttccacagtggctgaactaacttatattcctaccagcagtgtataagcgttcccttttctctgcagcttaaacagcatctgttgtttcttaactttttaataatagctattctgactgatgtgagatagtatctcatagtttgaaatttaatttctctagtgattagtcataatgaacattttttcacgtatttgttggccacatgtatgtctttttttgagaagtgtctcttcttgtcctttgcccacttttaaatgcaattaatatatttttgcttactgatttaagttccttacagattctggataataggcctttgtcagatgcacagtttgctaatattttctcccattcagaaggttgtctgtttattctattgatagtttcttttattgtgcaaaagctctttaagttaattaggtccttcttgtcaatttttgtttttgttgcaattacttttgggaacttagtcataaattctttgcaaaggcccatgtccagaatggtatttcctaagttttcttctagggtttttattgttttagttctacttttaagtttttaacccatcttgagttaatttgggtatatggtgaaaggaaggggttcagtttcaatcttttgcatatggctagccagtgatcccagcaccatttattgactagagggtcccttccccattgcttgttatcgtcaactctgctaaaggacaggtggttgtaggtttgtggctttatctcagggttctctaacctgttctatcagtctgcctgtttttgtacctgaatcatgctgttttggttactgcagccttgtagtatagttttaagtcaggtagtgtaacgcctctggctttgttctttttgcttaggcttgctttggtgattcagtcttttctttgattccatatgaattttagaataactttttctaattctgtgaaaaatgtattggtactttgataggaatagcatctaatatgtaagttgcttttggcagtatggtcactttaacaattctgattcttcctatccatggaataggaagaatatttttccatgtgtttgcattgtctctgatttctctcagcattgttttgtaattctctttgcaaggttctttaaggtccttagtaagctgtattcctaggtattttattctttttgtagcttttgtaagtgacactgtgttcataatttcgttctgagcttggacattattggtgtatagaaatgctactgatttttactcatagattttatactctgaaactttactaaggtcatttatcagttctagaagccttctggcagaatctatggggttttctaagcagagtcatgttgtcttccaagagtgagttagacttcctctctatttggatgccttttatttctttgtcttacctgattactttggctaggatctcctttactatattgaataggaatggtgagtgtgggcatccttgtcttatttcacttctcaaggggaatgcttccagctttcacctaattgctatgatgttggctatgggtttgtcataaatagctcttaaaatttagagatatgttctattgatgcctaatttcttgagggttttcagcacgaaggaatgttcaactgtatcaaaggctatttctttgcctattgagataatgatgtggtttttgttggtaattctatttatatggtgaatcacatgtattgatttgcctatgttaaaccaacattgcatcccaggaataaaccctacttgatcaccgtaaattaactttttgatgtgctgttagattcagtttactagtacttcattgagaaaattttgcatctctgttcattggggatattggcctgatatttttctttctttttttttttttgtttgttgttgttgttgtgtctctgtcacattttggtatcagaatgatgctggcttcaaagaataagctagagaatcccttctcaaattttggaataatttcagtaggattagtactagctgttttttgtatgtctggtagaattcagctgtgaatccatctgctctaggcctttttttttttttggttggtaggctttttattactgattcaatttcagaactgattattggtctgttcaggattttaatttcttcccagttcttgggagggtgaatttccaggaatttatcaatttctttcagtttttctagtttgtgtgcatacagctgttcataatagtctctgaggattttttgtatttctttgagatcacctgtaaagtcacgtttttcatttctgattgtatttatttggttcttctccttttattaatctagttattaatttattatttccctaaatagtcacaaacctaatttgtcaagttatagctcagttgcattacaaaagaagttcttacatcaagtattacagaagaatcagtagtatttgcttgggcagtacatgccatcagattatgaatggattataaatgcaaactgacgtgtgacttttaaaataccatgatctatccaatttgaaagagaccattaaagtggagatttcaactcctaccactataactctaaagtatgatctttactttggcagaatattacagacttagaggtattgtttttatcacttggttttgtttttatccatagcaaagccttcaataatatttcaggccacagagaaaataatacaagtttttgcattgttgatacttcaaccaagatagtcattcttttaatgtaggtctgctggtgtcaaattattttattgttccttcatctccgagaatttcttgatttctcctttatttctgaagagtatttattactggatataggatcctgagttgacaaaattttttctttcagcacttcaaaactattgtaatttttgctggcttccctggtttccgatgagagatccagtgtcatctgaacgttcttttttccacagagaatgtgatatttatttctgactgctttaaacatttgtctttaattttcagaagtttgtctatggtgtgatttcatgtggatttctttgggcttatcatgtttggggtttgcattatagtcccatacatttctgaggttgtgttttgtttttgttttctttaaagtctattttgtccctgttgtttacattgtgtaatttctatttgtattatttttcaatggactggttcttttctctgtctcctctgttcagctattgagcccatatgttgactttttaaattattattttattggttaatatttttagttctaacatttctatttcattcttctttgatttctttgctgtaacattctatttttttattctcctttggtgacattcttcccctttgcttatttttatttttaatttttatggctacataattgtacatattaatggggtacatgtgctatcttgatatgagcatacaatgtataataaaatctaggtaatttgaatatcgattatctcaaacatttatcatttctttgtgttgggaacattccaaatcttctcttcaaccaattttgaaataggtgatattttttcatttgttcaaggatgtttatgattgttcattcatttttatgatggctactttgaaatctttgtaagataattctaacatcgctgtcatctattaaatgtatttttttattcagcttgagatcttcctggttcttgatatgacaagtgatgtttgaatgagatggagacattttggttattatgttaaaagactatggatcatatttaaaattctggatcacatttctgctttagttggcttcttctgaaactgctttggcagaggaagaagagggttgcctcattactgcctggtgagggtaatctttaggggtaaaagtggttctcagttacatggatgaattgtataatggtgaagtctaggatattagtgcatgcattatctgaatagtgcatattgtactcaataggtagtttttcatttttaccccctcaccccttttaagtcttcgatgtctattataccacttggtatgcctttgcatacccatagcttagctcccacttataagagagaaccttcagtatctcgttttcaattcctgagttacttcacttagaataatggcctctagttccaaccaagttgccacaaaatacattattccattctttttatggctgagtagtattccatgataacatacatcacattttctttatccactcatcagttaatggacatttaggttgactgcatatctttgcaattgtgaattgtgctgcaataaacatatgcacacaggcatctctttgatatattcattccttttcttttgggtagatacccagtagtgagattcctggatcaaatggtagatctacttttagctttgagaaatctccatactcttttccatagaggttgtactaatgtgtatttccaccagcagcatataagtgttcctctttcaccacgtccacccgagcatcttttggggatttttttttttgactttttaataatggttattctggctcgggtaaggtggtatacattgtggttttaatttgcatttccttgacaattagtgatgttgagcatttattcatatgtttttgaccatttgtatattttttgagaaatatctattcatgtcttttgtccacatttcagtttttaagttgtctgtttactgtaatgattatttattttgctgtgaagaagctttttagtttgagtcctattcattatttttgttttgttggatttgcttttaggggtcttagttataaattatttgcctatgctggtgtccagaagagtttttcctaggtactcttctagatcttttatggtttcaggtcttagcttcaggtctttaggtctttagtcaaggtaaagttaatttttgtatctagtgagagacagagatccactgtctttcttctacatgtgactatgcaatttttctagcaccctttattgaacagaatgtcctttccccgatttatgtttttgtatgttttatcaaagatcagttggttttaagtatttggctttatttctgagatctctattatattccattgatctacttttataccagtaccatgctgatttggttacgttagccttgtagtaaaatttcaagttaggtaatgtgatgcctccagatttgttcttttcgtttaggttgctttgactatttgggctattttttggttccatgtgaattttaggattgatttttctaattctgtaaaaaatagtgttggtaatttgatagaaattgcattgaatctgtagattgctttggagtgtatggtcattttcatgatattgattgttctaacccatgagcaaagaatgtatttccatttgcttttgtcatctacaatttctttcagccgtgttttatttttcttgtagagatactacacctccttggttaagtatgttctagcatattttatctttttgtagctactgtaaaagggattgagttttttatttgattttcagcttggttgttgttgatgtatagcagtgatactgatttatgcacactggttttgtaatgagattttgctgaattcatttatcagatctaggagtcttttggaagaatccttagggctttctagatataagattatatcattggcaaacaaagataatttgactccatgttttacaaatcgaatgccctttatttatttctcttgtctgattgctctggctaggattccctgtactatgttgaatagaagggataaaagtcagcatccttgtcttatttcagttaataggggaaatactttgaactttttctcattcagtatgatgttggctatgggtttggaatatacagctttaattatttagaggtatgtttcttctatgtctagtttgttgagggtttttatcataaagtcatgctggattttattgaatgctttttctgcatctatagaaatgatcatatatttatttaaaaaaattctgtttatctgatgaatcacatttattcccttgaatttgttaaaccatctctgcatccctaaagtgaaatccatgtgaatatagtggattatttttttgatgcgctgttggatttggtttgctactattttgttgagcatttttgcatctatattcatcagagatttggtctgtagttttctcttttttgttaagtctttcctttgctttggtaccagggtgatactgggcttgtagaatgtattagggaggattctcttcttctcaatcttttggaatagattcaatcgaattagtaccaattctttggatgtctggtagaatttggctgtgaattcatttggccttggactgtttttgtttgtttgcagtgttttggtttttgttgttgttgttgttgttgttgttgttgtttttctaaattactgattaaatctcactgcttcttattggcctcttcaggatttctagttcttcctgattcaagctagcgggggttgtatgtttccaggaattaattcatttcctctaaattttctagtttgtgtgcatagagctcttcacagtagtcccaaataatcttttgtatatctgtagtatcagttgtaatatctccattttcatttataattagtcttatttggatcttctctcttcttgtcttggttttaatctacctagtgttctaacaattttatctttttgaaggagctattttttgtttcattggtcctttggattttttttgtttcaattttatttagctctgctctgatctttattattccttttcttctgctagctttaggtatgtttttttcttatttctctggttccttcagatgtattgttaggctgtcaatttgtgatctttcagaattattgatgttggcattttgcactataaactttcctcttagctttgcttttgctgtatcccagaggttttgataacttgtgtcactgttgttattcatttcaaaaattttttaaatttccaccttaatgtcattgttaacccaaaaatcattcaggagtagattgtttaatttctatgtatttgcatagttttgagggttccttttggaatcgattcctagttttattttaccgtggtctgacaagaaacttaatatgattttgatttttaaaaatttattgaacttatttagtgacctatcatataatctatcttggagaatcttccatgtgctgatgagaagaatgtatattctgtagttcttgggtagaatgttctgtaaatatctgttaggctcattttttctagactgaaatttaagtctagtgtttctttgttgactttctgctttgatgatctctctagtgctgttagaggagtgttgatgactcccactattattgtgttactatgtattttcttttttagacctggtaggaattgccttatgaatctgtgagctctagagttcggtgcatataaatttagacatgttatatcttcttgttgaatttatcctattttaattacataatgaccttctttgtccttttttaatattgttgctctaaagtctattttatttgttttaagaatagctactcctgcttgcttttggtttccatttgcaagaaatgtcttttttcaccccattagcttgaatctataagaatctttacatgtgaggtatgtcttctgaagatagcaggtatctatttggcttgcaaatttttaaaatccattctgtcagtgtgcatctttttaaagtggagcatttagaccagttacattaaacattgagatgtgaggtgctgttctagtcatcatattgattgttacttagtgactttgttttcttcatattgttattgttttataagccctgtgaattttatgctttcaggagtatttattctggtgagtaacaacaacttgtttcaagatttagtattctatttagcacttctcatagagctggtttagtattgacaaattccttcaccatttacttgtctgagaaaaactatttctcctttatctatgaaagagttttgctggacacaaaattcttgaccaacagtcattctgttcaggagactaaagataggaccccaattccatctggcttataaggtttctgctgagaagtctgcagttagtttgattggttttctgttataggttacctgatgcttttattttactgctcttagaattttttccttcatgttgactttagatagcctgatgagtatatgccttagtgatgttttgtttttgcaatgagtctctcaggagttctttgaccttcttatatttggatatctatgtcactagcaagtccagggaagttttcctccctggaaattttcctcaaatagacttttgaaatttttgctacgtttttctccctcaggaatatctacaattcttatgtttggccattttatataatccacatatttcttgagactttccttcttcttttaattcttttttgtttacttttgctgtgctgattgggttaatttgaaagccttgtttttgagttctgaaattctttcttctgcttggtctaatctattttaaaagcttttcactgcattttgtagttgccgaaatgtgtagtctttcatagaagttctgattggctttcctttaaaatatccatctctttagaaaagttttcattcatgtcctgaattaaaaaaaattatgttggttttcaactttatgttaacttaataatcaacttttttgaattatttatctggtattttatgttggttttcaactttctcttatgtctccttgattaacataataatcaactttttgaactctttatctggtatttcaaagatttcatcttgatttggatccactgctggagagtcagtgtgattgatttttttgagttgtcatagaacaactcaaatgttttttatgtttccagaattgtttttatggttccttctcatttgtgtaggctatttcttctaattattttaaaattagtttttgattcaattgggtttaaaaaaattttcctccttgaagatgtgactttaacatttatagtttatttacacttagtttcagctctgggtggtttcaagtggcaaagactgtatgagtttcttggttatagagaatcattgtgaagtgtctttctcagatgccggttgtagtggcagtgggctgggtgtgtgagtaggttcactgtctcctaaggggctggaatggcagaggtctcatgaagcttattttgttccccagtggtgtgcacctttaaaagtttttcttccagcattttattcaacgggttgagtagttcaggcttcaggccagtaggaggtgcccacagataaacacaggttgtggctaaagcgggtgggtaaatgtaatatccaacgattggatgaagtcccagctttgacagaggcagctggcaaagctctccgtgaaatacactgaggtcttttcatggggaagtgaaggagccaccccagctctccttccaggcaaagcaggaaagcaatccacctcccagtcacactgctgacctggtgttctagcttttcagatcaaacaggtatctctttctatctgcaagaatgctgatgttccctctaaagaagggttgtagctctacctcttgtgtaagtctgaacctgtatggcacacttcctgtggatagttaccttggagtgttccagaaagtctgtctacagatgcatccatgctgagctcccatgagagaagccccagctctctgcagtgttgggtgaggggaaaaagaaatcaccttctcaaacctttcatgagcgctgtttgactgttggggtagagctgcagactttccccactgagcccagcactgcacttgtgtctctcccgaaagaaacttctcacaagtgggaagttaagggactcaaggcccatggtctgctttcttttataccatgggatgctcccttaatgtggttcactactctttccccaaaaaatagtagtccctgaaagccaggctattctgaattctactgctcctctaggtctagctgtccagtggggctgccacagttcaggctgtactggagaatatctgcaagggatccagtgatgtgaactgtcctctagtttcccagcaccaggtgccagcattacctctgatgggggtgggtggggagtgacacagactctgagattttcttggttataaatagctttagtgttttggttttctcaaatgccagctgtagtagtagtgtattgggcacatagacagactcaagacgtcctatttagctaaggtaatactggcaatggcaatagctgaggttgcataaaagtttttggcttcctgagtgctgggttattgtttatgcagatgttttaatgggctgtgccggttggcctccagccagtaggtcatggcttgtagaaaagcaccagctgtggaggtagtggtagaatttgtgcttgctttatgtcactcaggggaggtattcctgtgtctcaggtaggtaatgggtagggccatggagctcccaaacatccctgtatattgcactgtgctaccagggcaggtggaggggcaaagctgggtatgggctaggtcaggcaactccttgctctggctcctcacatgcaggcacaagcagcggccccagtgaggatcataagtcaattccttggctactggggtaatatttcagggagtagcacagctgcctctgttgcacagaagaatccgcatgggatgcaggggttagcaagcagcagtaagccccactcagctcccatgcacttggcaaggcatgtatcccactcataatgttcgctaaaagcagcaggctgggttccaggtagtctgtacgtagaactaaaaactgccccaggccataagccgtcccagtggagaccagtgaaaccacagctttcaggccgcaccccttctggtctacctgtgaagcaggagtgcccagctcctgcgcccatggctatagcaaacttactacttgcccctcatttctggccaacagggtttatcctcactcaaggttataatctcatatctcagatgggagcttctctcaacctgtgactgcagcttgagttagctggtagacttctgtgaggtcccctgtgaggtaggatcaggaatggcttccctctgtccttgctggagtgtgaaagtgcaggcaatgtgcatcctgataccgcttcttctcaccccatcactcgctaaatcagctccagcactgggtagtgttaagatctgcctccatggcctgaattgcccggctctccggtgggagtgtgtgtcacggtggcagtctctccccctctcacacactctggagactcacagttttccatctggttcacagtgtaggctgctgtttcttctttcaaagggtctgtagtttctttcagtttttctgttaagttcctgtgttgcttcttagaaagaagtgcacattgtgaatctctgcacactattttgtctttccaagtgggagaggcaggctaacaatgcctccaaaccactgggccattttaaataacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatattaaatttaaagatataaattccaacacacatagatataactacatatagccaatgaagccaccaatcttgtgacacttctttgtagaaaaagaaatttccatgttgtagcatattgcattttctaaaaatggccagactaatattatgtctcaacccacataatctccctaaaatgggtctacactctttccattgaatctgggtaagggcttgtgactgctcctaacccacagaaactataagagataataaatgattgttgtcttaagtcaccacattttgggatgatttattatgcaccattagatgacaggaacagctgtgtgttatctttgttatttgatcttttgaaatatagtttaacttggaaactgaagacaagtttattcctttatttaaaacatatttaatatgtgcttactgctctttttcattgtgataaaaaactttcattgagagagaaacatctcttaatattagtttgtcaggtgttagaatccaggacccctgccctggaattgttcatgagtccaagcagttgtaactgcatctagcaaataatggtctgctttgctgtctccttgttaaaagtacttcaaaatgtatgcaaaatatgtcttatagccagcaggcttctcattccttgctagggactctgtaaatgaaaaacaaaacaaaaaacccaaagctacagcagaacacatttgaaattatgaatacaaccataaaaatggcaattctaaggtaaggtttgagaatacagaacttatctgagcctgttgccttcttctgtgcaaaagaaccattatagataaacaggcagcagatagtcacaattcaatgccatgatatgtggataaaacgaaacaaaggtcgagaaattagcttacttccagatgttctttgggtcaggctcatctatccctaacttctcatatgaaagttaaactgccacagcctgaaataatagataattgaaattctcattttcttcagaaaattctgcaattaaaatgttgatatttctttaaaatacacacacacacacacacacacaaacacacacacacacacacacacacacaaaacctgatatcaaatcttacattccctccacccagaaaacatgactaggtcatttaaacagtacttgaatatattcacagaaaatcagcaggtcaggtagaaaattactcaccctacacaccagttgtgtgagtgttgcagagtatgaaccgctgccaagatatctgtcattggcatatctccacttttcaatttgatacaatgtgtttaacctatcactgttattcagtgtactataactgctatacaagcacctgtgtgtttaccagagctttactattcccttggctagaaatatttccaaacaaggtactaaatataaatgcccgccattttcaaaaatatatatatataataaacattctccaaatattttaaaagcctacagttaccaataagcttttgtgtacataaattagagaataaggggcaaagaaaactttattagcataccattaagtacttaatttattatttttgcagtgacatccttgcaggatttcttctttaacatgaaaaagtcaacatcttaactgttgaaggctctgctttagaatcctaggggcatttccagacaagttctagcgattattgtgaaagtacctgtttctagaccaactctttaagcagaccactaaaaagaccttttcaaatcttccatgtaaaggaaagccttgaaagggagagagctagatagatacatagatacacatatatagatagatgatggagatagatacagagaggtcagatgataacaaagatcagattataacaaacttaaatgtaggtgctccagctagctaacagagaataacaaatcatcacacagtttagtgacttaaaacaattatcacataatttacaatctaaacttgtaaatcttgtcaacagcaatcaggagtccacattatcctttaaaccaaattttatttccaagtagaaaatattttcttatttaattgtatactgatctgaattcaatgtatcttgtacatgaaaatagcaacttggctctgctgggtaactgaagaccatgtttgtgactggaagcatgttattaatctacttaaaatcttcattccttaataaaatctactccctgtcaacatttattttagaaactgaaatctttgtgagcatagctatattggcatcataagctctaaatggaagactacttaagggcatcttcttatttctagtagagttaatatcattactaaccccaactattctgatgaaataggtatctagcataaacatcaatcatcttcttttataactcattgataattccccatggtcccttgctctatttttcatctgttgtaacacataaaggggttcaacaactactttattctaagctttctctgctgcaaaccgaaggttactaattcacttcattaacaattacaagtatttgtatctgtcctcacaaattcaaaattgaccattttataaaagacatatcccttctcttcattctacctttgttaggtatatttttctatttccaaatatttattttatttccaaatcatgattcattcaaataagttttacacaaagaagaaagtacaagatgtgtaacagctctagtagagaacatttcagctgtgccacaaaaagaaaacagcaatataatggtgtgctgacaaaataggccaggcatggaggctcatgcctataatcccagcactttcagagaccaagacaggcagatcacttgagcctgggagttcgagaccagcctgggcaatatgacaagcccccgtctctgcaaaaaatacaaaaattagccaggcatggtggcacatgcctgtagtcctagctacttggcggggttaaggtgggaggattggttgagcttgggaggttgaggcttcagtaagccatgatcatgctactgcacactagcctgagtgacggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagttgtaagaaataatatagagacatcccttgcaaactttatccccgtcttacaaaatgttaccacatcatccccctgtggtaacattttgtaagactatattttcagggtcttgacactgatataactcactgatcttatttttctccagttttacttgtattaatttttcttagtgtggtatgggtgggtgtgcaataagtctatacaattttgtcacctgtgtaggttcatggattcaccaccgcagtcaagatgttgaacagttcccacaccacaagagtattcatgttgcctttttataactatatccatctccctccttcaaaatcccacatcctcctgctagctcagtgcccccacacaaccactaactattccccatttctaaattttattatttcaaaatgttttataagtggaattatatagtatgtaatcttttgggatttttttcataacataattcttggagatttattcaacctaaggtgtttatcaacagtttattcctttttattgctgagtagtattccatggtatatatgtacaatacaaatatgttctcccattctttagcttgtaattttattctcacatggttttcacaaagttagcattttacattttgatgaagtctaattcatcaattttttaaattcacacttcatgattgtggtatcaaggactctgcctagccctagatcccgaatattttttcctattttgttctaaacattttgtatttatattataattttttaatattttacctttgtctctgatccattttgagtttatttttgtgtacagtgtgagacttcgttcggaactcattttgctgcctataggtgtcaaattgctccaacaccatttgtggaaaatgctgtctttcttctattaaattggttttgcatctttgtcaaaaatgtgttgaatatacagatttttgtgtggggatatttatgggtcccctattccagggctccccaacccctgggccacagacaactaccagtctgtggcctatcagcaaccaagccacacagcaggattggtgagtgaactttactgcctgatctttgccttctgtcagatcagcggtggcattagattctcatacgagctccaaccctattgtgaacagcacatgcaagaaatctaggttgcacgtcctttatgagaatctaatgcctgatgatctgaggtggcacagtttcatcttgaaaacacccctgcctccactcactatccgtggaaaaattgtcttccatgaaactggtccctggtcccaaaaaggttggggatcgctgccctattctgttccattgatctatgtgtctatgctctggcaatgtcacaccactttgattattgcagctatagtgtaaaacttaatatcaggtagagtacttttccccactttatttacctctttttattatttaactatttttgctattcattgtaaatttagaccacatgcatttatatttccaaaaacttgccaggattttgaagaaattgcatataaatccttttgggaactataatgaaattaaagaaagaaacagaaatgttctaggataacagagcaaaggcagataaagttctggcattggaggaagactaataaactaatacaatatgaaaaaaattgatgtgaaaaaatagaatatccacttgaaccatacatgcggacgtgtggataggcatcagcattccagcacaacggatgggacagaaacaaaaaatgagattatagcacaaagagttaactttaactatgtagtcatcacagaatgttatgggagcaaaacaataactcagtcacagcaatagaagtgtcaattttattataatagtgctgaccttttttggggcaagtggaaggggtagggagtagaagactgtcaataaagacatgtctgtatggaaatacagacatcttttgttggtaatctgctaaaaccacatacttttaaaggtgaaagagagatgaaaatacattatgttattaaggtatactctaaattgccaggcaagattgagaaaagtgatgaggcttccctgatagagactccacaattagaaccaaagcagtacagagcagcaacctgagcttccatcattcactcactgggattcccatcaacatacagcatccttggcaagtcttgttcagatggaaaagcagtcacaagaggagtgctcttctaatcctgtgctaaccaatctaaaagcatttgtgactgaagtagtggaaactctgaacaaaattaccttgtaaattttagtttatagtagcccagatatgtggccatgctagattccaaaaacttcagagaaaaatgggtataattaatgacctcttattctgacactttgagagggtttgaaggctatcaataataattctgtgatctcaagcaaaaaagaaaaaaaaaaagaaaaagaatgcggctgcacctcagactccatgagaagcttatatgtaaatggacaaaattcagaagaaataagtgcctcgcacaggccttaacacacaagttgtgctcaatcatgtttggtaaaagaatgaatggacattgtaaaaccaaaaattaacatctaaagggttcatacactacaagccaggagagtcaaagtatatatcatctgttcatctaatcattccatcattaatttattatgagcttcttgctttcagggtcccatagtccagagtgaaaaagtgatatgcaaaccaaaaaatcaaaatacaggaaagtaactatgactaggtaattgtttaaaatactttgggaacaggcaggctggagttattaattaactatatttggggaaaagaagactacaaaagtcttcacaatgtagttaacatttaagtaattttgaagaatagcagagatagagagttataaaaattactcttttttttttttttcttgagacagagtcttgctctgtcgcctaggctggagtgcagtggtgtgaccttggctcactgcaagctccgcctcctgggttcaggccattctcctgcctcagcctcccgagtagctgggactacaggcacctgccaccacgcccagctaaattttttttttttttgtatttttagtagagagggcatttcaccttgttagccaggatggtctcgatcttctgacctcgtgatccacccgccttggtctccccaagtactgggattacaggcgtgagccaccgtgcccagccaaaaagaactctttatatatgtttttgaaaagaagaagaaaagagaagcatatgctatcaaaaaagaaattcagtgctggaatgataatgagctcagagcaaaagtaaagagataaactgcctatagattgtttggagagcttaagttgaaccctccctagccattcccaaagatgcaagccccctataaaaatttggagcacctaacactacaaagtttgaaagaatattatctttgatatgattcctccctgtctgttaacttccatgtttccatcccattggccctgcttttatgtatcctccattggcctaacagctctcaaccagaggttttaaaccctgacagctcattagcatcaccagaagaacttttacaaaagccttccacttgtgtcccttccccagggattctgattccactggtttggggtaagggaccctgtgttgcccacagcggctgatgcccatcaaaagggcattaggaaaatcactctgcgggaaatcactctggcccgccatggtgaatgagtgtttttaagaggattaaacaaacatcaaaaagaaaaaaattaatgtcatggagttccataccatcttaagacttaatgattcatatgccattacacagaaggaatttgcccaagatagctatgaattgtagccatgatctctaaaaaagagtcgaatatgcgaatcctacctaaagaccggggacaagtgatccttaattcatacaaacagtaatggggagacactaaaatgttttctgaagaacattgacaaattaagatttgcacattataagaaatattctagctacatacaagaaaaaatgattgtaaaaaaatcaaagatgattcccagacttttgtttgggaaaccagatgaacataaatacaattcatcgagaggtaatggagaaaaaagtacaggcgtggcagcggaattagatgaggacagaagttctcctttagatatgctgatttttgggtatatatattacatagtggtttatacacaggttggaaattcaggagaaaaatcattacagatgggagatgtgtatttgagatccatctgcatatagctgggttgttaaggcaaagaaatagataagcttgttctgggagggtgtgtagaattctctttaggagaagaatacctagggcagaatttaaaggaacgctaacataggcagtagaaaaacacccacaaagtagattcataggaaatggccagagaggtagaaggaaaatcaggagagtgtggcataataggtgccagaagaaaagagtgtttaaaggaggaatgattgaacaatacttgcaaacattgcaatgatttcagtggagaatgcgactgaagtttgattagagtgaattaaggagtagatgggaggtaaaataaaaagtagaaataagaattagaaaaggtttataaagatggtggaagagaactttccagtgcttatccccacagagaaacattaatttgaacaaatatccatgcacaaacaaaagttcacaagagctaaagaaaccatgtgagagattacagaagctgagtggagcacagaaataagaaagacacactgataaaggtaagaaggacagttttaaatcacctgtgaagccgcttcacaaactgtatacagcacggacacagacagcagcaatacccaacccttacgggaaggaaagtgagcaccaaacttactgtggaacccaacactgggcctgctccagcaaaacccaacttcacgcaggcacctatggccccagactccaggctgatacctgcagactaagcttccaggcccacctggattctaggatagctcccacagccctgggatccatgcctgctcaatagactcaatctctgggcctgccccactgccaggctgaccccagcagccctaggctcgggaacagccccagtatcaggcaagccctaccagccctggcccttggtcagaaccagacatcacagatgtaggcataagcctgacccaggaccaggcctgacacaggccagcaccttgggacccagcctccaggttaagccccacagactcgggcttcaggcttaccccaggtttcagacaagccggaagctaaaacatcccatgcagtcccaggcctcaggccccaacaccagattagcactcctggtctcaatagcaggggactcaaatatcccactttcagcaatgaaaaaattatccagaaaaaatatcaataagtaaacatcagattaaaactacactttagaccaaatagacccaacagacatatacagaacattcccattaagcagcagcagaatatacttttttctcaaacacacacagaacattcttcagggtagatcatatgttaggtcattcacaagagcttaagaacccatgtgggagattacagaacccgggtgtagcacagaaatattggcaaaacaagtcttaacaaatttgaaaagatgtaatcatattaagtattttttctgatcataatggtaagaaattagaaatcagttaactggaaaaatttcaaaaacttcacaaatatatgaaacttaaacaatatgctctttaacaaccaacgaatcaaagaagaaagtaaaagagaaattaaaaactattttgagataagtgaaaagagagacacaaaacagcaaaactcatgatgtgtccggaattggtgggttcttggtctcgctgacttcaagaatgaagccgcggaccctcacgatgaatgttacagtttttaaagatggtgtgtccggagttcattccttcagatgttcagatgtgtccagagtttattccttctggtgggttcgtggtctcgctggcttcaggaatgaagctgcagaccttcctggtgagtgtcacagctcttaaaggcggcgcatctggagttgttccttcctcccgtccagagttgttcatccctcctggtgggtttgtggtctcgctggcttcaggagtgaagctgcagaccttcacagtgagtgttacagctcataaaggcggtgcagacccaaagcagacccaaagcttccacaaagaacaaggcttccacagcctggaaggaaaccccaacacgttgccaccgctggctcgggcagcctccttttattcccttatctgaccccacccacatcctgttgattggcccattttacagagagctgattggtctgttttcacagggtgctgattggtgcatttacaatcctttagctagacacaaaagttctggaagtccccactagattagctagacacagagcactgattggtacatttacaaaccgtgagctagacaaagagtgctgatcagtgtgtttacaatcctttagctagacacagagtgctgattggtgcatttaaaatcctctagctagacataaaagttctccaagtccccaccagattagctagatatggagtgctgattggtgcatccacaaaccctgagctagaagcagagtgctgattgggtgcatatacaatcctccagctagacaaaaaagttctccaagtccccacctgactcaggagcccagctggcttcctctagtggatcacgtgcaggatccctgggctgagctgcctgccagtcccacaccaagtgccgcactcctcagcccttggggggtcaatgggactgggcgccgcagagaagggggcagcgcccatcggggaggctcgggccttgcgtggggaggggggttggggggcagtgctcctgcatggcaggctaagggtcccaagccctgccctgctgggagacggctgaggccctgagagaattccagcgcagtgcccgccggccggcactgctgggggacccagcgcaccctctgcacctgctggcccgggtgctaagcccctcactgctcggggcctgctgtgctggcctgcggctccgagtgcggggccagccaagcccacgcccacccagaacccgcattggccggttcccacccgcgcctctccctctacacctccccacaaggaaagggagccggctcctgcctcggccagcccagagaggggctcccacagtgcaacggctaaaaggctcctcaaatggtggccagagtagatgccaaggccaaggaggcaccgagagcgagcaagggctgctagcacgttgtcacctctcaatgagatgcagcaaaagcagttctaagatagaagtttatagcaatagacacccataataaaaaggaagatcccaaataaacaaatgttacacctcaaggaactaaaaaaaaaaaaaaaaaaaaaactaagcccaaagttagcagaagaaaggaaataataaaaatcagagcagaaataaatgaaatagtgactgagaaaatgatagaaaaaaaatcaacaaaagtggctttttggaagttaatcaaaatggacaaatctttaagtagactaataaaaaagagaaagactcaaataacattatgaatgaaggaggggacattacaactgataccacagtaatgcaaaagagtataagacactattatgaataattatatttcaataattgaataacctagaagaaatgggtaaatttctagagatatcacccacccagattgaatcaaaagaaagagaaaatccaaacaaactcataatgagtaagaagattaaatcagtaataaaaagtctccaatcaaagaaaacccaggaccagatggcttcactgcttaattttatcaaacatttaaagaagaattaattccaatccttctcaaactcttctgaaaaacattgaagaagaaatacttccaaactaatttcatgaggttagcattaccaccataccaaatccataaaaggacactacaaaaaaataaaattacatgccaatattcctggtgaacatagatacaaatatcctcaacaaaatactagcaaaccaaattcatcagtatatttaaaggaacatttatcatgatcaagtaggatttattccagagatgcaggtatggttgaatataagctaatctagaaatgtgatacaccacattaacagaataaaggacagaaaaatatgatcatgtccatggatgaaaaaagcatttaacaaaattcaatatccttttgcaataaaaattatcaaaaaattagatatacaaggaacataccttaacacagtaaattccatatatgacaaatccatggctaatatcatactggatgcctctaagattaggaataagacaaggattcccgttcttttcggttctgtctaactaaagtgctgtaagtcccagccagagcaattaggcaaaagaaaaataaatggcatccagattggaaaagaggaagtcaaattgcccctctttgcagatcacatgatcttataaatagaaaaaattagtgacctcactaaactactcttaaaactgatacattcagaaagttgcaggatacaacatcaacatacaaaaatcagtagtatttctacagactaacaacaaactctccaaaaaagaaatcaagaaaactatcccatttataatagctacaaaagcaataaaatacgcagaaataaatttaaacgaggtaaaagacctgtggattgaaaactctgatacattgataaaagaaattgaagaagacacaagtagagttatcccatgttcaatgattaaaagagtttatattgtttaaaatgtctgtattattccaagcaatctacatattcaatgtaatctgtattaaaatgccaatgtcacttttcatagcaatagaaaaaaaatcctaaaattcatatgcaagcacaaaagatgctgaatagccaaagcaatcttgagccaaaataacacaatcagaggtatcacattctccaatttcaaaatatactacaaagctatagtaatcaaaacagtgtggtactggcataaaaacgtacacaaagaccaatggaatggaatagacagtccaaaaatgaacccatgtatatatgatcaactaatctctgatgagggtgccaagaatagaaaatgtggaaaagataagtctcttcaataaattttgttggggaaaatggatatctacatgcagaagatgaaattagacccttttcacacaccatatgtaaaaatcaactcaaaatggattaaagatgtaaatcaagcaatacctgaaactgtaaaactgctagaagaaaacatagaggaaaatctccatgacataagtctgggcaatgattttttggatatgatctcaaaagaaaaggcaacaaaagtgaaaatagacaaatgggattacattatgctaaaaagtttcttcacagccaaggaaataattaacagagtgaagagacaacctatggaatggaagaaaatattgtaaaccatatatctgataaggagttaataccaaaaatgtatgtgaaactcctcaatagaaaaaaacccaaataacccaattaaaaaaataggcaaaatatctgaataaacatttctccaaagaagtcatgcacactggccaacatgtatatgaaaaactgttcaacttcactaaccattaaggaaatgtaaattaaaactgcaatgagctatatcaccttatacctgttacaatggctattatcaaaaggaccaaagataagtattggagaggatgtggaggaaagggaactcttgtacactcctggtgggaatggaaattagtacagccatatggaaaataatatagaggtttttcagaaaattttgaaaataccactacaatatgatcttgtaatctcacttctggatatatgtccaaatggtatgaaattagtatgtcaaagagattgcctgcattcccatgttcctcacagcattattcacaatagccaaaatatggaatcaaactaaatgtttgtcaacatatgaatggctaaagaaaatatggcatatacacacaataaaataccatttggtcttaaataagaaggaaatcctgtcatttgagatgacatggatccacctgagggacattagtaagtgaaataagacaggctttaccacatgatctaacttacatgtgaaatctaaaaaggttgaaatcatagaagcaaagagtggaacagtggttaacatgggctgtgggatggggtggagttggggaaataatggtcaaaggatacaacattgcagctggataagatgaacatgttcaagagatctattgtacaacccggtgagtggagttaatagaactgtattcctgaaaattgcttagaaagtattttgtgttcttaccacaaaaaaatgttaactatgtgaagtaatgcatgttaattatctggattcagcctttccacaatgtatacatattttaaaacatcatgtggtacatgataaataaacacaattttatttgtcatttaaaaaattacttaaggtttagaaagtagaaattagaatagttacctctttaaagatatttgcacaattaaaaagatttttcatgtttcttttttgaaaagtaacatatatacaatctagtactaaaccttaacagatagttattattttaagacgacagaaatgtgaacattttacttctgatgaagagaatctataagagagaaagatggtgatgctaaacaaatgagaaattataattattaaaatacaacaaggtatctgggatagaagcaagacaggtggaaagattcactcatgctttgccctgccaggagggaatattccagtataatgggcagaaaggaagaaaacatggaatgaatgcagtatgattaaaagtctggtgataggataaggatgcatctctagtctagtggcttcaattttctcagcaaagtaggaggacaattctgatagtaaggaaggaatggcaggattttaggtttgagagggtgaagcgggtgaaagcactgcagagacactgagggagataactaggaattacagaagaattgccaaagagcattgaagtctcaaaactcatcttaagttggataagtacacaattttaggagcagtgataggtaaatggcagaaagtatatacaagtattaagtaacttcaggctcaattccatccaccgaaatgttgggacttacagaaaagcagattcaatatggaagacgtggctcatatctgtcataggaataacagaagaagtagtagtaaacgtttattgagtacttactgaatcttctgtttaaatgttttacataaattttagtacacggccagtaaatagtgttattattttcagtgttctaatgagaaaaccacagcacaaagaagttgagtaattttcccaaggtcaaccagctacaaagtgcagagttttaaacagtgaatccaatgcatgtccagagaaaagtgagcaggacagcaaaggatctctgcaatataaggaagaattagataattgaggatattttgcctaaataagacaggcagcagcaaataacgattgcttcaatacttaagtagttgctatatggaaaaggaattagagttttacattatgtttcttcagggagcaaaactaaaactaatatgcagaagctgcaatgaagtagatttcatctggaaagaatgatttttgtagccatgagaaatacaggtgaagtagaaggagcagcttcagaaagtgaagttccagtgaccaaggagtttgagcccagaaagggatgttaggaaggactttatacataggtgagagaggacttgctagtttatgtaaagttcaacacccattctaacactgaaagtctgcctctagtgtgcattttattaaccccaataaacatttacttttttattttctccccagagtaagcatgttggcagatacatgaagcacttggatccatgtcatgacaatatttggatataacagataagacataatgctttgccaggactgctagacctgggctttcaattgcttccagggctataataaattcagatgttgggggaagagagaggaaaggagagagtgctttttgttgttgttttttgtttttgtttttgttttttgcaatgtagccccttcccaagagtaagaaaaaatattcttctgacaattgtaaagctgtttcctgccaaaattgtcattgttaaaacttttaaaagataatccatatgtccccacacttcatactcttgcactttcatgcaaagagctcaaataagaaaatttgaagtttttctctgagtagaggtcagtgtttctgatgcagtgccagttttaatgagaagattttattttctctctctcttaagagaatggcacgaggaagctacatgttaagaagttaagatggtctctacttggacctgatgctaaaagaaggttcatgccatattttatttgacattgtaatcttgatttggctgcccaatttattgaaaagattaatattctctacaggttttagatagcaaattttaagttttgatcctgacttgccttagagagcctttctttataaagcagctctcgttctttaatcttatagcaaccttactgtgttcttgctcctgttcttcaatgtggtattgtttgtttacctgtttgtgta

SEQ ID NO: 888 - DNA, 76142 bp, Homo sapiens
ttccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctgagtaggagtctggctaatcatccaaaaatgtcaaaagagaaaccaaggtgaatttctttcccaagctgagatttgaaataaactgctagaagttgtcactgaatgtggatattagcaaataactttaagctacagaaacatcacagatttctgctttactacttttctgaatttgtaaaacacaaagagagggagagaaaaagagaggtggagaggtgggagggagtgggctagggtgagggcaagagcagggagcggggagaagaggatggtagggggagggggagagagaggaagtgggagaaaagggacaaagggaaggggagggggtagggagaaagaggggaagggggagggagggagggaggagtggggaggggtttaggtggcttttgaagtctaaagttcatttttcaatatcactatcactcaatattatgaacagggaactcacaggcagttgacagacacaggcaaggaatcatatgattagactaatcagtggaaggtgcaatgacagaggatggcatgggagcctatgaagaaagagatgatgtttctgtatattatacattctccagaaactaagagctccaatagtctatcgagacttcatttccctggcctggcgaggtggatcacagatgtaattccagcaatttgggggccaaggcaggagaattgcttgagcccaggagtttaagaccagcctgggcaacatagtgagaccctgtctctgtgaaaaataagataattagctgggcatggtggtacatgcctgtagtcctagctattcaggaggctgaggcaggaggatcatttaagcccaggaagtagagactgcggtgaatcattattgcatctctgcactctagcctgcgtgacagagcaagtctctgtctcggggaaaaaataaaataaaaataaacgagagagagaggaaaatttcatttcccttaacagcgaagggcttcactaaaaacaaatttatcatcctgccattttactaagatattgttttcacacatccccctttcaggtcattgccactcaaccatgttcaatctttaccctcctcatctctgagctggcatccatccatcttggttgatgattttttccagctcagagactcagtgccccagcacagcagttctccaagttacaataataaacttcatttgctcttctgactactctgggtcctgaaaatgttataactgacacagttgcagagccatccattggaacaactacactaaaatatagagattgtgttcaaacatgtatacttcacatttacagtaattactatggctttactttcatttgcttctctcagttttccttcatcttgcaacaagacaatcaagaaaaagcaggtagtaggtagcttctaacagaagaacagacaaaagagagcataaagaagatattagccaagaagtgatgcttgacatttttttcaaatagaaatctattaaggaccttaaaaaatcatctattatagccaaactggtgcctaactgaagtagtagctgagagtgcttcattgaaaatcaattagagtccaacctgattgtagacagtgtcccttcaacaaaactgacaagcattctatctctactttgataacatttgtatccaaaatgagaaaacactagagaaatatgaaaataaggcaatttcaatgtatgagttatatcccttaagttcatggatgacattaactaagttctgacaccaatacccctagggtgtctttatttcactcccccttctggaaatgattgaataatttataaaggatatatcttgggggtggccacttctacttcctgagctgcatacagaacataacatttttagagctcagaattgggttcaccaccttccattgcacagttaaagagactgcagtccaagaagggtaaggggtttgcctgctgtcacaaagctagggagcaatagaaccaaagttcaaatccagcaatgctggctgcaactctggtatcttctttgcattcttctgcttgtaccaaatcagatgttagcagaaacgcatggaatcctaggaatagtaaacaaagagaaactgataacaggacaatttacatacatggggcagaatgacaaaggaaaccaacctgggaagcgaagtctgccagggctggcagcagagaaagcctttgcttcctatctctacatcctaaaggaatgaggaggaggaagagagaagtaactgaaatccagaaagtactctgactatagcaaaggatctgcaggagctgtggccttggaaaggaacatgccctctgataaactgtggctttgtcaggaagaagctagagaataaaagctagacatcattttgctcctggcctctaatcacctcctagtgcctctcattagccttgcccaaccagaagccagagaacaaaggaggctgccccatcgatgttctcctaggaccataggaggagagaaaggggatgtggagggacaaatggaaaatattcagccaatatttcttagctgcgccagccttttgctttgcaatttagtcttccttaccctcctctattttctttcattgggacaaacattatcaaggttaataagagataatggcccatgtaaaaagagtattgtattcttttatggactttatctaaaatttactcaaatataacagaatcctgtagatgaagcataatatgcaacagatatactttgcaatatttaaaaatgattaatctcaaaagtaatcatctcagtactatgactcattagctggaagaaaacagtaataacatgttttgtgcacagaacaattttaattaataagcaggacatatttattcaaaaattataataagacattattattctcagaacatgaactttgatggtaggtgttagcatcctgttgggtcccagagaatgcacttctggatattaaacatgatggctttgagacctcaaatatatcagcttgtacagtcagctattatctacactgacaattgtttatggctacaaatcacccacgcttgatgtgatatctgaaagtacctcagtaagatattatgagcaatatcaggagtgggtggtgtaaaagtcatttcagtaataaaacagtattcaaagagttgattcaaaaggcagagccattactaataaaaataatataggtagatatttgttaaatgttttctttcttttgaagggcaatactatgaaaggagagtgagcatagggaagttgtctgcaacctctgagccacacacctttctttggtctaccacatatctgtgcagccattaagaatgactctcatctcttgcctttccaaaatgaggtgtaagagaagtcattctggtatagacaggagatatgttaccaaaacagtccaatggacccttttagggatacttcagttagaagttttagctctgtgtgggttcagtgtctctccacattacccctgagacctaaatcccacagaaaatcttaaaggcaatagatgctagttttccttatacctttcaaaaatatgatttgttttgttttgttttgttttgttttgttttgacagagtctcgctctgtcgcccaggctggagtgcagtggtgcaatctcagctcactgcaacctctgcctcccgggttcaagcgattctcctacttcagccttcccagtagatgggattacaggcacatgccaccacgcacagctaatttttttatttttagtagagtcggggtttcatcatgttggccaagatggtcttgatctcttgacctcgtgatccacccacctcggcctcccaaggtgctgggattacaggcgtgagccaccgcacccagccgacaaaatatgaatttttaaagaccaaacacatcagaacaaaccagctaacttgacttttaaaaaccacttgatttcacacaggtctcagatggagcaaaagtaaaaaaaaaaaaattaaaaaataaagacatcccacttgaattctagacaaaattttatattatctaatggaaatgttttttaaaccacataaactgatgagacatatcctttatcctctgaaagaaagaagaaaaaaacaatatttactagctgaacaaaatgccttgagtgaaatatctgtgagcatacatttttaatttcctaagatgaaaacagttttgagcaaggagctctcaaaaaaatgtcctgatgttctcctaatacaccaagaaataaaatctgtcaaagtgctgagattcttataggttttggtacatgttcccagttgatttgatctggctccagatgaaacatattatttaagcaagatagtaatcaaggtaactaacaattttaaaaattacttcaaagcatatactaaggcttgactagtgtgtatttattctctttccattatttctagacggagaaacaatttcattatattttaagttgtatcgaagcatttgttctggaactttctgatgcattagcagattctacctttaatatagtcatatgtgtaggtgtattatcatgcctgctagaccagaagaagtgaaagcctgaattggttatcgcattcccttttggagattaaaaaatagcattacaactatctgtgttgcatttcaagctaaacccatactttcatataaattgtttcacttggtctacataataatcctgtgaggaaaacagggcagcaattactgccccatttcatggatgaggaaattggcttagaagagttaagtggcttactcaaaggcacatggctgagcagttatggacctctgactcataactaagcccagttcaagaaaacacgtatttattcagtgttttaaaattatcaccctaagtcttttgggttcaaggtagtatacatatggcagactaatgaacaaaaagaaaagtaacatttatacagtatttattatacaagagtccctctcataagaactttatagataatagggtcattatagatttatctcatttaaccccatagcgaccttgttaacagtgagataaatctgtaatgacccataacaaccttgttatgcagttaaataagataaatctataatgaccctatgtcattgtcacgtcacagatgaagccgccgaggcacaatgcagatgattaatttgtatagaatcactgacgcattttttaaagaaattaaacaattaattagtgtgtattcatactagttgtacatatttatgaggcaattttgattttagagtccatgttcttaaccactatacatatttgcctccagagattccaaaacttacggacatcttttcattatgctacacagtctcccatgagcagagtatgaaaaaaatccagatatgaggccgggagtggtggcttatgcctgtaatctcagcactatgaggggttggggcaggtggatcacttgaggtcaggagttcaagaccagcctagccaacaaggtgaaaccccgtctctactaaaaatacaaaaaatagctgggtgtgggggcacgtgcctgtaatcccatctactagggaggctgaagcaggagaatcgcttaaacccgggaggcggaggttacagtgagccaagatcgcaccactgcactccagcctggttgacagaggagactctgtcttaaaaaaaaaaaaaaatctgaatatgaatctaagcaaacatatacacacaaacaggcatacatacctagacaaactatatgtctatctctacatctacctatctatacatacaccttatgctgagggtcttgaatatgattgataatcacattctgtgtggctaattgcatttaggccaggactcaaaaaaaaaaacaaaacatgaaataaaccaaaataacctagatgagtgagaaattctaagtttgaattttaactggggaggaaaaaagataaagaaaacttcacagattggaggccacttatctccacatttaactttcaaaacctttctcaaaatatctttgtatttaaaagaatccatcagtctttgcaaagagaggagagaaaatagacttgaggaagatgtttccttctgtgtgctgtgtgactcaggacacatgcttcttctgtgcaatgctttaccatcatctgccaaagacgtgtgtgcaaatatcagtcttgcaaacagacaatatttgcactacattgaggctaacctgccatctgcttatcagatgttcggagtccaaattgtacagttttccttgtgtttcccctaatgaaaaatggaatgctggggctctgattacaagtgtctgtgcacaggactaatactacatccctaggtagagtaatggaaacagtgcatctaggggaaatggcttatatattgacattgtttaaagaaaacagaattattttctgtggctcaggttcacatgaaatataaacctcctagttcactaaagtgtgatatatttttctcaaaatttggagaaccactgatgttctggacaactgtatttcagtgttaggcctagccgaatatatcaactaaaaatgcaatcacagtgaaaaattctaatgatatgcattatttctgaataagcaaatgccagaagcacaatcccaacatattatgaatgatgtgattgactaccagggttgctcgcagcccatagcttcaggtaacacagctgtctcctcccattaatgagaaaagagatagcattttctgtttaaaattaataactgtaacactccaggattataggaaaaattctaagtgtttcacacaaagtgcttcacaaaattttactgaagttcaacaaaatcattatataacaaatacatatgagaaattcttctttatggcttattctattgaattgcctattcatttttgccttcccagaatccacaattttcagcaagatgaatatgagcagaaataaaaatgccctttctatttaataccccctgctttcaattaaaagaaaactggttagtcatttagtatcttagaatatttcttacttataatgaattaggcattaattatattcttctatataaccaaaacaattttttagcaatggacaacactattattttctaattcatgttactttttttaagcatgcctttgggcattggatcactatcagcaatgtgcagagaatatcatcatcctttgaaaagctgtactactgatgtactttacagataaatagtaaaaatgtttaatgtacacctaaaacacaattgaaataaatgccatttcaggaatttgaaagtgtgttgaggttaccaagattatctgtgatccttttcaaacagcaataatttactcaaaaggctgtcatgtctgcttacaagactgtgcagatagttgacatagatgaaattagtattaatatattcattttaatttctacccatttactgtcttactaagggtaatttaactcagaaatgccgtcataatagggtgataatctgataatccggggtgcagtggaggcagggaagaaaggaagaaaaaaggaaaaacaatgacaataaatggcacaggcaagaagaaagcaataatgtaataattactaccatgttttgttcaattatcaccgaaaaatccagaaagatatgaaaggtgagcaaaggttctaccatgtttttgtaaagaaataaaagctcactgaaatattagggagaaatggaatcaaaagtaccaatgaaaaaagcaaaaataagataatttaaaaagaaattagaataagaaaaaactaggaaataacgttctttacatgtgaataatttctttttggttgagttgtaaatcacatatctgttattcaaaaatatttcctgattcatttgaaaagaaaacatattgaaaagggatctaaacaaaggttgtttttttttcccctctttaaatgttgctacctcaaacaagctgtaatctgagtattaaagtacaaaacacttaggaaatataattttccatgattactttgagcttcctgtaagtgtaacagtttttttactacagttttcctctctaaagacagaaatgcaccgtatgggcgcaaggatgctcatgccatagcctatgctcaaaagaggattcttagtctacattccagattcagctggagtctatattaactgcatccattcttttaatgttggccatcttgtatgggttggatgtcccaagaagccacttaactatgggtgtgattgtctattcaagaacctagaaaaaatggtaaactggttacataacaaataacacatcttgatctaagttgagaggactggagtcttctagctatattatttgaaaaaatgcaatcatgatttagtgacaaattgaatagcaacttcattaaccagaatttgactgtaaacccatgcaccgtcctagccagtatctcttttctccggaagagaggcatgggaggaggggagagaaaaaggtgagctatactactttagagtcttatgctagttctgtgaggtaaatgtaactactatttcctttatttaacaaacaaaaaatgaggctcaaaaatttaaacaacttgtgccaaagtcacagaggtaagaaatactagggcaggaattgctcccatgtctgtgtacctttaaaattcactttgcagctgcacagctgataagtctgctcagaagatttaaattataagaggaaaaaatgccttgcatccctggcactgtgcctagttctttccccaaactgaaaatgatacttgcaattttttgagccctcaccatgtatctggatcatttcaattaatcttgacaatgctggtcaagggactattattagtctcattttgaagatgaagcttagagaggtaaaataacttgccccatatcctacagctggtgggagacagagatggcattctcaccagctctctctaaactccaaagcctgtgctcttcccatttattccattctgctttctctccaggagtcttcataataactctgagttcagcagctgttttcaatgaggatataggctcaaagcaaatacaacataaccggtacatggttagatttctaagcctcttgccattccgccttgtggacaaggacatcaaatacaatgaaaaatgggtgccccgcaaatcaatacatctgttctttaatacctgtgatcacagctgtgaaataggcttaatacacagcctgaaaatattgttgtgaaaataactgtgtgtttggctgttaagtaaagttcagctggacacatgatctagtaagaggtgctaggctgctgcatgcaaaggaattccattagaaaagacagagaggtatgggaggaaaccgagcacaaagcagtgtgtccattgatgagagaagtcactcccacttcgcccacagatggtggcattaataaagatatcttgtacaatccaatgatgtgaatctcaatcttcagcatggataagaatcactggggagcttgttaagaatacagttttagtgtcatctcacctaagattctgattcaattaagtctggggtggtgcccaggaacctgaattttataaacatcccagctggttttttaattattattactattggtttctactttattctaggtttagtggttacacatacaggcttgttacatgggcaaattgcgtgtcactaaggcttgatgtatgaatgagcccatcaccaaggtagtgagcatagtacataacaggtagccttccaatccatgcccccccaccaccctccccaatgaagcagtctccagagtctttgttcctatctttgtgtccatttatattcaatgttgagcttccaattataagcgaaaacatgtggaatgtggttgtctgttcctgcactagtttgcttaggataatgacctccagctacatttcatgttgctgcaaagaacatgatttcattcttttttatggctgtgcagtattccgtggtctatatgtaccacaatttctttatctggtccactgtcaatgggcatcttggttgatgccatgtctttgctattgtgaatagcattgtgatgaacatatgagtgcatgcatctttttggtagaatgatttattttcctttgggtgtatacccaatagtggaattgttgggccaaatgatagttctgtttcaagttctttgagaaatctccacactgctttccacagtggctgaactaacttatattcctaccagcagtgtataagcgttcccttttctctgcagcttaaacagcatctgttgtttcttaactttttaataatagctattctgactgatgtgagatagtatctcatagtttgaaatttaatttctctagtgattagtcataatgaacattttttcacgtatttgttggccacatgtatgtctttttttgagaagtgtctcttcttgtcctttgcccacttttaaatgcaattaatatatttttgcttactgatttaagttccttacagattctggataataggcctttgtcagatgcacagtttgctaatattttctcccattcagaaggttgtctgtttattctattgatagtttcttttattgtgcaaaagctctttaagttaattaggtccttcttgtcaatttttgtttttgttgcaattacttttgggaacttagtcataaattctttgcaaaggcccatgtccagaatggtatttcctaagttttcttctagggtttttattgttttagttctacttttaagtttttaacccatcttgagttaatttgggtatatggtgaaaggaaggggttcagtttcaatcttttgcatatggctagccagtgatcccagcaccatttattgactagagggtcccttccccattgcttgttatcgtcaactctgctaaaggacaggtggttgtaggtttgtggctttatctcagggttctctaacctgttctatcagtctgcctgtttttgtacctgaatcatgctgttttggttactgcagccttgtagtatagttttaagtcaggtagtgtaacgcctctggctttgttctttttgcttaggcttgctttggtgattcagtcttttctttgattccatatgaattttagaataactttttctaattctgtgaaaaatgtattggtactttgataggaatagcatctaatatgtaagttgcttttggcagtatggtcactttaacaattctgattcttcctatccatggaataggaagaatatttttccatgtgtttgcattgtctctgatttctctcagcattgttttgtaattctctttgcaaggttctttaaggtccttagtaagctgtattcctaggtattttattctttttgtagcttttgtaagtgacactgtgttcataatttcgttctgagcttggacattattggtgtatagaaatgctactgatttttactcatagattttatactctgaaactttactaaggtcatttatcagttctagaagccttctggcagaatctatggggttttctaagcagagtcatgttgtcttccaagagtgagttagacttcctctctatttggatgccttttatttctttgtcttacctgattactttggctaggatctcctttactatattgaataggaatggtgagtgtgggcatccttgtcttatttcacttctcaaggggaatgcttccagctttcacctaattgctatgatgttggctatgggtttgtcataaatagctcttaaaatttagagatatgttctattgatgcctaatttcttgagggttttcagcacgaaggaatgttcaactgtatcaaaggctatttctttgcctattgagataatgatgtggtttttgttggtaattctatttatatggtgaatcacatgtattgatttgcctatgttaaaccaacattgcatcccaggaataaaccctacttgatcaccgtaaattaactttttgatgtgctgttagattcagtttactagtacttcattgagaaaattttgcatctctgttcattggggatattggcctgatatttttctttctttttttttttttgtttgttgttgttgttgtgtctctgtcacattttggtatcagaatgatgctggcttcaaagaataagctagagaatcccttctcaaattttggaataatttcagtaggattagtactagctgttttttgtatgtctggtagaattcagctgtgaatccatctgctctaggcctttttttttttttggttggtaggctttttattactgattcaatttcagaactgattattggtctgttcaggattttaatttcttcccagttcttgggagggtgaatttccaggaatttatcaatttctttcagtttttctagtttgtgtgcatacagctgttcataatagtctctgaggattttttgtatttctttgagatcacctgtaaagtcacgtttttcatttctgattgtatttatttggttcttctccttttattaatctagttattaatttattatttccctaaatagtcacaaacctaatttgtcaagttatagctcagttgcattacaaaagaagttcttacatcaagtattacagaagaatcagtagtatttgcttgggcagtacatgccatcagattatgaatggattataaatgcaaactgacgtgtgacttttaaaataccatgatctatccaatttgaaagagaccattaaagtggagatttcaactcctaccactataactctaaagtatgatctttactttggcagaatattacagacttagaggtattgtttttatcacttggttttgtttttatccatagcaaagccttcaataatatttcaggccacagagaaaataatacaagtttttgcattgttgatacttcaaccaagatagtcattcttttaatgtaggtctgctggtgtcaaattattttattgttccttcatctccgagaatttcttgatttctcctttatttctgaagagtatttattactggatataggatcctgagttgacaaaattttttctttcagcacttcaaaactattgtaatttttgctggcttccctggtttccgatgagagatccagtgtcatctgaacgttcttttttccacagagaatgtgatatttatttctgactgctttaaacatttgtctttaattttcagaagtttgtctatggtgtgatttcatgtggatttctttgggcttatcatgtttggggtttgcattatagtcccatacatttctgaggttgtgttttgtttttgttttctttaaagtctattttgtccctgttgtttacattgtgtaatttctatttgtattatttttcaatggactggttcttttctctgtctcctctgttcagctattgagcccatatgttgactttttaaattattattttattggttaatatttttagttctaacatttctatttcattcttctttgatttctttgctgtaacattctatttttttattctcctttggtgacattcttcccctttgcttatttttatttttaatttttatggctacataattgtacatattaatggggtacatgtgctatcttgatatgagcatacaatgtataataaaatctaggtaatttgaatatcgattatctcaaacatttatcatttctttgtgttgggaacattccaaatcttctcttcaaccaattttgaaataggtgatattttttcatttgttcaaggatgtttatgattgttcattcatttttatgatggctactttgaaatctttgtaagataattctaacatcgctgtcatctattaaatgtatttttttattcagcttgagatcttcctggttcttgatatgacaagtgatgtttgaatgagatggagacattttggttattatgttaaaagactatggatcatatttaaaattctggatcacatttctgctttagttggcttcttctgaaactgctttggcagaggaagaagagggttgcctcattactgcctggtgagggtaatctttaggggtaaaagtggttctcagttacatggatgaattgtataatggtgaagtctaggatattagtgcatgcattatctgaatagtgcatattgtactcaataggtagtttttcatttttaccccctcaccccttttaagtcttcgatgtctattataccacttggtatgcctttgcatacccatagcttagctcccacttataagagagaaccttcagtatctcgttttcaattcctgagttacttcacttagaataatggcctctagttccaaccaagttgccacaaaatacattattccattctttttatggctgagtagtattccatgataacatacatcacattttctttatccactcatcagttaatggacatttaggttgactgcatatctttgcaattgtgaattgtgctgcaataaacatatgcacacaggcatctctttgatatattcattccttttcttttgggtagatacccagtagtgagattcctggatcaaatggtagatctacttttagctttgagaaatctccatactcttttccatagaggttgtactaatgtgtatttccaccagcagcatataagtgttcctctttcaccacgtccacccgagcatcttttggggatttttttttttgactttttaataatggttattctggctcgggtaaggtggtatacattgtggttttaatttgcatttccttgacaattagtgatgttgagcatttattcatatgtttttgaccatttgtatattttttgagaaatatctattcatgtcttttgtccacatttcagtttttaagttgtctgtttactgtaatgattatttattttgctgtgaagaagctttttagtttgagtcctattcattatttttgttttgttggatttgcttttaggggtcttagttataaattatttgcctatgctggtgtccagaagagtttttcctaggtactcttctagatcttttatggtttcaggtcttagcttcaggtctttaggtctttagtcaaggtaaagttaatttttgtatctagtgagagacagagatccactgtctttcttctacatgtgactatgcaatttttctagcaccctttattgaacagaatgtcctttccccgatttatgtttttgtatgttttatcaaagatcagttggttttaagtatttggctttatttctgagatctctattatattccattgatctacttttataccagtaccatgctgatttggttacgttagccttgtagtaaaatttcaagttaggtaatgtgatgcctccagatttgttcttttcgtttaggttgctttgactatttgggctattttttggttccatgtgaattttaggattgatttttctaattctgtaaaaaatagtgttggtaatttgatagaaattgcattgaatctgtagattgctttggagtgtatggtcattttcatgatattgattgttctaacccatgagcaaagaatgtatttccatttgcttttgtcatctacaatttctttcagccgtgttttatttttcttgtagagatactacacctccttggttaagtatgttctagcatattttatctttttgtagctactgtaaaagggattgagttttttatttgattttcagcttggttgttgttgatgtatagcagtgatactgatttatgcacactggttttgtaatgagattttgctgaattcatttatcagatctaggagtcttttggaagaatccttagggctttctagatataagattatatcattggcaaacaaagataatttgactccatgttttacaaatcgaatgccctttatttatttctcttgtctgattgctctggctaggattccctgtactatgttgaatagaagggataaaagtcagcatccttgtcttatttcagttaataggggaaatactttgaactttttctcattcagtatgatgttggctatgggtttggaatatacagctttaattatttagaggtatgtttcttctatgtctagtttgttgagggtttttatcataaagtcatgctggattttattgaatgctttttctgcatctatagaaatgatcatatatttatttaaaaaaattctgtttatctgatgaatcacatttattcccttgaatttgttaaaccatctctgcatccctaaagtgaaatccatgtgaatatagtggattatttttttgatgcgctgttggatttggtttgctactattttgttgagcatttttgcatctatattcatcagagatttggtctgtagttttctcttttttgttaagtctttcctttgctttggtaccagggtgatactgggcttgtagaatgtattagggaggattctcttcttctcaatcttttggaatagattcaatcgaattagtaccaattctttggatgtctggtagaatttggctgtgaattcatttggccttggactgtttttgtttgtttgcagtgttttggtttttgttgttgttgttgttgttgttgttgttgtttttctaaattactgattaaatctcactgcttcttattggcctcttcaggatttctagttcttcctgattcaagctagcgggggttgtatgtttccaggaattaattcatttcctctaaattttctagtttgtgtgcatagagctcttcacagtagtcccaaataatcttttgtatatctgtagtatcagttgtaatatctccattttcatttataattagtcttatttggatcttctctcttcttgtcttggttttaatctacctagtgttctaacaattttatctttttgaaggagctattttttgtttcattggtcctttggattttttttgtttcaattttatttagctctgctctgatctttattattccttttcttctgctagctttaggtatgtttttttcttatttctctggttccttcagatgtattgttaggctgtcaatttgtgatctttcagaattattgatgttggcattttgcactataaactttcctcttagctttgcttttgctgtatcccagaggttttgataacttgtgtcactgttgttattcatttcaaaaattttttaaatttccaccttaatgtcattgttaacccaaaaatcattcaggagtagattgtttaatttctatgtatttgcatagttttgagggttccttttggaatcgattcctagttttattttaccgtggtctgacaagaaacttaatatgattttgatttttaaaaatttattgaacttatttagtgacctatcatataatctatcttggagaatcttccatgtgctgatgagaagaatgtatattctgtagttcttgggtagaatgttctgtaaatatctgttaggctcattttttctagactgaaatttaagtctagtgtttctttgttgactttctgctttgatgatctctctagtgctgttagaggagtgttgatgactcccactattattgtgttactatgtattttcttttttagacctggtaggaattgccttatgaatctgtgagctctagagttcggtgcatataaatttagacatgttatatcttcttgttgaatttatcctattttaattacataatgaccttctttgtccttttttaatattgttgctctaaagtctattttatttgttttaagaatagctactcctgcttgcttttggtttccatttgcaagaaatgtcttttttcaccccattagcttgaatctataagaatctttacatgtgaggtatgtcttctgaagatagcaggtatctatttggcttgcaaatttttaaaatccattctgtcagtgtgcatctttttaaagtggagcatttagaccagttacattaaacattgagatgtgaggtgctgttctagtcatcatattgattgttacttagtgactttgttttcttcatattgttattgttttataagccctgtgaattttatgctttcaggagtatttattctggtgagtaacaacaacttgtttcaagatttagtattctatttagcacttctcatagagctggtttagtattgacaaattccttcaccatttacttgtctgagaaaaactatttctcctttatctatgaaagagttttgctggacacaaaattcttgaccaacagtcattctgttcaggagactaaagataggaccccaattccatctggcttataaggtttctgctgagaagtctgcagttagtttgattggttttctgttataggttacctgatgcttttattttactgctcttagaattttttccttcatgttgactttagatagcctgatgagtatatgccttagtgatgttttgtttttgcaatgagtctctcaggagttctttgaccttcttatatttggatatctatgtcactagcaagtccagggaagttttcctccctggaaattttcctcaaatagacttttgaaatttttgctacgtttttctccctcaggaatatctacaattcttatgtttggccattttatataatccacatatttcttgagactttccttcttcttttaattcttttttgtttacttttgctgtgctgattgggttaatttgaaagccttgtttttgagttctgaaattctttcttctgcttggtctaatctattttaaaagcttttcactgcattttgtagttgccgaaatgtgtagtctttcatagaagttctgattggctttcctttaaaatatccatctctttagaaaagttttcattcatgtcctgaattaaaaaaaattatgttggttttcaactttatgttaacttaataatcaacttttttgaattatttatctggtattttatgttggttttcaactttctcttatgtctccttgattaacataataatcaactttttgaactctttatctggtatttcaaagatttcatcttgatttggatccactgctggagagtcagtgtgattgatttttttgagttgtcatagaacaactcaaatgttttttatgtttccagaattgtttttatggttccttctcatttgtgtaggctatttcttctaattattttaaaattagtttttgattcaattgggtttaaaaaaattttcctccttgaagatgtgactttaacatttatagtttatttacacttagtttcagctctgggtggtttcaagtggcaaagactgtatgagtttcttggttatagagaatcattgtgaagtgtctttctcagatgccggttgtagtggcagtgggctgggtgtgtgagtaggttcactgtctcctaaggggctggaatggcagaggtctcatgaagcttattttgttccccagtggtgtgcacctttaaaagtttttcttccagcattttattcaacgggttgagtagttcaggcttcaggccagtaggaggtgcccacagataaacacaggttgtggctaaagcgggtgggtaaatgtaatatccaacgattggatgaagtcccagctttgacagaggcagctggcaaagctctccgtgaaatacactgaggtcttttcatggggaagtgaaggagccaccccagctctccttccaggcaaagcaggaaagcaatccacctcccagtcacactgctgacctggtgttctagcttttcagatcaaacaggtatctctttctatctgcaagaatgctgatgttccctctaaagaagggttgtagctctacctcttgtgtaagtctgaacctgtatggcacacttcctgtggatagttaccttggagtgttccagaaagtctgtctacagatgcatccatgctgagctcccatgagagaagccccagctctctgcagtgttgggtgaggggaaaaagaaatcaccttctcaaacctttcatgagcgctgtttgactgttggggtagagctgcagactttccccactgagcccagcactgcacttgtgtctctcccgaaagaaacttctcacaagtgggaagttaagggactcaaggcccatggtctgctttcttttataccatgggatgctcccttaatgtggttcactactctttccccaaaaaatagtagtccctgaaagccaggctattctgaattctactgctcctctaggtctagctgtccagtggggctgccacagttcaggctgtactggagaatatctgcaagggatccagtgatgtgaactgtcctctagtttcccagcaccaggtgccagcattacctctgatgggggtgggtggggagtgacacagactctgagattttcttggttataaatagctttagtgttttggttttctcaaatgccagctgtagtagtagtgtattgggcacatagacagactcaagacgtcctatttagctaaggtaatactggcaatggcaatagctgaggttgcataaaagtttttggcttcctgagtgctgggttattgtttatgcagatgttttaatgggctgtgccggttggcctccagccagtaggtcatggcttgtagaaaagcaccagctgtggaggtagtggtagaatttgtgcttgctttatgtcactcaggggaggtattcctgtgtctcaggtaggtaatgggtagggccatggagctcccaaacatccctgtatattgcactgtgctaccagggcaggtggaggggcaaagctgggtatgggctaggtcaggcaactccttgctctggctcctcacatgcaggcacaagcagcggccccagtgaggatcataagtcaattccttggctactggggtaatatttcagggagtagcacagctgcctctgttgcacagaagaatccgcatgggatgcaggggttagcaagcagcagtaagccccactcagctcccatgcacttggcaaggcatgtatcccactcataatgttcgctaaaagcagcaggctgggttccaggtagtctgtacgtagaactaaaaactgccccaggccataagccgtcccagtggagaccagtgaaaccacagctttcaggccgcaccccttctggtctacctgtgaagcaggagtgcccagctcctgcgcccatggctatagcaaacttactacttgcccctcatttctggccaacagggtttatcctcactcaaggttataatctcatatctcagatgggagcttctctcaacctgtgactgcagcttgagttagctggtagacttctgtgaggtcccctgtgaggtaggatcaggaatggcttccctctgtccttgctggagtgtgaaagtgcaggcaatgtgcatcctgataccgcttcttctcaccccatcactcgctaaatcagctccagcactgggtagtgttaagatctgcctccatggcctgaattgcccggctctccggtgggagtgtgtgtcacggtggcagtctctccccctctcacacactctggagactcacagttttccatctggttcacagtgtaggctgctgtttcttctttcaaagggtctgtagtttctttcagtttttctgttaagttcctgtgttgcttcttagaaagaagtgcacattgtgaatctctgcacactattttgtctttccaagtgggagaggcaggctaacaatgcctccaaaccactgggccattttaaataacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggaga

SEQ ID NO: 889 - DNA, 14073 bp, Homo sapiens
taacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatg

SEQ ID NO: 890 - DNA, 47600 bp, Homo sapiens
gagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatatta

SEQ ID NO: 891 - DNA, 193186 bp, Homo sapiens
taacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatattaaatttaaagatataaattccaacacacatagatataactacatatagccaatgaagccaccaatcttgtgacacttctttgtagaaaaagaaatttccatgttgtagcatattgcattttctaaaaatggccagactaatattatgtctcaacccacataatctccctaaaatgggtctacactctttccattgaatctgggtaagggcttgtgactgctcctaacccacagaaactataagagataataaatgattgttgtcttaagtcaccacattttgggatgatttattatgcaccattagatgacaggaacagctgtgtgttatctttgttatttgatcttttgaaatatagtttaacttggaaactgaagacaagtttattcctttatttaaaacatatttaatatgtgcttactgctctttttcattgtgataaaaaactttcattgagagagaaacatctcttaatattagtttgtcaggtgttagaatccaggacccctgccctggaattgttcatgagtccaagcagttgtaactgcatctagcaaataatggtctgctttgctgtctccttgttaaaagtacttcaaaatgtatgcaaaatatgtcttatagccagcaggcttctcattccttgctagggactctgtaaatgaaaaacaaaacaaaaaacccaaagctacagcagaacacatttgaaattatgaatacaaccataaaaatggcaattctaaggtaaggtttgagaatacagaacttatctgagcctgttgccttcttctgtgcaaaagaaccattatagataaacaggcagcagatagtcacaattcaatgccatgatatgtggataaaacgaaacaaaggtcgagaaattagcttacttccagatgttctttgggtcaggctcatctatccctaacttctcatatgaaagttaaactgccacagcctgaaataatagataattgaaattctcattttcttcagaaaattctgcaattaaaatgttgatatttctttaaaatacacacacacacacacacacacaaacacacacacacacacacacacacacaaaacctgatatcaaatcttacattccctccacccagaaaacatgactaggtcatttaaacagtacttgaatatattcacagaaaatcagcaggtcaggtagaaaattactcaccctacacaccagttgtgtgagtgttgcagagtatgaaccgctgccaagatatctgtcattggcatatctccacttttcaatttgatacaatgtgtttaacctatcactgttattcagtgtactataactgctatacaagcacctgtgtgtttaccagagctttactattcccttggctagaaatatttccaaacaaggtactaaatataaatgcccgccattttcaaaaatatatatatataataaacattctccaaatattttaaaagcctacagttaccaataagcttttgtgtacataaattagagaataaggggcaaagaaaactttattagcataccattaagtacttaatttattatttttgcagtgacatccttgcaggatttcttctttaacatgaaaaagtcaacatcttaactgttgaaggctctgctttagaatcctaggggcatttccagacaagttctagcgattattgtgaaagtacctgtttctagaccaactctttaagcagaccactaaaaagaccttttcaaatcttccatgtaaaggaaagccttgaaagggagagagctagatagatacatagatacacatatatagatagatgatggagatagatacagagaggtcagatgataacaaagatcagattataacaaacttaaatgtaggtgctccagctagctaacagagaataacaaatcatcacacagtttagtgacttaaaacaattatcacataatttacaatctaaacttgtaaatcttgtcaacagcaatcaggagtccacattatcctttaaaccaaattttatttccaagtagaaaatattttcttatttaattgtatactgatctgaattcaatgtatcttgtacatgaaaatagcaacttggctctgctgggtaactgaagaccatgtttgtgactggaagcatgttattaatctacttaaaatcttcattccttaataaaatctactccctgtcaacatttattttagaaactgaaatctttgtgagcatagctatattggcatcataagctctaaatggaagactacttaagggcatcttcttatttctagtagagttaatatcattactaaccccaactattctgatgaaataggtatctagcataaacatcaatcatcttcttttataactcattgataattccccatggtcccttgctctatttttcatctgttgtaacacataaaggggttcaacaactactttattctaagctttctctgctgcaaaccgaaggttactaattcacttcattaacaattacaagtatttgtatctgtcctcacaaattcaaaattgaccattttataaaagacatatcccttctcttcattctacctttgttaggtatatttttctatttccaaatatttattttatttccaaatcatgattcattcaaataagttttacacaaagaagaaagtacaagatgtgtaacagctctagtagagaacatttcagctgtgccacaaaaagaaaacagcaatataatggtgtgctgacaaaataggccaggcatggaggctcatgcctataatcccagcactttcagagaccaagacaggcagatcacttgagcctgggagttcgagaccagcctgggcaatatgacaagcccccgtctctgcaaaaaatacaaaaattagccaggcatggtggcacatgcctgtagtcctagctacttggcggggttaaggtgggaggattggttgagcttgggaggttgaggcttcagtaagccatgatcatgctactgcacactagcctgagtgacggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagttgtaagaaataatatagagacatcccttgcaaactttatccccgtcttacaaaatgttaccacatcatccccctgtggtaacattttgtaagactatattttcagggtcttgacactgatataactcactgatcttatttttctccagttttacttgtattaatttttcttagtgtggtatgggtgggtgtgcaataagtctatacaattttgtcacctgtgtaggttcatggattcaccaccgcagtcaagatgttgaacagttcccacaccacaagagtattcatgttgcctttttataactatatccatctccctccttcaaaatcccacatcctcctgctagctcagtgcccccacacaaccactaactattccccatttctaaattttattatttcaaaatgttttataagtggaattatatagtatgtaatcttttgggatttttttcataacataattcttggagatttattcaacctaaggtgtttatcaacagtttattcctttttattgctgagtagtattccatggtatatatgtacaatacaaatatgttctcccattctttagcttgtaattttattctcacatggttttcacaaagttagcattttacattttgatgaagtctaattcatcaattttttaaattcacacttcatgattgtggtatcaaggactctgcctagccctagatcccgaatattttttcctattttgttctaaacattttgtatttatattataattttttaatattttacctttgtctctgatccattttgagtttatttttgtgtacagtgtgagacttcgttcggaactcattttgctgcctataggtgtcaaattgctccaacaccatttgtggaaaatgctgtctttcttctattaaattggttttgcatctttgtcaaaaatgtgttgaatatacagatttttgtgtggggatatttatgggtcccctattccagggctccccaacccctgggccacagacaactaccagtctgtggcctatcagcaaccaagccacacagcaggattggtgagtgaactttactgcctgatctttgccttctgtcagatcagcggtggcattagattctcatacgagctccaaccctattgtgaacagcacatgcaagaaatctaggttgcacgtcctttatgagaatctaatgcctgatgatctgaggtggcacagtttcatcttgaaaacacccctgcctccactcactatccgtggaaaaattgtcttccatgaaactggtccctggtcccaaaaaggttggggatcgctgccctattctgttccattgatctatgtgtctatgctctggcaatgtcacaccactttgattattgcagctatagtgtaaaacttaatatcaggtagagtacttttccccactttatttacctctttttattatttaactatttttgctattcattgtaaatttagaccacatgcatttatatttccaaaaacttgccaggattttgaagaaattgcatataaatccttttgggaactataatgaaattaaagaaagaaacagaaatgttctaggataacagagcaaaggcagataaagttctggcattggaggaagactaataaactaatacaatatgaaaaaaattgatgtgaaaaaatagaatatccacttgaaccatacatgcggacgtgtggataggcatcagcattccagcacaacggatgggacagaaacaaaaaatgagattatagcacaaagagttaactttaactatgtagtcatcacagaatgttatgggagcaaaacaataactcagtcacagcaatagaagtgtcaattttattataatagtgctgaccttttttggggcaagtggaaggggtagggagtagaagactgtcaataaagacatgtctgtatggaaatacagacatcttttgttggtaatctgctaaaaccacatacttttaaaggtgaaagagagatgaaaatacattatgttattaaggtatactctaaattgccaggcaagattgagaaaagtgatgaggcttccctgatagagactccacaattagaaccaaagcagtacagagcagcaacctgagcttccatcattcactcactgggattcccatcaacatacagcatccttggcaagtcttgttcagatggaaaagcagtcacaagaggagtgctcttctaatcctgtgctaaccaatctaaaagcatttgtgactgaagtagtggaaactctgaacaaaattaccttgtaaattttagtttatagtagcccagatatgtggccatgctagattccaaaaacttcagagaaaaatgggtataattaatgacctcttattctgacactttgagagggtttgaaggctatcaataataattctgtgatctcaagcaaaaaagaaaaaaaaaaagaaaaagaatgcggctgcacctcagactccatgagaagcttatatgtaaatggacaaaattcagaagaaataagtgcctcgcacaggccttaacacacaagttgtgctcaatcatgtttggtaaaagaatgaatggacattgtaaaaccaaaaattaacatctaaagggttcatacactacaagccaggagagtcaaagtatatatcatctgttcatctaatcattccatcattaatttattatgagcttcttgctttcagggtcccatagtccagagtgaaaaagtgatatgcaaaccaaaaaatcaaaatacaggaaagtaactatgactaggtaattgtttaaaatactttgggaacaggcaggctggagttattaattaactatatttggggaaaagaagactacaaaagtcttcacaatgtagttaacatttaagtaattttgaagaatagcagagatagagagttataaaaattactcttttttttttttttcttgagacagagtcttgctctgtcgcctaggctggagtgcagtggtgtgaccttggctcactgcaagctccgcctcctgggttcaggccattctcctgcctcagcctcccgagtagctgggactacaggcacctgccaccacgcccagctaaattttttttttttttgtatttttagtagagagggcatttcaccttgttagccaggatggtctcgatcttctgacctcgtgatccacccgccttggtctccccaagtactgggattacaggcgtgagccaccgtgcccagccaaaaagaactctttatatatgtttttgaaaagaagaagaaaagagaagcatatgctatcaaaaaagaaattcagtgctggaatgataatgagctcagagcaaaagtaaagagataaactgcctatagattgtttggagagcttaagttgaaccctccctagccattcccaaagatgcaagccccctataaaaatttggagcacctaacactacaaagtttgaaagaatattatctttgatatgattcctccctgtctgttaacttccatgtttccatcccattggccctgcttttatgtatcctccattggcctaacagctctcaaccagaggttttaaaccctgacagctcattagcatcaccagaagaacttttacaaaagccttccacttgtgtcccttccccagggattctgattccactggtttggggtaagggaccctgtgttgcccacagcggctgatgcccatcaaaagggcattaggaaaatcactctgcgggaaatcactctggcccgccatggtgaatgagtgtttttaagaggattaaacaaacatcaaaaagaaaaaaattaatgtcatggagttccataccatcttaagacttaatgattcatatgccattacacagaaggaatttgcccaagatagctatgaattgtagccatgatctctaaaaaagagtcgaatatgcgaatcctacctaaagaccggggacaagtgatccttaattcatacaaacagtaatggggagacactaaaatgttttctgaagaacattgacaaattaagatttgcacattataagaaatattctagctacatacaagaaaaaatgattgtaaaaaaatcaaagatgattcccagacttttgtttgggaaaccagatgaacataaatacaattcatcgagaggtaatggagaaaaaagtacaggcgtggcagcggaattagatgaggacagaagttctcctttagatatgctgatttttgggtatatatattacatagtggtttatacacaggttggaaattcaggagaaaaatcattacagatgggagatgtgtatttgagatccatctgcatatagctgggttgttaaggcaaagaaatagataagcttgttctgggagggtgtgtagaattctctttaggagaagaatacctagggcagaatttaaaggaacgctaacataggcagtagaaaaacacccacaaagtagattcataggaaatggccagagaggtagaaggaaaatcaggagagtgtggcataataggtgccagaagaaaagagtgtttaaaggaggaatgattgaacaatacttgcaaacattgcaatgatttcagtggagaatgcgactgaagtttgattagagtgaattaaggagtagatgggaggtaaaataaaaagtagaaataagaattagaaaaggtttataaagatggtggaagagaactttccagtgcttatccccacagagaaacattaatttgaacaaatatccatgcacaaacaaaagttcacaagagctaaagaaaccatgtgagagattacagaagctgagtggagcacagaaataagaaagacacactgataaaggtaagaaggacagttttaaatcacctgtgaagccgcttcacaaactgtatacagcacggacacagacagcagcaatacccaacccttacgggaaggaaagtgagcaccaaacttactgtggaacccaacactgggcctgctccagcaaaacccaacttcacgcaggcacctatggccccagactccaggctgatacctgcagactaagcttccaggcccacctggattctaggatagctcccacagccctgggatccatgcctgctcaatagactcaatctctgggcctgccccactgccaggctgaccccagcagccctaggctcgggaacagccccagtatcaggcaagccctaccagccctggcccttggtcagaaccagacatcacagatgtaggcataagcctgacccaggaccaggcctgacacaggccagcaccttgggacccagcctccaggttaagccccacagactcgggcttcaggcttaccccaggtttcagacaagccggaagctaaaacatcccatgcagtcccaggcctcaggccccaacaccagattagcactcctggtctcaatagcaggggactcaaatatcccactttcagcaatgaaaaaattatccagaaaaaatatcaataagtaaacatcagattaaaactacactttagaccaaatagacccaacagacatatacagaacattcccattaagcagcagcagaatatacttttttctcaaacacacacagaacattcttcagggtagatcatatgttaggtcattcacaagagcttaagaacccatgtgggagattacagaacccgggtgtagcacagaaatattggcaaaacaagtcttaacaaatttgaaaagatgtaatcatattaagtattttttctgatcataatggtaagaaattagaaatcagttaactggaaaaatttcaaaaacttcacaaatatatgaaacttaaacaatatgctctttaacaaccaacgaatcaaagaagaaagtaaaagagaaattaaaaactattttgagataagtgaaaagagagacacaaaacagcaaaactcatgatgtgtccggaattggtgggttcttggtctcgctgacttcaagaatgaagccgcggaccctcacgatgaatgttacagtttttaaagatggtgtgtccggagttcattccttcagatgttcagatgtgtccagagtttattccttctggtgggttcgtggtctcgctggcttcaggaatgaagctgcagaccttcctggtgagtgtcacagctcttaaaggcggcgcatctggagttgttccttcctcccgtccagagttgttcatccctcctggtgggtttgtggtctcgctggcttcaggagtgaagctgcagaccttcacagtgagtgttacagctcataaaggcggtgcagacccaaagcagacccaaagcttccacaaagaacaaggcttccacagcctggaaggaaaccccaacacgttgccaccgctggctcgggcagcctccttttattcccttatctgaccccacccacatcctgttgattggcccattttacagagagctgattggtctgttttcacagggtgctgattggtgcatttacaatcctttagctagacacaaaagttctggaagtccccactagattagctagacacagagcactgattggtacatttacaaaccgtgagctagacaaagagtgctgatcagtgtgtttacaatcctttagctagacacagagtgctgattggtgcatttaaaatcctctagctagacataaaagttctccaagtccccaccagattagctagatatggagtgctgattggtgcatccacaaaccctgagctagaagcagagtgctgattgggtgcatatacaatcctccagctagacaaaaaagttctccaagtccccacctgactcaggagcccagctggcttcctctagtggatcacgtgcaggatccctgggctgagctgcctgccagtcccacaccaagtgccgcactcctcagcccttggggggtcaatgggactgggcgccgcagagaagggggcagcgcccatcggggaggctcgggccttgcgtggggaggggggttggggggcagtgctcctgcatggcaggctaagggtcccaagccctgccctgctgggagacggctgaggccctgagagaattccagcgcagtgcccgccggccggcactgctgggggacccagcgcaccctctgcacctgctggcccgggtgctaagcccctcactgctcggggcctgctgtgctggcctgcggctccgagtgcggggccagccaagcccacgcccacccagaacccgcattggccggttcccacccgcgcctctccctctacacctccccacaaggaaagggagccggctcctgcctcggccagcccagagaggggctcccacagtgcaacggctaaaaggctcctcaaatggtggccagagtagatgccaaggccaaggaggcaccgagagcgagcaagggctgctagcacgttgtcacctctcaatgagatgcagcaaaagcagttctaagatagaagtttatagcaatagacacccataataaaaaggaagatcccaaataaacaaatgttacacctcaaggaactaaaaaaaaaaaaaaaaaaaaaactaagcccaaagttagcagaagaaaggaaataataaaaatcagagcagaaataaatgaaatagtgactgagaaaatgatagaaaaaaaatcaacaaaagtggctttttggaagttaatcaaaatggacaaatctttaagtagactaataaaaaagagaaagactcaaataacattatgaatgaaggaggggacattacaactgataccacagtaatgcaaaagagtataagacactattatgaataattatatttcaataattgaataacctagaagaaatgggtaaatttctagagatatcacccacccagattgaatcaaaagaaagagaaaatccaaacaaactcataatgagtaagaagattaaatcagtaataaaaagtctccaatcaaagaaaacccaggaccagatggcttcactgcttaattttatcaaacatttaaagaagaattaattccaatccttctcaaactcttctgaaaaacattgaagaagaaatacttccaaactaatttcatgaggttagcattaccaccataccaaatccataaaaggacactacaaaaaaataaaattacatgccaatattcctggtgaacatagatacaaatatcctcaacaaaatactagcaaaccaaattcatcagtatatttaaaggaacatttatcatgatcaagtaggatttattccagagatgcaggtatggttgaatataagctaatctagaaatgtgatacaccacattaacagaataaaggacagaaaaatatgatcatgtccatggatgaaaaaagcatttaacaaaattcaatatccttttgcaataaaaattatcaaaaaattagatatacaaggaacataccttaacacagtaaattccatatatgacaaatccatggctaatatcatactggatgcctctaagattaggaataagacaaggattcccgttcttttcggttctgtctaactaaagtgctgtaagtcccagccagagcaattaggcaaaagaaaaataaatggcatccagattggaaaagaggaagtcaaattgcccctctttgcagatcacatgatcttataaatagaaaaaattagtgacctcactaaactactcttaaaactgatacattcagaaagttgcaggatacaacatcaacatacaaaaatcagtagtatttctacagactaacaacaaactctccaaaaaagaaatcaagaaaactatcccatttataatagctacaaaagcaataaaatacgcagaaataaatttaaacgaggtaaaagacctgtggattgaaaactctgatacattgataaaagaaattgaagaagacacaagtagagttatcccatgttcaatgattaaaagagtttatattgtttaaaatgtctgtattattccaagcaatctacatattcaatgtaatctgtattaaaatgccaatgtcacttttcatagcaatagaaaaaaaatcctaaaattcatatgcaagcacaaaagatgctgaatagccaaagcaatcttgagccaaaataacacaatcagaggtatcacattctccaatttcaaaatatactacaaagctatagtaatcaaaacagtgtggtactggcataaaaacgtacacaaagaccaatggaatggaatagacagtccaaaaatgaacccatgtatatatgatcaactaatctctgatgagggtgccaagaatagaaaatgtggaaaagataagtctcttcaataaattttgttggggaaaatggatatctacatgcagaagatgaaattagacccttttcacacaccatatgtaaaaatcaactcaaaatggattaaagatgtaaatcaagcaatacctgaaactgtaaaactgctagaagaaaacatagaggaaaatctccatgacataagtctgggcaatgattttttggatatgatctcaaaagaaaaggcaacaaaagtgaaaatagacaaatgggattacattatgctaaaaagtttcttcacagccaaggaaataattaacagagtgaagagacaacctatggaatggaagaaaatattgtaaaccatatatctgataaggagttaataccaaaaatgtatgtgaaactcctcaatagaaaaaaacccaaataacccaattaaaaaaataggcaaaatatctgaataaacatttctccaaagaagtcatgcacactggccaacatgtatatgaaaaactgttcaacttcactaaccattaaggaaatgtaaattaaaactgcaatgagctatatcaccttatacctgttacaatggctattatcaaaaggaccaaagataagtattggagaggatgtggaggaaagggaactcttgtacactcctggtgggaatggaaattagtacagccatatggaaaataatatagaggtttttcagaaaattttgaaaataccactacaatatgatcttgtaatctcacttctggatatatgtccaaatggtatgaaattagtatgtcaaagagattgcctgcattcccatgttcctcacagcattattcacaatagccaaaatatggaatcaaactaaatgtttgtcaacatatgaatggctaaagaaaatatggcatatacacacaataaaataccatttggtcttaaataagaaggaaatcctgtcatttgagatgacatggatccacctgagggacattagtaagtgaaataagacaggctttaccacatgatctaacttacatgtgaaatctaaaaaggttgaaatcatagaagcaaagagtggaacagtggttaacatgggctgtgggatggggtggagttggggaaataatggtcaaaggatacaacattgcagctggataagatgaacatgttcaagagatctattgtacaacccggtgagtggagttaatagaactgtattcctgaaaattgcttagaaagtattttgtgttcttaccacaaaaaaatgttaactatgtgaagtaatgcatgttaattatctggattcagcctttccacaatgtatacatattttaaaacatcatgtggtacatgataaataaacacaattttatttgtcatttaaaaaattacttaaggtttagaaagtagaaattagaatagttacctctttaaagatatttgcacaattaaaaagatttttcatgtttcttttttgaaaagtaacatatatacaatctagtactaaaccttaacagatagttattattttaagacgacagaaatgtgaacattttacttctgatgaagagaatctataagagagaaagatggtgatgctaaacaaatgagaaattataattattaaaatacaacaaggtatctgggatagaagcaagacaggtggaaagattcactcatgctttgccctgccaggagggaatattccagtataatgggcagaaaggaagaaaacatggaatgaatgcagtatgattaaaagtctggtgataggataaggatgcatctctagtctagtggcttcaattttctcagcaaagtaggaggacaattctgatagtaaggaaggaatggcaggattttaggtttgagagggtgaagcgggtgaaagcactgcagagacactgagggagataactaggaattacagaagaattgccaaagagcattgaagtctcaaaactcatcttaagttggataagtacacaattttaggagcagtgataggtaaatggcagaaagtatatacaagtattaagtaacttcaggctcaattccatccaccgaaatgttgggacttacagaaaagcagattcaatatggaagacgtggctcatatctgtcataggaataacagaagaagtagtagtaaacgtttattgagtacttactgaatcttctgtttaaatgttttacataaattttagtacacggccagtaaatagtgttattattttcagtgttctaatgagaaaaccacagcacaaagaagttgagtaattttcccaaggtcaaccagctacaaagtgcagagttttaaacagtgaatccaatgcatgtccagagaaaagtgagcaggacagcaaaggatctctgcaatataaggaagaattagataattgaggatattttgcctaaataagacaggcagcagcaaataacgattgcttcaatacttaagtagttgctatatggaaaaggaattagagttttacattatgtttcttcagggagcaaaactaaaactaatatgcagaagctgcaatgaagtagatttcatctggaaagaatgatttttgtagccatgagaaatacaggtgaagtagaaggagcagcttcagaaagtgaagttccagtgaccaaggagtttgagcccagaaagggatgttaggaaggactttatacataggtgagagaggacttgctagtttatgtaaagttcaacacccattctaacactgaaagtctgcctctagtgtgcattttattaaccccaataaacatttacttttttattttctccccagagtaagcatgttggcagatacatgaagcacttggatccatgtcatgacaatatttggatataacagataagacataatgctttgccaggactgctagacctgggctttcaattgcttccagggctataataaattcagatgttgggggaagagagaggaaaggagagagtgctttttgttgttgttttttgtttttgtttttgttttttgcaatgtagccccttcccaagagtaagaaaaaatattcttctgacaattgtaaagctgtttcctgccaaaattgtcattgttaaaacttttaaaagataatccatatgtccccacacttcatactcttgcactttcatgcaaagagctcaaataagaaaatttgaagtttttctctgagtagaggtcagtgtttctgatgcagtgccagttttaatgagaagattttattttctctctctcttaagagaatggcacgaggaagctacatgttaagaagttaagatggtctctacttggacctgatgctaaaagaaggttcatgccatattttatttgacattgtaatcttgatttggctgcccaatttattgaaaagattaatattctctacaggttttagatagcaaattttaagttttgatcctgacttgccttagagagcctttctttataaagcagctctcgttctttaatcttatagcaaccttactgtgttcttgctcctgttcttcaatgtggtattgtttgtttacctgtttgtgtagaatgttaggatgccacagttaaaaacaacacacatcccaattcattatgatccataggcatcacatgctgccactaatatgtacggtaaagcttacaccatccaatctgaagcaaatgacaaattcctgactctttatttcaggcacttctctccttgatttgtcttcttcaacagctgtcatctttgcaatttctcccaaatcagaccctatattactgagcaatgtacttgcacactttcatctttgtaaactactgcatgtctgctgctttataatttttattttattaattgagaatagatttccacccatttttcaataacatgcagcaatcttagtcactaaatattgtttaaaataaattctgcaattttcttacctgaaaatcagatagttttactttttgcttcaaattattacaaagctaccgtatgggaaggcagtcgtgcaattaaaccctggttattaagaattttgagagggaaatcgaacatggaaatatcacagctgaaatatttacacttaagtccttgtactttttttgctgattgttggaagcaaacccaatcagcaattttggcagtgagtagctatagtgtaaaacaaagatggagatgtggatacttatcatggagatgtgtgtccctttcaatttggtctgtctgatgaacagggagagaaacattgctactttattgttttggttgttattgttttcacaactttcacctaactctagtactctagtaacttgtctgggagacctgggcttgagtctgatttccatcacttgtcaatgactagaaaattctctctctctctttctctctctctctctctccccctccctctctctctctgcattcatttcttcatttgaaaatgaagagctagattggatactctctaaaatcctttccagctctaaaatcttgtttttatgagacactatttctggaatgagcaattaagaaataaataaataaaaatttaagtgatgtgataatcaagattatgtaactaaaaagatatgagagaataaattaccttttaaaattcctgaacaactcagtgggggaattattctgcctcagtgaaaatataagagaggaggtcaatgttctgtgttatcacataattttgacaaagccaatgagtgaggctaccgttaagtgccagcattggagagtttgcatgcaaacacaaaagaagtaaaaagcggaaaaaagaagaggtgtgacaaatggaaggtagcctgatcatctgcctgcagcctggccttctctctcttttctaaaatattttttggagacagggtctcactctgttgcccaggttggagtgcagtggcctgatctcagttgactgcaacctgtgcctcacgggttcaagcgatcctcacacctcagccacctgagtagctgggactacaggcacccacgaccacacctggctaagttttgtaattttagtagagacagggttttgtcatgttgaccaggctggtctcaaactcctcaagggatccccccgcttcagcttcccaaaatgttgggattacaggtgtgagccaccatacccagcagtttttttcttctcagtcatattcattcatttattcactcattcaacatgtattcactgaatgaatatttattaaatgcttatgatatacctgaaactcttctaagaactgggactatatcattgaacaagaaaattttccataccttatgaactttacgttttagttagggagacaaaaaataattaagaaaacacacacacacacacacacacacacacacacacacatacgtgtagttcaatttaacttcagatatacaatgctcaaataaaaaatgaagcactataataagatagaaactgactaggtatttagatggagagagaaggtctctctgaggaggtaactttgagtagagacctgtataagtgaggaagagaaccatacaaagatttttagaaggagctaaagttttatttagaaggagctcagttttgtaactgagatctttgcttctattatattttctaacaggttgttgtgagaaaagacttagaaagacctattgtgtacttacaaggaatatttaaatgccgaaagtggagctgctatggtctgaatgcttgtttttttacaaatattcatatgtttaaatcctaacctccaaggtgatggtattaggagatgggacctttgggaggtggatggttaatgagagcagagccctcatgaatgggattagtggctttaagaaagaggtcccaagggagcatgtttatctcttctgccatgtgaggacacagttagaaagtattatctatgaaccagaaagtgggccctcaccagacatcaaatctgcccgagctttgatcttagacttcccaacctccagaactgtaagaaataaacttccgctgtttataagctacccactttatggtattgttttatagcagcccaaatagactaagaccctaggagatttaatgaaaataaagtacttctaggatctaggagtcaaaatatcattatgacaatattgacaatattcctgggttttttttctttttcatagtgacagggtctcactaagttgctcaggatggtctcaaactcctggtcttaaaagatccttctgccttagtctcccaaattgccggtattacaagcatgagccactgtgcccagcctattcctcattctaagagagaatagggaattaacctatgcacatgggttccaagatcttacctgcccatttgctcatacaactggtgactgctcattgactaaaagaatggagaaaggggctttgctctatttctacttgtgtacctcaagatgccagtgtggttcttctgtgagatcactaaaatattagttgatagtcttttaactcactggtttttgatccatgaggcagataagatagcctaatttgtgatatgcctccaacctcttaacttgtgataactctaaggttaggtgggacatccatatttctttagggacaaccttcatactgctgtagttcttagagttgtgctagagagacaaagttatgggattgagccttgcaaaaatcagtgaccaacttgtcatctcataaatatgtggttggttacaaaaggtccctgataagaaagtatgaatgcatacaaaatttatcataaattccttcaacatagaaggtatgctttttgcccaggaattttaacttgttatttcttctccctagaatgatttctcctcagctgataatatgtatcacttctttaattcttttcaggtttttgctcaaactcagagaagtcttccttcacttccctatttaaaattgatctctactctcattatcccatatccccatttcctgctttattttctctccaaagcacttatcaccatctaatatatttattccttatttattgacttttgcctattgaaatgtgagctccatgggatcagggatttctgtatcttttattcaatattttcccaaggcctatggcaactaatattggttaagtgaattaatgagttcttagtgtgtttttgttagagtttggtatattaagtgctcagtacagtgcctcgtacatagtaaatactgaataaattatagctataattattattcataaaccaactgaaatatatattttttgatactaaacaattagatcagtcatgttagaccattcatatcactattttcattctgccaattttagaatctaatattatattagtccattttcatactgctgataaaaacatgtctgagactgggaagaaaaagaagtttaattggatttatagttccacatggctgggaggcctcagaatcatggcgggaggcaaaaggcacttcttaaatggtggtggcaagagacaaacccctgataaacccatcggttcttgtgagactgattcgctatcacgagaatagcatgggaaagaccgccccctatgattcaaatccctcccacaacacgtggggattctgggagatacaattcaagctgagattttggtgaggacacagccaacccatatcaaatgtcattttctttttaaacctcttaaaacatttatattagttaaaaataatttcataaggcagaagaagtaagtcttgaggtataaagcattgatctctactctcatatcccctcttggtctccagggttttaagtgcaccaaaacaaaacaaaacaaaaacaaaataaaaaaccaacaactatgtacaatgtacaccttggccactattgctggaaggctaacttttattagcctgaaggttgttgatgcaggctttatcaccgaagagattaatgtaaaattgctgagagtctgccaacagggtaaatgttcccagagagatggcaaaagcagcaaggtaagagatttaagtgcctcaacatttcttattaatttttagtgaaaatgttaaacagtcgaatcaacgtatggtggaattacaattcagctcacagttagtttgtaaaaatttcatgcagcttcaaaaagtctggttcaaaaactggtgcactgctcaccatccatacacattataaaattaaaaagttctggatgccgcaagtgacctctacatttgcagttgttaaatccaagaactttagaaactagaaaacatatgcttaaaaacgaattgttgtttatctaaaattcaaatctaacagagtcttctctattttatctggcaagtctaattcatggggaaaatacattctactaaaattctgctgctaaattaacttttcttaaaacaatggagacattggtatccttaacaacattaatcaattaattaagacatacattcttgcaatgacaaaacatatacaatttgcttactggtctctctgaattcataatcactaactttaagagggcgtttagcatacacctgcaatcctactacattttgctggaacttccctactgtcctagatgaccatctcctaacttttcttcacctcttaaatatgcaacaaccctaccattttcttttgtttttgcaggtacactttcttcccctttcattaacaaatagaagcaactggaagagctcttctacttactttctcaacatctattcactctctcagtctatgcccatggccttccttcctctgtcctttctgtctcagtcctaaggccaatccttcctcttaagcaccagatcccatctccttttgcctcttaggggtatttctactacaattgttgtctgcttccctccttcaagatcctcaactttatcttctctaatagattatttccatcagcattcaatcatgtagcaatattttcatctgagagagagagagagaaggaggggaggagggaaaaaacagggaaaggaaaggaaggagaaaaatgcctcctttggtctcatatctaccttcaagtataatttcatttatttgtttcctccttcacataaatcctgcttaaaatgtttacctacttactactttcaattcattctatggtctttcctcccttgaacccactccagtcaagattttgacccttcttcactgaaattgcttctgtctaatttaccactgacctccaggagctgaatccaatggcacattcttcgtcctcaccttaattgctgtatgagtttcctagagctattataataaagtaccagtcttatcttactataatctattctctacacaacagccagaatgatctgttaaaaggtcagatcatgttacttctccatctaaaacctctaatgattcccccttttttcagaataattaacaatgtccttacaatggcctaaaagctggcccctccccagtcatgaccatcaactcccaaaccaatgcaccgttccccttatgtccctttcacatacctcagaatttactcttcccactctttgggaccatcgtcctccaaatttgtccaggatattttcatgactttctcacttagtttcttacttctatgcaaaaatgtccacttaaaaaggtttttgccttttacaaaaaaaaaaaaaaaaatcctcaccagtaacccaattatgcctttcccactttgcttttcacctaggcttaagaccacctgacacattacaaatgaataaaagcaattattttgtatctctccagtttgctgcctttctctcccactctactggaaactaacttctaagaagactgagatttttatctcttgttttctattgctagtgttgaaagaatcactgaatcaatcagaacataactctaaaaagttaatcagagttcagttctgtacaccaagttaaagtcttgtaaccagtgaatacctagagcaaaattaagaaaagattgtcctttagaatgcagaaacttctgcatacttataaaatcttataaaattgttacactgtgaattaaacatagttttctcctttttaaattagcattagtctccaaagaattttttctagttggacaaagactgctattacttatattttctctcctttgtcaccttaaagagtaaaattttttgccagttattcttttgtttcccttaatataagattagaacctctgtagccatttcaacatacaaattcagcctatatctctcctgccaaatgtcttctgtactaattttatattttatattaattttttatcatatacaaaaggttaatcttttatacaaaagattaatctttattctgtgtcctgctgaatacttatcagaagtttaatctcccccagacacttttatataaatatttatagggttgacattgaataataaaatgaaagctcctgatactcttgccctgtcacatctcaaatagtttttttaaaaagtgtcaatcagatttatagcactaactaagtcacataattgagcacagcttgaagaccctaaatttaccaaccataaaaggaataattttaggaaacgtttggagctctgtatgtaagttactggcagagaccttcatgaatattggtcccatctccatgcagagaagagaagatcttggcctctgatctagttgtggggttggatgaagctagcctagtagttgtgagccttgtcaggccctttgggaaatgacagatacaggctcattatctttggtgccatgactacgacaagcctgaaatctagaaacatgactattaactgactggaatcatctaggtatgttccgtctctcctactcttcctggtagggagcagaacatagcattcagcccagaagctgatgttgctaggaagaaaaatcccatgggaaaaaaatctctctcactgatatttctcactgggaaatgctcattgaaataatgcctttcaggatcctttgataatattattcaattttgtccttacgacaatattataaagctttgctcatccaccctggctgaatatgagtcagctgaaaaaattaaaaaaaaaaaaaaaaaaaaacagagatccagaccttcctacaaactggataggacccagacatctctgttttgtaaagactctcccagtgatttaatacaaatacacagagcggataaaaaattatgtaaaaaagattggctgggccaatgtagttactctgtataacaagtaagaaaacaggtcagacaggttaagtgacttacccaaggtcacactgccaacacaaggtcttctcttgccatcatatcatggtgccctctcccagcttccccaatttctactatttcatataaattttctgccttttcagttaatgaagcttacttcagctcatttcagctcagaggagaaaaacatgaacaaaattggactaaaatgggtgtaagaattggttcatggaggataaaaagcattggatttctgccagacccttcaggatgtgaatcagtcaaagaaatcaagtcaacacataataataacaacaaaagcaacaactcttttggtattttacatagtaaagccctttgcatgctgtaatttcaataatgattcctgcaaatgcaaaagtcacacaattttatctctgtctttgtattcttttttatttcagacattctttgtataggcttagatttaaacaacataaatatctgagaatctttacccaatcatgagtctgaaaaagtcaattgatggattcttataaacattgtctaacttccccgacccatctgtttcaatgccagcataggccagtaaggccacatttgtccattgaggatttaaaggcctgatgttctaaaagtctgaaagatcctcagctgtggagagatgacagtgtcagaaattcctgactagcaatacttttatatgatcataacttctttttaatcataaaacacctcttttgttttataaattttttcccttcacctttctaaactattctcagagattacactttccaaaaaatgatatttttgtcacatattacaactcaagggccaaaacagctggtttatgacttataagtactttgtgaattgcttgagctggtggggaaggttagacaataggaacgaagttttcctactataaatcattgagtcacagaatcttagctttctagaactagaaaagataaacacaatctaatataagtccaacacattgcaggcgagaaaacaggcccctggatgttggtaaccagttggggccaaacagggaattctggacagagcagacagtagaagccaagttcgtttgccttgactcccatgtattttcctaagccagactgtctactttggagtatgagatcctctgagcacatctaactctgtcttctccttcaagattcaattcatttgctgcctggtattacggaatttcaggaatgaaagagatgctaaaatcatcctgtccattcagggtttgacttttttctaccatggtccccaccacagggtcaagtactttagtaacaaaactcctaatgaagcagcctgttccatctttggatactttggattaaataacttataatatttagctaaaatgttttcctaaagcaactgttaaaaaattgatcacttttgtcatataagagtctcttatatacttgaacataggtataataaggacaccttttttgcattttccccagaataaccattgcttgcctttaaaatttcttcatgttgtgccatcctaattgctctcctttatatgccattaggttttgaaatatgtcttaaaatgtggtattcagaattaaacacattattgtaaggactgctaagaacagaatttttctttcttctttctagaatattctctattaaataaagcccataaatgctcaacaggagtgatatcacccccaagaggctgaaaactggttcttggggaaaaaaaacttacttttttaatgtataaagcacatataatgtacataaagtacattaacagatatgttatgtacttaaatatctgtggtattcaaatttcattggggaagtgatcagaaaaaaacatttttagggactccttaaagggataatagttttttttaaaaaaaggctgtgaaacagtgatatagcctaagatcacactagcacattagctattttatcagagaatcatactattaacccctattgagtttatagtcaagcacaatccttaaaactatctatctaacctacttgtacaactgttgaaaggtattttcactaccgcgaggtttccagtgtgtttggttggttagatgattggtttgtttttgaagagtagtaattttttttttgcctaattttgttactataagagcacaaagttaaatttatttctgataaaattgcccttgttaggttttatctattcccgcctgtccagatattttggaatgtaatacattcattattttctgaagctctgattatttgcaaattttatctcctatcatcttgattgctcatgccagtaatttgcagaaacaacgttaagagaacagagctgagaatattgtcccgcacacaacttttccattttgtgttaaagtatcagcagtatgttttgactaacatttcttcatcgaggtattaatgttactaactgtacatttccttacataaaatccatagttttctatttttttttatttgtacactctgagaaagaatgtcaagtgtctcacagaaatccagattgcctggctctagtatactttctaacagcctagtaagccaagtgaataaagaagcaagatttagtcttttgtttttctttaataattctgtgctggctcactctcattacttcttcaatttatctatacttaagaggttctttttagtagtctgtacagacatctcttcccagcacagcttaaatattctattgactgcatttctccctataacagtatttgtcagttacatctagttggctcttgctctgtttgttttcatgggcatatgccttaacttttcaaaaaagattataaactcccagggttgaagcatatactcttatagtgcccacagctgcccattaaagtatcacagaagatgataaaaataaattgtttgatttactaataacaaactactcactatcaaatcagattgatgaaaggatcatgaatcattcactcacaccctagcccaggtttacagattgttttaaatgcttgcttctaataagggtgtattaaaagagttaaatgctttcttctaataagggtatattaaaagagtttctttccaacactcaatttactaatttatcactaagaaatagcgtttttgctaagtaataaggaaattaagaactgatgatggaaaaggaaactatataggggaatataatgggaaacataaaagggaaatatgtctgcaaaaagtaggattacaaggtcatgtttctttagaatgaggagcctgtttccattttcacaaattaaaatcatttgaaagcacatatacttatcaggatgggttcctaaaacttttttctcaactctcatatgtgtgtgtgtgtgtgtgtgtgtgtgtgtgtgtgtgatacacatccacatatatacatacatacacatatatattcaaagatatataatcttatatataaaatatattggccgggtgcggtggttcatgtctataatcccagcactttgggaggccgaggtgggcggatcacttgaggccagaagtttgagaccagcctggccaacatggcaaaacccgtctctactaataacacaaaaattaaccgggtgtggtggtgcacgtctgtaatcccagctatttgggaggctgaggcatgagaatcacttaaacctgggcggtggaggttgcagtgagctgagatggcaccactgcactccagcctgggcgacagagtcagaccctgtctcaaaaataaataaataataaaatatctcacatatatattctatatatatatatctcattgtgcaaagttcccaaattagacattttgactacattaaaaacacaatgactacttggataaaaactggattaccaaattatctaaatgagccatttgtgtgctatttgatggtggtatatttttatatcttggatattatccatatactgaatatatatgttccaatattctaaatctctaatataattcaattacttgaaataacatattaaataatctgagagagggcggagaacgaattaagcctcaattatttttacaatatgctgtatgcttggtgttaacacaggtgttcattcattattctcaaggcctttttgtatagctaaaatatttcatattataataagttgtgtgtcatagcagatcatgttaaaagaaatctaaagttgcccgagcgtggtggctcacgtttgtaatcccagaactttgggaggccgaggctgatggatcacttgaggtcaggagttcgagaccatcctggccaacatggtgaaaccccatctctactaaaaatacaaaattagccaggcatggtggcatgtgcctgtagtcccagctactctggaggctgaggcacgagaatcacttgaaccgggaggcagaggttgcagtgagccgagatcacaccactgtactccagcctgggtgacagagcgagacttttgtcaaaaaaaaagaaaaaaagaaaaagaaatctaaagttaaaaaataatctaaagtttccattttgccattcaactgccatgtttacccacagctcctcttttctggtagctgttttcagttaaggaaagggaacactgggtggaggatgggacaggaacactcctttcacagagggctctgcatatagcagtccccttgagcatgaattttccaagctttgataaaatctattgaggaggtaaagagaggattcatctttaaaatattgtcaatgtatagttaattaaatagagtttattctgctgcaatcttacagccctgagaggtacagaatgctgaggttcataaatgctgtcagcaacacagtgaggcagtgagggtgaggagaggaaggggggataaaaacaattgcatgaaaaatagaataaattttgagatgtcttctaaatcaaagctcatccaatatggagaattgaaaaaaaattaaacaaggaacatttgagattcatggtatagaaatctccctttccctaaacattctttaaggtcttctttcaattatttctgacagttatggcaacatattatgagagtaatatgtccactatgggggggatacgcattagttcactattgttgccataacaaattaccacaaacccaacagcctaccacaacataaatgtatttgttctcagttctataggtcagaaatctggctgggttcagctgattcctggggtctaaaaggtccaaatcaagttgctggccagcctgggctcttatttgaaggtctgagcaaagaaagtacttccacgccaaggtcagtggctgaattcaattccatgctaccatagaactgacatctcaatttccttggggctcttctccagggatggttcttaacttccagagatcaatcactttccttggctcagcgtccccttcctccatcttaaaggcagcaacaataggctgtgtccttctcacattttaaatccttctaacctccccttctacctcttctcttctaggctcccctcaccgactgatttttctgttctccgattctgcccttaaagggttcatgtgattacattgatctcacctggataatctaggctaatctcctttttctttaaacgtcaatgattagtaatattagtttcatattcaaaattccttcaaaacattacctaggttagcatttgattataaccaggaatgggaatcttgcagagacatctgaattctgtctaccacagggtgtgcccaccagattcaaacagacctgccaaccagaaattggcagtttgatttatatttctcagtctatgaaacataacatttctctaaatgaagcattcttaaatagtatttgattactcaagtggataacttcatggctaatgataaagcttttctattagaagtttccattaagaatgcttttgtttgagttgttttgtgttttaaaacaggacttggatttcttgggagaagctgtttaaacaaaggagagaggatattatttgattacaattagagatgtctttttgtaggaagcaattatcagtataaattaagaaccaaactgcaaattcaattattcctaagtatttactagagaaacattagtttaactgtaattcttctggaaattaaccccataaaatatgttataagagcattaattgcatttttatagttaaaatatgacgcaataacaatattacaaaagctatttgatccatattaattttgtacaattgctgaaaaccatctattgaaatcatttttttaatatttgaattggagtgcattaggttactcctttgaagatttatgcattacccaagaaagagaaaaccaatttttaaaaataccaattaaatgaagatactcagttaaattaaaaaataattctaatgctccaaattcttgctgtgaatttgcttattgtggaatcagaacatatttgaaagaatgaaaatggccgattttaaagtacttttgaattttctgttacttttcttgttaaaccctaaatagttataataattgtaatgaaaatgtttttagttactgacctccacatgagtggcaacatgagtttcacacagttacatatattcagctgataaaccaggtagtaaaaggaaatgattaagatcacaggactctgaagtcagactacctagatttcagtcccatttgtcactttatctgaatggcttgaggcaaattattcagcctctctatgcctcagcttccttctgtaaaacggggataagagtagtacacattactcccagggttgctgtgaggataaaataggataatacatacaagtaaatacatgtaaagtcatgtaaatgtttcatagttggtatggactaaataaatgctggttattattcttgaagtgatgtccaatgttaggccctagactgacaaactgagacctcaactcttcaaacctgtcagcattaggatatagaggcaaacagccttggcctcagtagaactgacctgtagtcaagtcagctgatcaacagagagaatggaggaaggggctgaagagtccctacagaactccagcaattagctctgtactcctactggctagctatgttttcaccgctacaaagatgctatcgatatatccctcatcctggccattcaccttggtcattcattttttatcaaaaaaaaaatagtgagtacctaacaaagttataggctctgtgtgaagaagatataaagagctgaattttaaaattataagattttctgctcttacggagttcacagtcttgcaaacaaacactagcaaccccaagccatccttccttttgactcactgatttaaattgaacaagaaagccactttcctattgaaagtaataaaaattagggaaaaaagatgaaaatggtatcatgagatgtcgaagttgaggtgctatcaatgctttgggggttatgtatcaaaatttccttaagacttttttacgacattgtcactcacagttttattaaaacagacactcaaaggaaagctatggaaaaataacacagtgtctctggttcctacaaggtatttggttatggtgggagaggagacgtaaattacctctttacttccacatacccacagagaccctccatcacatctgcttttctccacccacccgagcaacacccactatcttaataccaagtgctgtataatcaactgagttaaactattttcaatttaagctcaagaaagtttagaagagctccttaaggagtagcagtttagatccaaaaagctcttaagattgatcagccttctttcatgcagtctatattctgagggtctcagaattttaggcttagaagaaaattttaatatataataaaattattttattcttctaaatatttgaataattttctcaaagccatatggatgttagttgcaaatccagatctgggccttaaattccatttctatttcaacttctttccacatcagcatgtattataattgaatataatgggcatttactactgccaaggatagattctaaagtactgattcaatctattgctaatgaggcattaaatgtccacagctgataacaaatagcatgaaaaatatttgaaaacagaatttatcaccatttagcaccactttagtcagattgcataccacctttgtttatgtattccatcatgcttatctctttgttaaagatttttgttcgttaaatcaccatatagacatattacatacattaatgaaattataaacttgactttgaagttgatgtagctaaaaaatattgggaaaagagtaaaagattcattaagtgttgctaaattgtaagtggttctatgttatgtttccaaacaaaagaaatcgtctacattacaacattgtaaaagtaatgaccacaaataaaataacactttaatacaccaggcttgctccaatactgaaatttttcttttagtttaagatacaaaactcctagacacttgtttattaagaatatctttactggtggaaaatgatatatttaagcttccaatttatgaataattaaattcctatgattagatataccaaatacagccacatcgtcaaaggatatactacataatcttaaaggcaatgaagattagatatgggccttattatattcatcatttcaaagaaacatcaaaagacatctgaataaaataaacaggagtttttatttttatttttatttttgcttgtatcaagaactttctgagcacactgtctggcaaatttagagtgtcagattagaagttcaatggcaatttgattcttgtctttgtaaacatttttacattctaccaggaagtgtataggtttttctttttattattgaaatttagaaatctcacaataatatctagatgtgagccttctttcattatcactatactaactcagcacttgttaattttttttttggtctgaagcctcaagtctttagctcaagagagtatcttctcctgtgactattgtttctcctcaatcaattccatctattcttataagatttatgtattgggtgttagtgccaagattctctaatatttgctgagattttctaacttcttcttttaaaatctgacatatgggataactccttgggtttgcttctgatttttattgatagctgttgtgctcttttcttgtcctagtaagggtttttatttgcttttgggtttttttgttgttgttcttttattatttcttcaaaacaatggtcatcttcttttcagtttctaagtccttggtattcagtgtatagtgtaattaaggttatgggcactgaatgtaggtctttctagagccttgggttagcactttcctagctattttaccttgggcaaggtatattaactatgcctcagttttctcaccacatagagataatgtgcaataatcttcagtaatattaccctattgctcctttgcatagcagtgtgtttgctcttttacagagtgaagaaaaaaaaaacctcccaaatatcaatgaggacatcaattagaattctaaatcattatcttttgtctacctgtaatatctatatttcatttgttctaattcccagctttatccctattctctccaatgatgggtaatactttattatctgttcatatgtatgcgttcagcgttagattgcccatcctagtggttgatacgggctccctctgcttaggccacctttgatgtcatgaaattgctgtgttcagggcataaagaggaacagaaaggttgatttattcccaggtgcatatgctggaaatgaacctgatacatctgtttcaaagagaaaaagcaaagttaaagtgggtaggaaaagctccaactgcatttagaatgccgatgacaccaagtggaagaagcaccagggcaaatatttcagctatcttctctctgcagagctctaataaatcctagagggcctcttgtgtgattctctctgacattcccactctttcaaatgggggttaaacaacgctacagcttcccaagcataagattcccacagttttctgctggaaagactgtctacttgcctctcagggcttccttacctggtttatattgagcaaaacaaaagccattgtcagctccttgattaaacccgatccatctgctgctgcttttttttttctttttaaataaattactgaaagagtatgcttgcttgatgttacccttcctattttctagtattactacatacctttttgctcattttgtgcttctttagtcattttcatggggttaagatatgaagggaagaaaaaaaatgagttggtttaacttcccatcctaaagctggaaattatattttggatcttgaaaataaccaaaatattcattatttttatggcagttgagttagtcgaggaacagattctatgtaatgtcatgttaagttgcttatttagctaaaatgatgcaaagtaaatagctgtcaacatgattaaaattacttgcaatctgaatttaattaaattgagaactatgttattttcctactttctccaacctctggccacttaattagtaagatttacttttagttcatctcaaaatttctgtgcttatggtcaagagtggttatgtgaacaactcaaaagagacatccagcctgaatcatttttattggcacagataccattatgtgactgtttgggttactatttgccttcttaattatattatcttcagcctaatacatgaaaataagatttcaatccctgtggctatgacagaatatttgggagatactatctggagaaagcaaaggctatgccacccagaaatttgaatctggaaacacagaagttgcaacctgactatataaaatcaaaaggaccaaagagaggtgcaaggtctcagagctattgtttacataaaaccagtcatgtctaaatcattggaagaaagcttttgtacaacggaggatttattttctgttaacataaataatgggaatttctacatgttagagttaaaacctttaaaacacacacacacacacacacaactgcaatttatcttattccttccaggttgtgaaatggactgggggaaaaagaaaacggtgacagagaaagaggttagactggcttgttctgtgtaggcaggctgtcaaaatggctgctgggataggaaaaggtattcaactttatgcagtgaaggaagctgtacagactcctcctgagcgtctgtgaggtcaaatgctatgcaccccaatctacttcctgaaattaatagccaggtgttatgctagttactgtaccttaatcattaattatgactgtggcagcaagagagaaaaaaattctaggatacatgagctagagtgataaagggaaagcatcaatcacgcatgacaggaaagccaaaggtaccctctctctgcctgggatactttcatttgtgactgcagattttctcctacatcagacttcaaacttcagagaaaccatttctcatagcctgcctctctctctttctccctctcacaaccagctatggtcctaggactcaggaggatgaaaacaaaataaaacacatttgttagtaatgccatattttccatgtactaccaccaggatctatttgaaattaaaggtaatttatacaaataaaatattcagtcaagagatgatttattcaaaaaagcaagctacagcaagaatggagtttagagtcaatagttaataaacattctggcagcacaggctggcccacatgccttcatttttctacaatgtcataaatgtgttgcatgtcatcttaaacaagtgggcagagcaggtgaatctccctcaaagtctcatggcacagtctagtatgttacaaatcttgataagcagaaacccaagccacattctggtggtactgagtggtcagaaatggggtatttggaagtaggaagaaatacattaatttagttgaatggaaggaaactaagttgggttctactttactatggtattgtggatagattacttgacttctctagcattggtttcctgtttgtaaatgactggtttgagccagatcaggaacccttattctggggtgacataggagcttcagaggatctggcaggaaactcaaattataggagaaattgttcagcatattatttaagtgttactaaaaaaacatacacactaaaggagtgcttctctaactatctgtagtgaagaattagcactttgtaatttccaatctgctatgaaccacctccttttaaaaatcatacaaaaatgaaataaaaaataattttatacaaaatagaagcccactttttttttaatcagactcaatagatataaaaatactccttcaagttgctataaagatgatatggtatggctgtgttcccacccaaatctcatcttgaattgtagcacccataattcccacatgtcatgggaaggacccaatgggaggtaattgaatcatgtgggcggagctttcccatgctgttttcatgatagtgaataagtctcatgagatttgatggttttataaaggggagttcccctacacaagctctcttacctgctgccatgtaagatgtgcttttgcttctcatttcccttctgccatgattataagcctccccagccatgtggaacctctttcctttataaggtccattaaacttctttcctttataaattacccggtctctggtatgtctttattagcagtgtgagaatagactaatacaaaagattttaaaatcttcctatcaacttgggtcattgtaatggactgaccagaactggaccataggtcaaactttgagtaacaactattctaaggttccttccagctataatcttaaaactttctatgtaaaaaacagatatccctatgtccattctgcctcaactcctcctgccaaaaccatacaatctcacttgccattgcattcagcactataaacggaactcaatctaaaggtccatcttccttgaaatgcaatgaaagattgtaaataataatgacaatgacaacaaaatatgctttcccttgtcactggtgattatttatgttccctgaacaacaaggataaaaatgagggaaagcctgtaggactacttaccactagaacctaggccatctgctccctgacctagtagttccctcatctatgcttttgtgctctcataattatcctgactcagaaagcctttactagcctttcccctattccctacctgcagtcttttcaagatccttactgcatttattgggtactcaaagcttatctattaagcacttacaaatagaagaggataaaattataattatttggtccctgtcacatacacacacacatgcacacatgcatacacatatatacatatatggcccctgcccttaagttgtctagagcaattcaatgtttataagtatgttatatgaagaatcacaacagggaatgcagaaggggcaatgacaaaagtcaaagttagacaggaagggtcacataagacttcttagaagaacacttttggggctatttcttgagtcatgactatctggtgatctggctgtaatattaaagaggcttagtcagctcactgaactattacttgcagttcttcccttcctttattgctacatatttggtctagaagtacattctttccaaagagtcgactcctctttcatcaagagtgttctaattaactaaggggggaaaaacatgtgtatgagagtgtgtgtgtgtgtgcacgcaagtgtgtcagttttatgtgtttggtgggagaaaggcaaagaatctgggagagcagcgcatgtaaagtaatgtttaaaggctggagaaggagggaccaccaggtcatgaagcttcttgtatatttccctaaggattctggattcatcctgagcacactggtgactcattaaaaggttttaagtaagggtgtaatatggtcaatgttttgtttttaaaagatcactctagcagcatgatgtaggatatctaggtggtgagcagggtggatctggtagtgccaaggtgttcatctaataattcaaatgagaaatcatgaaatcctagactaagtcagtagcagacaggaatgcgaagccatttcaatctgagacagatttgaagcacaccaagaaggcagaattactggctatgaatcatggacaaatgaatgaatgaatgatgaatgattttgaggatactagcttcagcaattgggagattggtgatttcattccctgaaagagaaaaacactcgtgtaaatacaagatgagagtgtaacaaacaagaattcagatttaaataagttaaattcaaggtgtctgcagaatgtttatatggagaagtctgttgggaggtagaaacaggagtctgtagttagaagttgggtctggactagagaaaataagttgatcaacagtaactgaaggcttgagatgggtgtgattacttcagcatgccttgcctgaggaacttcattccactccaatagatttgattttaccccagaagtattcttcatttttatcacctgtatgttttccttaataggcattgtataaaaatatactcttttttactaaataaaaacataagtgggaaaaataagctaaagggccaatgaggtacagcaatgaagataaagttggactgtgacttacacacaacatgcaaactacttgataccatttactgatctctggatcacactctgacactacactttcaagcaacaatgcaaagggtgacgaaatcgcaagttacatatttaatactcatacaataaaagtaaaccaatttctccaaaacagaattatttatgttactgtgagctgagaaaaatttctcctgaaggtcctcataagaagagcattcaccatattaatggtgagcagtatcttttttttgacacggattctctgtcaccaggctggagtgcagtagcttgatctcggctcactgcaacctccacctcccgggttcaagcgattgtcctgccttagcctagcctcctgagtagctgggactacaagcacatgccaccatgcccgactaatgtttttttttgtttgttttttgtttttttgtttgtttgtttgttttactagagatggggtttcactgtgttagccaggatggtctcaatctcctgacctcgtgatcctcctgcctcagcctcccaaggtgctgggattacagacatcagccaccacacctggccagtgagccttattcttaatcacatccccatagtgaataaaaaataatacttacacaattattatatccatcaatgtaaggtgatagtataataacaaagaagagtagaggaaaggcaattcaaaggaagaagaatggcaaaattctgtcatttatgtggacagcccatgtggattggtatgtatgaatgaacagcaacatttccttcaggtattcatctataatacttgggatatgggatgtattttatctcccaaactagactggtatgtccacatctgcctttccactatttaatgtccacaactttcttcaagatgcattcatttgttccttcaatagtcaataattttctgaactaaagtcatgaaggactgagtcttaaaggatacttaggaatgattcagacaagatgggagacagggtaggaatagaaacacttccaaacagatggatacgtagcatgaacaaagctaccaaggtaagaatgagcttggtatgcaaagaaatataagcaatttagcatggcaacaatgataataataaggcagagagaatgatgagagaggaagctaaaaaggtagacaggagagcattgaaggaattttttcttatctctactcttggcaaatacaactcttggggactgagatcatatgtagccttaaatgttgcataagctgtgtatatggcacagaggtgatctccagtgtctacataaactttgtggaatttcactgatgaaacagtttgtgccatggctggagaaaagcatttggatgcatatttattgactgatgtatcggatgtgatgtgatgtttgaaatatgtcataagagtgctttctagaagaattacccatttgttcattatgtaagagagaaattgtttctggtcctctagaataggactttggggagtgactgcatattaccctgactcattctgccatcaatgtgctggagtcaccattcaacaactgcttcaactcacttggtcctaagtttggcagctcaaaattccaacaacctcacagaatatacctggggatccaaactggaaacagctcattagattcaaaataggagggtatattttagaaaataaaatctagcatacctttactggctcttaaaaaatcagattggaataggtggtctgaaaatgaatttatccagcaaaccatattaaaaaacaaaacaaaacaatatcggagtcctggcctaaataaagtggttggttactacctccctcttcaatcaccttaggctcttgtagcaaaaggacttttaccatattagctgctacaagatttaataaggatatgatgtactatatccttcattttgctaggcaacgcaacattctaaataagattgaatgtttgtcaatatttggaagaggaacctcaggggtttctttaaaaatttcctcttttcctattcctctaagactgattttaacctaaaactgattttttcttttcatgtatacaagatacctttttgggggtttgtgtttatttcccctgaagaaggctttacagagcttggattttaatggaaatttattgctggatgtttgatagccaaaaggattgtgttttgatcacagtcaaaatggcaattttctccacagtagcatagcagcatactagtacaaggccactgcagctagaaacctgtgggcgtgtcaggtcctttgtagtgagtgtcagtagcacctgcaagagcccaatccctaactgtgctggaaggaggtttgatcctattaagtttcaaataatatgtcagcttttcagctttgatacaaattcctccagaattatctattttcccacttgtgatataagacttcgtgaaatgtgtaaaatctaagagggtctgcctcattttctgtgttgggagagctttggaatgacctcggactctgtcaagactagtatttcttgagctttccccaaaccaattaatcttttcatctgggggttatacaatgcacaataataagaattaaaggtaaaaattaaaagaaaataaagaaatcttgttgtataagaattaatgcaacacaaacatagaggccatctcctcaaaactgacctggatggctacagattaaaatatggatggaaggaccactgagaaaaaagacagacatagagagcaagaattaatctaatactacatgtttggtacacaaacaacaaatcaaattgagcaaattattttctcaggagattctctcaatcactgtattttattatctgtgaattccagtaaaatcctcattttctaggtggaggctttcttttttttttttatttctgttttctttcttttttctttttcaggttttattttagattcagggggtacatgtacaggtttgttatatgggtatatttcatggtgaagccctttcaataacaaaaggaagaggtaaataattatacaaacaaaacaaagaaaagcaacattaaagaatacatttaaatgtgagtcaaaagacctaaattgagggccaacaagcatttgctctgtcacttcacttttctgtgcctcagttttcttttctggaaaatggaggtcatgaaaatactcatacctgccctcctcatttcacaggttgtggagcaaatgcaatgagtgtggctcaatcattgccagatcttaacgttgtacataaatgttagtgactgaggacaattatttaacccctatgagctttcatatatccacccgtcaaataaagcttggatactggcctgcctatccccaaaatgatcttataaaaatcaagtaaggtgataccagtgtgtgctttgaagtagtaggtgctatcaagtattagactgtcaaatatattcaaacaactgtgtgtgggaaaagattgtggtggactagaaatagccaaactttagaagtattctatagtctttgggaataaagctgggatgtatgaaaaaccttcttatgatattaaaatgttcacctttgaggaagaaagtagactagcagaaagtttcactatcaaaattctagaacattaactactgatactattacaagttgttaggaaacagtaaattaaactttgtaatgctctcccaaaggaagtagaaatacaccatcattacttatagtttaaattggactgggaacagtgggccagcatgtattatggagaagcaatgcttcagtagtagcaaagtgaaccaaatgacactgcagatcttatccatatttaatgtttgacaggcaaaaatacttacattaatgcagtaatgtgctatgcaagtcatcaacatgggaatgctcaaagctttaatactgtttaataagcatcacactatgagagcatattttccctttcaagtacgactcattcaagtttgagggaactgctaaattgtcacacttggcaaaatcttgaatgacagccaatctaaacaaaagcaatcattttgtattttgggctggtttgaagaaagatgggaagtgtgaggtaggcagggggatgtaggataccccaaaaggccacaataatcagacaaaacccccagcaaaattgcaaaggtaggatagacaagaaaaggcatcaatgctttgcgattgaacctacacaatgacctgatgtatacaaaaaagatgggattttggtcaatggtaaagtttatttcaggggctggaggtgtgagacatggctcctaaaagtaggtgtgtcaatgactaattatctaatttacaataagttgacctctctgtaattctgtcccactttttcaatttctaaaccagcagttctcagttggggaggggaaggaggataaattttgtcagggatattggggttatctggcttgtcaccacaggggaagtgtggtgctactggcatctagaaagtggagtccaaggatactgctacatatcctataatgcacagggtagccctccacaatagagaattatctagctgagattcaataataccaagcttgagaatacacgtgctaaactaaaatcatctgagaagtatattatggggtaaaatgggacctaatcattcttagcataaaagcaattttctaaaaatcagtattttattaatattactgttattgcttaagcttcttttctactgagtttccttttaattataaagcacttggcagaaaaataagattcatttctataataggcttagtgctttctttttcagcagtctttttcttcaattaattaacatttaactgctttcttataatgaaggccaaaaaaacaagctgtctccttaaacttctcaggagaagtgataaaactctgtgagtatattaaatttttctgataaagtatttgtaggacatagatttaggaggtctttctctcttaggaatgttacttataaacatttcttggaagtccaagataaaattaaaaacacgtgcatgattctagaggctacatatgctattgatgctgaaaatagaatgttggcaccggagaagtccttactatatatgtggatgaagatgaactcctatttattagtaattatgtaggaataaacgtgatgattctaaaaaaattatcttattgtctttgttggcatttattttaaaaataagtgaaaaaaaactataaccaatatgcaattcatagatcttctatcatggctaatagttcaaattttgcaagctattggtttgaattattgcatttgctacatataaaaatggaaggtttctaaaagaaaatgaataatagaaaatattcagatgaaaaccaaagcaagctataaggcattcttagaagaactatatatatatacacgtatatatatatatacacatatatatatacgtgtatatatatatacgtatatatatgtgtatatatatacgtatatatgtgtgtatatatacgtatatatgtgtgtatatatacgtatatataagtatatatatgtgtgtatatatatgtgtgtgtgtatgtgtgtatatatatatatatatatatatatatttttttttttttttttttttttttttttttttttttttgagatggagtctcgctctttcgcccaggctggagtgcagtggcgctatctcggttcactgtaagctccacctcccgggttctcgccattctcctgcctcagcctcccaagtagctgggactacaggcacccgccaccacgcccggctaactttttgtatttttagtagagacagggtttcaccatgttagccaggatggtctcgatctcctgacctcgtgatccgcccacctcggcctcccaaagtgctgggattacaggcatgagacaccgcaccaggccaagaaccatattttttttaaaaagtttgccactgtaaacaagatatttaaaatgaccatgaacaatttttatgtatctgtaggcttctctctttaccagaattaaagtgtggggtcctggaagaagcagagggctagaagccacgacacttaggtttgtctcctcatcttggcactttctgagatgttaaattattcaacttcactgattcttcattttcttgataataaatagaggggattagatatagagatgcacaaaatccctcccaactctaaattttcatagttttataagactttgagtttaaaatcatttgatctacttatataacactcataatttttgtatctttatttccatatgcacagtttatgttatgacaagaaccaactcaaactagcttacgccaatacaggaattgattggcttgtcttccacacaaattcagtcagcatgcggatcctgctccagggactcaaatggcatcctcagtatttgttttttctatatatctcagctctgcctcatgctatgtttatttaattcttgaggtatatgtagtaattccctattgctccaagaatactcttcagcagcctgggcaacatggcgaaaccccatctctacaaaaaatatgaaaactagctgagcataatgacacacctgtcagcccagctccttgggaggctgaggtaggaggatcaattgagtcttgcaggttgaggctgcagtgagctgtgattgcactactgcacctctgcctgggtgacagagtgagaccctgtctcaaaaaatatatattttttcccattttcaaatttcagcaataaataaataagaagctgtttttcttttcttctctctactgtcctagcaaaagtctgcttctttctagtttgctttgatcaggctataggcctctctttgaaccagtgattgcagacatagaaataggatacacagatttaagtggcatgaatgacatgtcttctcctgggaccagagatgaggtaaatggaaagaatgttcttgaagcaacaggaaaatacaataaatattttgagtattaaaccaatatagtaaaaagcagagctgagagagagaaaccaaataaggacaataccatttgaatccctgaaaaaatacctgtatgaagactgaaatttcatgaagaacaaaccaataaatctctgtgatttgctttagtttgagttgttgttgttttttgtttttttgtcacaacataattagtaccaactgaattaaagataattttttaaattacagagtattatatcctatattaaaatcaataaaaaattttaagctcaaagaacttgatgatatctttgatacaaatgacatactttatacttaataggttcccaataaatatgtattgtttggtacaatgtaatgaatatagaattaaaagaaatatgtatgtaccaaatgagtatgtaccaactaagaagaagggaaaaagggtacattcatttcctatctatataataatatggcaaaaagaatggaaaaatatatacataaatgatgcaagaaggaggcaaaaaaggtgataaatttcaaagtggaaacactcaagatatatatgttgtccttcaccaagaaaattacaaaagaccttgatattgaaggcttcttctttgtcttcttgatgcctcccatttcttctcagcgaatttcattggtacatacccatcctaatatgataagagcattttaagaaatacctgtaaataatattttcccctattctgttagaatataagctccataactttagaaatctttgttttgtttactaatatataccttatactactaagtaaatccctagaataaataaacaagacatagtaaaataattgtaggatgaattacaaacaggtgataaaatgaagaagcctgaggagagggccaagcaggatatgaactgttctgaattctttcttctacctttttttctcaccttaaaaactctggtccttatcacctgtattgattcatatatatatatatatatacacacacacacacatacacacacacacacacataccacttaagtcagatttcaggattcagaacatatggaagatggtgattatcttctagactctatattctaatgaaagataatattttcttttgggaggcatttcatatattccataatttattgaggaaaaaaatgatattgaggtcaattatactatagagtttgtaggataacttacttaattgtgttgaagattttagatttgctgagcttggaagaagaaaggaagagagattgtgtcaaacaccaaatgagaagctgttttgagggtaaaagatcctagaaataaaaaatatatggtagaattaaagtaaaaatatataaaatctaaaagaagattcctacccttgcattttgacttcttccctggtagacaaggctagaaggaaacaggatttacatggcaggagagtataaaagatgactcaagtatttccgtgaagaaaataaaaagatcatgtccactgtgtcataaaatcacatcacccttctgatcaaaagcaatcaagaacttcccttaggttttagaataaaatccaaatgtttcccctgcctatgtcctttattattacccatttgccctcatgattttctagtcacaccagccttcttgcagacctcaaagtcgccatgcttgttttcatcccaccggatttttgcatgggttgttcctctttcctggaatgttctgccaccctcagcccccaacattcccgtaactagtccttctcctcagttaggtcaaagaacgaatgatgtcacttcctcagagtgacatcttctctgacactatctacagtagccaattcaccagttactttctatcagctagactgctttattttcttcacctcagcagaagattttttgttcatttattgtttgactttactaactttattttctaaaattaaagccccataagagcagagaccggccgggcgcggtggctcacgcctgtaatcccagcactttgggaggttgaggcaggtggatcacgaggtcaggagatcgagaccatcctggctaacgtggtgaaacccgtctctactaaaaaatacaaaaaaaaattagccgggcgtggtggcgggcgcctgtaatcccagctactgaggaggctgaggcaggagaatggcgtgaacctgggaggtggagcttgcagtgagccaagattgccccagcctgggccacagagcaagactccatctcaaaaaaaaaaaaaaaaagagcagggaccaaatgcctattttaatacccccaaatacctagaagaatacttgacatacagcagtgaatcaattattattgaaatctcctgtgtgtgtatgtgtgcacgtgtgtgtatccatgaatcaatgaatcaatgaatcaatgaatccattaatcatccaaaattaggagaacttggggcaagcctgagacacttagggcagagggggaatgaaggttagagctgcttctgaaataggcagagtaagcagtggtataaaaattttttttgaaacatactgaattgaagcagaactgagtatcaagactttcaacaaatggcctaggtccttttaatgagtttgttggcctggacagttgtcccataaagctctctccaaaattaggtaatcaaagaaaactattaattcctgagaaattgccttgtattgcctttatttcaaatattttaccatgtcataatcatatttatgcaaatgtggcttaaacaaacttttggaacaatcccaattatttgttaagagtcacttgctattaacatgaacaaaagaaaatttaaagaggtgatattaattatatcatattaaaatattatggtcagttttctagtagcccaagagtccttggagacatttaaatagacaattttgatatctcaaagctctttgacatattaataatattgaatgttgcctcactccttaatgaggagtccaataatcttctaaatcataaataacaagtggattcaataaaataacaagacagtaactgctgatattgaaaagtaatgagaagaccaataaaggagaatgcagtaagactacaagggagagagggggaaaatgagaagaaaataactcagtgcagctgggatttcacagtattcctaatacttgtgatctagtcccacaaacaagatagaaaagacacagagaaggcaaaatgctacagatctgctttctccacacttgttttaatattttgggaaatttctgaaaatagaacaaagaggatagcaatgaaactgcagagaacaaaaggacaaagctgatgagtattaggcccagagaaatttggaaaagggaaattagacacaggagtcttaaagcttaataaagtatccctcaaaaataaagaataagaggtgtgtaactgggagtatgcatgtatatgtgtgtatttgggtatatgttgaatgaaggttcatcaatggtggctctagaaatagatcatgggaaggacttgggtgcagactgaattctaatataattttatttacagatacttaaatttgaattttacattatttttatatgtcacgtcttttaatttttttctttttttattattattatactttaagttttagggtaaatgtgcacaatatgcaggttagttacatatgtatacatgtgccatgctggtgtgctgcacccattaactcgtcatttagcattaggtatatctcctaatgctatccctcccccgtccccccaccccacaacagtccccagagtgtgatgttccccttcctgtgtccacgtgttctcatcgttcaattcccacctatgagtgagaatatgcggtgtttggttttttgttcttgcgatagtttactgagaatgattcccaatttcatccatgtccctacaaaggacatgaactcatcattttttatggctgcatagtattccatggtgtatatgtgccacattttcttaatccagtctatcgttgttggacatttgggttggttccaagtctttgctattgtgagtagtgccgcaataaacatacatgtgcatgtgtctttatagcagcatgatttatagtcctttgggtatgtacccagtaatgggatggctgggtcaaatggtatttctagttccagatccctgaggaattgccacactgacttccacaatggttgaactagtttgcagtcccaccaacagcgtaaaagtgttcctatttctccacatcctctccagccaagatggccgaataggaacagctccggtctacagctcccagagtgatcgatgcagaagacgggtgatttctgcatttccatctgaggtaccaggttcatctcactagggagtgccagacagtggacgcaggacagtgggtgcagtgcaccgtgcatgagctgaagcagggcaaggcattgcctcactcaggaagcgcaaggggtcagggagttccctttcctagtcaaagaaaggggtgacagacggcacctggaaaatcgggtcactcccaccctaatactgcgcttttctgatgggcttaaaaaacggcgcaccaggagattatatcccacacatggcttgcagggtcctacgcccatggagtctcactcattgctggcacagcagactgagatcaaactgcgaggcagcagcgaggctgggggaggggcacccaccattgcccaggcttgcttaggtaaacaaagcatccgggaagctcgaactaggtggagcccaccacagctcaaggaggcctgcctgcctctgtaggctccacctctgggggcagggcacagacaaacaaagagacagcagtaacctctgcagacttaaatgtccctctctgacagctctgaagagagcagtggttatcccagcacgcagctggagatctgagaatgggcagactgcctcctcaagtgggtccctgacccctgacccctgagaagcctaagagggaggcatcccccagtagaggcagactgacacctcacacggctgggtactcctctgagacaaaacttccagaggaacgatcagacagcagcattcgcggttcacaaaaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcgccatcatcaaagaccaaaagtagataaaaccacaaagacagggaaaaataaaaggaagaaaaactggaaactctaaaaagcagagcgcctctcctcctccaaaggaatgcagttcctcaccagcaatggaacaaagctggacagagaatgactttgacgagttgagagaagaaggcttcagatgatcaaactactccgagctacaggaggaaattcaaaccaaaggcaaagaagttgaaaactttgaaaaaaatttagatgaatgtataaccacaagaaccaataaagagaagtgcttaaaggagctgatggagctgaaagccaaggcttgagaactacgtgaagaatgcagaagcctcagagccgatgtgatcaactggaagaaagggtatcagcaatggaagatgaaatgaatgaaatgaagcaagaagggaagtttagagaaaaaagaacaaaaagaaacgaacaaagcctccaagaaatatgggactatgtgaaaagaccaaatctacatctgattggtgtacctgaaagtgacggggagaatggaaccaagttggaaaacactctgcaggatattatccagaagaacttccccaatctagcaaggcaggccaacattcagattcaggaaatacagaggacaccacaaagacactcctcgagaagagcaactccaagacacataattgtcagattcaccaaagttgaaatgaaggaaaaaatgttaagggcagccagagagaaaggtcgggttacccacaaagagaagaccatcagactaacagcagatctcttggcagaaactctacaagccagaagagagtgggggccaatattcaacattcttaaagaaaaggattttcaacccagaatttcatatccagccaaactaagcttcataagtgaaggagaaataaaatactttacagacaagcaaatgctgagagattttgtcaccaccaggcctgccctaaaagagctcctgaaggaagcactaaacgtggaaagcaacaaccggtaccagccactgcaaaagcatgccaaattttaaacaccatcgaggctaggaagaaactgcatcaactaacgagcaaaataaccagctaacatcacaatgataggatcaaattcacacataacactattaactttaaatgtaaatggactagatgctccaattaaaagacacagactggcaaactggataaagtcaagacccatcaatgtgctgtattcaggaaacccatctcacacgcagagacacacataggctcaaaataaaaggatggaggaagatctatcaagcaaatggaaaacaaaaaaaggcaggggttgcaatcctagtctctgataaaacagacttgaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaacgagacttagactcccacacaataataatgagagactttaacaccccactgtcaacattagacagatcaacgagacagaaagttaacaaggatacccaggaattgaactcagttctgcaccaagcggacctaatagacatctacagaactcttcaccccaaatcaacagaatatacattcttttcagcaccacaccacacctattccaaaattgaccacatagttggaagtaaagctttcctcagcaaatataaaagaacataaattataacaaactgtctctcagaccacagtgcaatcaaactagaactcaggattaagaaactcactcaaaaccactcaactacatggaaactgaacaacctgctcctgaatgactactgggtacataacaaaatgaagacagaaataaagatgttctttgaaaccaacgagaacaaagacacaacataccagaatctctgggacacattcaaagcagtgtgtagagggaaatttatagcactaaatgcccacaagagaaagcaggaaacatccaaaattgacaccctaacaccacaattaaaagaactaggaaagcaagagcaaacacattcaaaagctagcagaaggcaagaaataactaaaatcagagcagaactgaaggaaatagagacacaaagtacccttcaaaaaattaatgaatccaggagctggttttttgagaggatcaacaaaattgatagaccgctagcaagactaataaagaagaaaagagagaagaatcaaatagacacaataaaaaatgataaaggggatatcaccaccaatcccacagaaatacaaactaccatcagagaatactacaaacacctctatgcaaataaactagaaaatctagaagaaatggataaattcctcgacacatacaccctcccaagacgaaaccaagaagaagttgaatctctgaatacaccaataacaggctctgaaattgtggcaataatcaataacttaccaaccaaaaagagtccaggaccagacggattcacagccgaattctaccagaggtacaaggaggaactggtatcattccttctgaaactattccaatcaatagaaaaagagggaatcctccctaactcattttaatttttttctaacttttaaaaatatgtaaaaataattcatagattgcaggatatacgaaaacaggtagattaggtgctcgcaggccataatttgcctctgccatcaaacaatagcataccataatctacatctgtgaattccaagggatcacaaacagaaaagcacaatggcagctgagaacaatagtggaagaatacatttttattactgttattacttattccacttatacaaatggaaaatgccatttttaaatttggtatttcctcttgtgcctcctcagaaattatactaaatttctttcagaattcatttattattaatgtgcccagattgtttcagtataagatttcttcattaaggtgatttcattttgaacagaggcaaagaaatacatttggctatttactaactataaaatatacaactgctgaaagctcgatggcacctaaaggaattgaccactttgttatcccaaaatgttctgacacttcaatgtcattgaaataatgccagagatatttcaagggatttcttttccttttcaaagatgcacattaaatagattgctatgtaaagctgatacatcatttagtcctccccaaaagggaaatgcaggtacaggcatgtttgcctcctgactcccagacaccatggctgggaaataaaacaagcaaggctgggaatctttggagtcaggcaaatctgggctctgctcaataggaagtatttgtttctttgggcaacatggagccttagttttctctccactgaaacttggaccttagctccctcacttctaaaatggaaatagaaatttctacttcccagggaaaatgagaggtttaaacttaaatgaaatgagaaagtatatgtaatattcacattgctagcacaatgtgtagaatctattattatcctcgaataccctctgtgatacacatagaaatagacacagcttctcccagcagcctagtagttggttgaaaattgttctatattcacaataaaagtcattcccagaagttgttgcaaggaaagaagtgatcctgttacaggtttgttgagacaggaagatacaagaagacaaaaataaaaatatttctttaatattgttattgggccatctgaccttagaagctagattcctgcttaaaaattcatgactaatttttagcatgaaacagcagaagtttccaattctcaagagacccactgcattgaaaatcctggggtctttttgtatggtccaaaactaatggagacaacttagcccatctaaaaattgggtgaaagagacgtaaggggggggggcaataaaaatgtatttttctaactagttttcaggtatccatattccaaaatagaacagcatctttgccagaagttcaagtcattaaggagttggtatggcattctcacttacataaagtatgggcacctctgaacaatgacctgaggattactaacaggtatgcaacatatttgaaatgtcaggtacagcaaagcaaatgactttatcaaaatataaatcacacttttagcagaaaaaccaatagttatatgaatttaacttcatctttaagtgcaaagagtaatattttgtgaattttctaaccgttttttagatgtcatcagtgtttcagaaactggtttctttcattttaaaataaagagatgctatttacttcatcattttccagccttcctgataggcgtatactcacatgaggagatacaaaactgaaaacattatctcattatagactatccacgatttaaaccttcaagctggcaatatgtatttaaataatatgtcataaacacctcttggtacataataatgtagtaaatatgagaatgcctttaaagtgaactaacttattctcccaactgttagattattccctgctatgatcccatcaccaagtgaaattttaggcatattcctctaggcaaagtaaatagttatgaggaaaaaaatattgctaattccagttgaaataagaaagcctcttaatcatctaaaatatttctggggcagatgcagtggctcatgcctgtaatcccaacactttgggaggcccaggcaggaggatcatttgaggtcaggagttcaagatcagcctgggcaataaagtgaaactctgtctctattaaaaaaaaaaattaaagaattatccaagcatggtggtgtgcgcctgtagtcccagctactcaggaggctgaggcaagaggatcacatgatcccaggaggttgaggcggcagtgagctctaatcatgccacagagtgagatactgtctctgaagaaagaaagaaatacataaataaaataaaataaaatgttctctatgggccagatttctctctgcttaggtcaattaaactacaaatttctcagtaatttttgaacgctctatctcccaagatgcctaggtggaattgttaggaagcaactgcccatccacaaaatatacctggagaatctcagatttcattcactgcttttaaaaaaggaaacaagaaaatcttcctcttagaagaaatttaatcttttaccacttttattacttttattatagaaatatatatgtatatatacatatgtgtatttatgtgtgtatatatatcagatatatctatatatatatagatatatagatatctatcagaaagcaaaacttaccttccttagacaaatggagatttggggaaattgtattggagtctagaagaataaatcctaggaaaagcaaacacacggtatacacacgcacacatacaaacctccaataaactttgggaaaaaaatttatatacacaaacactgatacacaaaatatatggattatatatgtatgtatatgtgtgtatatatattaaaatataggtttattcaccaatcactgaaaaactacatcataaactacaccaaaggagtagttttaggacaaatggcaaaaaatagtaccttacagagttgacagtttggaattgcaatacttcagatgatcacaagctttaaaaatgctcaatgtgctcgtctatgaatttcaaaatgggtataaattaaaacttattacactttttttaagttgcattcccagtacatgaaaaaacattgtcctaagactacctctttgaagcaattttcaaggattcgtgaatgagtatcgtgagcaataaactaaagctgcataagagagatatagtgtataaactgtgctagcatattatctttggttccaatcgcctcataagcattgctacactgactcaggccaatggtggtctcaaaacaatgttttcatctccctgaaccatttattcttttagaacataactcattgttgggtttcaggtgactattctgactgccattccaaggaaacaggccttctgaacaagaaaaaaatctgaaaacggaatatttcctttcagagatgtatggaaacaagctctgcctttttacccatgccataatgggtcttgctgagagtttgcttcaagaaccagaactcagtaaatgtaaacattcccttaaacagatgcacatatgttcttaatataaaatcttccagatgtaagtttcatgcaagaaagcaaagtgacctagcaagaattgagctttccatatctggtgaagcatttttcttagtgtgtgccacaagcagttattctgagaaatcatgcatctgctcctcttcacatggacattccacttctgatgagactacattcttggaaaatgtaggcaggagctgaattcaatcttacaatgtgtgtgcgcttattccttccatctatcacttacccaaaatacctgcaggtggtatcagaaatgagctttaaagggcctgtggcactgattacaaaaaaatgttaagtggtatttcatatggttgtggagtgggcagactcctgcttaagattcataatcctcatcagtaacacaagtgtatcacactcacaagataatattgaagtaatagaagaaatcgtccagaaatgcaaaaaatagttcacgtaagatgcaaaatcttatgacaaaatgaaatcctgaactaataaatagctctgtactgatatcaggccctaaagcctatattactgagagataaaacgtgggggacagcaacttagagatagggctattacattaaatctatgattacattagctaaaaagaaaaagcacaagagatgaaacaaaacatccaagaaactcatcaagatttatgcttcaagcaatgtcctaatatctgagaatatcaagatatgaggacactaacaaaagtattattattctaccggatcatttaaaaaattccttttgttctgaaatcaaataaaaagtaacaagactggcctgagtagcagaatatacatttcatactttatatttgtgtatgtctatatatatgtacctttacacatacacacagatacacataaacaatcacatctgtatttcatatctgtatttcaaccttctccattcactggaacagacatttaggttgattccatatcttgtatattgtggctaaggttgcaatgaatgtaggagtgcagatatattttcaaggtgctgatttcatttcctctggatatatacccagaaaagggattgttggatcatatggtagttctatttttaattttttgaggaagctccatacattttttcataactgtaccaatttccattatcagcaacattgtaccagggttcccttttcttcacactctcgccaacacttgttatctcttggtgtttttctttttttctttttttttaaataacagccatcttaataggtgtgaggtgatatctcattttggtttgatttgcatttctctcattagtgacattgagcaccttttcatatacccgttggctatttttatgtcttgtttagaaaaatgtctattcaagtactttggtcattttttttataaatacatacacatatgcacatgtgcacatatacatgggtatgcacatacatatgcatattttaataactatgagtactcaatgatatttaccttttttttttttgagatggagttttgctcttgttgcccaggctggagtgcaaagtcatgatctcagctcacaacctttgcctcctaggttcaagcgattctcctgcctcagccccccgagtagctgggattacaggcttgtgccaccaccctggctaattttgtatttttagtagagatggggtttctccatgttggtcaggctggtctcgaactcccgacctcaggtgatctgcctgccttggcctcccaaagtgctgggattacaggtgtgagccaccacagctggcccactttggtcattttttttaaatcaagttacttggtttttttttgttttgttttttgctattgtgtgagtttcttatttattttagagattattaactccttgtcagatagtttgcaaacattttttccaacctatagtttgtctttttattctgatgattgttttgttatacaaaagctttttatagtcccacttgtttaattttgctttcagtgcctgtgcttttggtgtgatgttcaaaatatcattatgaaggacaatatcaagaagtttttcccttgttttcttccagtagttttagagtttcaactcttatggttaggtatttaattcattttgacttaatttttatatatggtgtagataagggtccagtttcactctttgcctgtggatatccagttttcgcaacaccagttattgaagatactaccctctctccatcgtgtcttcttggtagccttgctgaaaattggttgactttataaacttgggtttatttctgggctttttattctgttccattggtccatgcatctgtttttatgccagtaacatagtgtttggttactattactttgtagtataacttgacattagggaatgtcatacctccaactttatttttctttctcaagattgttttggctattcatggtctttgtaattccacattaattttagaatttttccatttttgtgaaaaatgctatttaagtatgtccatcattctaaattaattataagagtgaagttatgccctaaattgttcattttgtaagatgtgccttgcagttttgcaccttgcaaaatgagcattaaaaattaggaacagtattttgctaatttgttcctgtgatctagaatacataattttattctatagcaggagctgtatattctcacatcggaagaaagtaatataatctgcttatatagcacatggtgtagccaataaatagcattttacatttcgtcccttttttcctttctctctcatactttcctactatttttaacagctttattgagttaaaattgacataaaataaacatcccacatttcaagtgagtgtacaatttgataaatttttggtaggaggttattgattgaattttttatattaataaccagttgttccagcaccatttgttgaaatgattatcctttgcccactgaattgcctttgaactttggttgagtatcagttgtctacatccatgtagatctttatggactctagtcatttctattgatctatttttctgagtttcctttaacactacactatcttgataaccatagttttataatgagttttgaaatcaggcagtcttagtccccaaattttgccttttatcaaagttgttttgactattctaggtcctttgcatataagtttcagaaacagtttttcaattactagccaaatgaatgttgggattttgatctggactccattaaatctacagatcaattgaggagaagagaagaccactttaacactgttacagtttcaacactgtacagtttaacatcataatctgcatttatttaggtcttccttaatttctcttggcactgttttatacattttgtgtacaagtcttgttaattttttatagacatatttcatattattgatattattgtaaaaggttttactatttcaactaatttcaattactcttaatgatacatgtaaatactactgatgtttgtatacggatcttatatcctgaaaccttgcaaagctaagttttgagttctagtaagtagtagaggttgaataaccctatccaatacacttggaatcagaagtgtttctgattttgttttttaattttggaatgtttgcatatacataatgagatatcttggagatgggacccacgtctaaatacaaaattcatttatgttttatatgcaccttatacccatagactgaaggcaacattatataatattttaataattttgttaatgaaaaaattgtatattttaaatcatcagaaggcaagtgtcaacatctcggccacccatatgagccatctgtggttgtttggcatcacaatcattcttgattttgaacttataagctactgataagcaacaattttcttaacttatttacccataagtacttatctgtaaaaaatatggcatgccatttacacagtaaaaaaaaaacaaatgtgtccagggtaactaagcagcacagcagcatcaccagaattcccgtaacagctgttgaacatcagcaacaaccaacaatggcaggctttcagtctccacctatgatgctgtgttttgattaataggttactgtgtgctgatttttttttaggtgagagaaaaaaaaaatcaaaacagttgaaggaccaggaagtgagtcctctagggatgaagaggcattttgtggatggcttttaaaaatgtttccttcagagtcatcttgcctcattaacaatggtttttgtcttagaagtctccctttgggattacaggcatgagcatgggtggatcacctgaggtcaggagttcgagactagcctgaccaacatggtgaaaccccatctctactaaaaatacaaaaaattagccgggcatggtggtgggtgcctgtaatcccagctactcaggaggctgaggcaggagaatcacttgaacttggaaggtggtggttgcagtgagccgagatcatgccaccggcactctagcctgggcaacaagagtgaaactccacctcaaaaaaaaaaaaaaaaaaaagaataagtagtagtagtagtagtagtagtagtagtagccatcgtcgtcgtcgttgtcgtcgtctctctttggctttataaactgacatgatttcttgtgctgttataaatgtacagtgctgtagtccttcaataagcccgtcacacatttttaccttatccataggaactttttcttcagtgttaacaatgtcattttaatcatcactattatcacaatcaacttgattcaaaaccatctggactatttccccattggtcaatgaagaattggaatctcattattgatgttaaaaataatcaagttctttgatatttacttctgctagcctagggaaagactctgaaattatattttttgtgtatgtaaggaggtcagacaccatctttttttctcagttggcccacagaattcttcaaagtcactaccttgttcatcaagatcacttaatatagtcacaggcaagaggttgtgccaggagtgtactactgtgtctttagtcactgcgttccaagtgttagcaatggcataaacagcacccttcatgctaaactccttctagaaaccttccacacccacacctctcttcactggtgctggcatgatgttcaagaaagtgtttttatatttactcttcatcaatctaaggataccttggtcacatgactgaattaatgaagtcacatttggggaaaagtatatggcataagcattatttttgatgaaaatttcagctgaaggatgagcagaaatgttgtcaaggaataacaaaaatctaacagttgtcatccaatccagcttccttgcagtaaccttgagcctctggtataaatgtttgtgaaaccaatcagaaaatatgtccgtggtgatccatacctttttgttaacataatagtggactgctgagaaattcactccttgaaaacagtgaggatgcaagcttttgcttttcagaacaagtttatacttttgtatgcctgctgcattagcacatgccagcacagttattgtccttggaatccttaatttttgtaggggctacctcattagcttttgtcagtgtctttctggggcaacagtaccaaaacagtgatgtttcattagcattatagactagttctggcatcagattttcatcagcaatgactctggcaaatttgtcaatgaatttttccactactacatgaccagaagatgctttatcactacaaatctttaaaaatgtaatatcatagtttttcttaattttctgcagccagcctgttgagtactcatggttcccttcaatattcatttcctcattatagatctttgcttgtctcccgattcgtattccattaagtgacaagtgttcactgcaatggtaatggatccactatttaaatacacaatcaatatttttattgttagctgtatacggtgtttttctatttttcattgacttctattcatcactttcagtataaaacttcaacagtttatccttctgtttcttcaggtcatatatggtagtcaacactatactcttccatagaacatttcaacttccgccactgtccagtttcttcttcttcaacagtttgactttctgtgctgtagagaaacataaatgcttctttttcttatcactgttacccaatactgatatcacagagggaactgcaggagtttttaatatttttaataatctttacaccatagagcagataataagaaaataaaaacacagtaatgcatgtaggtcttggccccatgtgacacattattggaaacctgccattggtgtgtttggcctgcatacatgccattttattaccctttatgagtgtgcctgcatagtgggggtggaggaatctgggtacttaagaaagatatatttcatagctgaaggggtctgggagggtcttcttccccttagggatgctgaataaactgtgtgctcagagcctgttttttgactacaccagtcacatgaagtcatgtatagaattttccacttgtggtattatgtaggtgttccaaaaagcatcttggattttcacattagcaatgctcaacctgtactagtagattccatcatattttctacataaatgatctcatgtcatctgtaaagctttacttcttcctttccaatctggatgtcatttgttcattcattcattcattcatttattgctttccttagtgcactggctatagcatctggtataatgctgaacagaagtggtaagagtgaatatccttgtcttattcttgatcttaaagtatccagtctttctgctctaatgatgtttgcattttatagacccctcttatcaagttgaagaagtttctttccattcccagtttttactttagttgaatttggtcatatttttgtctgttgggataatcatatggttttcttttttaatttgttactatggtaaccttacattgatttgttttaatgttaactaacctagtattcttaggataaatcgtatttcattaggatatgttaagcttttagatacattgaattagatttgcccacatcttaaaaataaatttttgtatctatattcatatcgatccatatatttactaattttttataatgtctttggttttagcatcaggatagtgttagcctcagagaacgagttgggaagtagtttctctgctcaattttttgaaaaataattgtatatacttggtaataggtactatttcttacttaaatgtttggtagaattcatcagtgaagccatctgggcttcaaattttctttgtgggaagatataaatgttagctggattaaattgataatgatgccgtttaagtcatctacatccttaactaatattttggtttgaatgttctatcaattattgagattgaggtgttgacatctctaaatataattgtgtgtttgtttaatactccatctttttttggaagcataatatcccttccttaacaaattatcttcttttattctatttgcacttttactttttattatgttcttttttgatccttttaagaatactggttgtactaaatgctacccatggttacactgatttttgtcttaggctttattcatttctagcccaactatatcttcctacctcttgtttgaaacagaaatattcatttttctccataaagcaggcatcccttctaatcctaagcaacacaattctcctagacacaagtattttcaagccagtcatctttgacatcactttatagaaaatacatcttctcagttaaatctttactcaagtagtgtattatcctccctctgctatcagtccctgactgtacttcatgttatgacattttaaattattgtggtaaacctcttcagcctctagaacagtatttcatacatcatcagtgtgcagtagaaacaagaacatccccaggtttactactgcctacaaaaaacaatggaaattcttcagtctatccaaataaaccagttgtcctcccttggcatcactctgtctccttccatccttcatccattcattcttccttttcttctttccttccattcaacaaatatttatactcgctcttaaatgcagctttcattcaattaatctactcattgttgtcaaaagatagcttatctttttttttttttaattggaccatatggccccactactcttcctatgcaagtcttgcaaggcccacttttagcccatcttctgaatgaacattttctgtctccaaagacagcaatttctctcatttctgagcatattattgactgtgtacataaacacaccaaacagcagtggattaaaaaaacacacagaagccattactgcctcaatcagttaaataagaatggttaaaaataatctgttgtttaaactgatggaaacaggaaggagaatgtcagcttgctttttaggctattgtcttcctgataacactggtagaaagataatcctttaccctaaaaattaatactgaattatgaggaataaatgcatacatagttcttcctgccatgcagtccatatgaaaagggggagggggtcacaacagcttaaataaaagagaagtttcagtttgtctgtaaatgtctacaccataaggaaaaaaatatttgaagccacagtaatgagagagtgtttcggtagaataaagtgtgaaatttgtaggaaggagaaccaagactgaaaatacaaaaacattattaggaaagagacattgcaaaacactataatgtgtacagttaacagaattagcagagaatataagagacacacaagaagattatgaaagatatcaatactagaaagacagaagagaatgtttaaaatagtaagaatactaatgtgtccaatttaagcatttaatgatgtttaaataaaaaataagccaccctttaaaaattccttctttattttagagttccaagataaaaatattgggaaggtatttttcaatcagtaaaacaaacttcagttagaaaaatttactattagataatcttattaatatctataaaagctgcattcatattgatttagcctacacccactttgtgcacaatgtatagagaaagaacagcttataaaattaatatctaggcaacgatggccacagtgcattttaggtatggccacttttacagtcttttgtaataattacattttaattttttttttgtcttagcaactggatcgtaaaatctttgagggcagggctccctcttacactctgtgtatcatatatagtatctagcaaggtagaaattaaataagatttcctgaattattccctggctgctcatcttaattgtaggaatccataaatgtctttcctattgattctaacatgttgggagtgccaagtatccttaagattacatccttggactagagatttaatagaaacacttcatttaatattaatagaaaagaaactaactcagagtaccaatttcttgggtggaaatacatggataataagtgacaaggtggtagaaaagcaagctacctatttcaaaaccatatttcatgtgtcagctggtgttaactaaccaggcaactactatggatgtaaacaataactacagacaacactttccaagtcttcatatcgtatctccttagaaaaaagctattatcaagcagttttgaaatccacttaaaccttttcaaaatgtattatagatttacttaggacaaagtgttctggtgcattcagtcataattggtaggaaatatcaatcaattgtttcatttgtcataatgttaaagtcactcaatctagggtcttagctgatttctcttttctgaagaactataaaacgtacaaataaactttatagaaatgggaaaatcccaagcatgtattaaaaataattcttgccactaactataaaacacatcaactctggcaagagcctttcctggggagcatagtgtacaaggtctagatgtgactatcatacagagcttttttggcttgccaatgctgccaaaaaaaaaaaaacaccactgactggatgtagcttaaacaacataaatttattttctcctagttctagcggctaaaagtccaaaatcaaggtgttggcaggtctagtttcttctgagacctcttgtctttgcttgcgggtggcggccttcttgctctgtcttcgcatggcctttcctctgaactaacacacattcctggaatttctgtgtgcccaaatattctcttcttacaaggacactagtcatgttaggtaaagtcccatcctagaagtctcattttgtctcaattaccccttgtaggaccctatctccaaatgcactctcattccaaggaaggtgctaggagttagggcttcaacatatgaatgaggaggaggaaggaagagatacaattcagcccataacaagaggccagagagctgtcatgaaatttcaggaaagatatagctctctcaaataatatttttactgagtatcactgaatttagagccaaaagagacctcaaagttgatcatgtctcaccacctaggcaatgctgaaatccctcgtaaggttgtaaggtttcactgactagtctcagcctctgcttccttatccagggaattcaccactaccatggaaatagatgccatttatagagagttaatcattgtgtggtgggataataattttgaaatatcaaccgttttttcttttccatttttctatcttgtattttctcttttcatcaactccagtgagcttttattctatacttatcacctcaccaagtgatatacactagaagcttttagtgtgaaaacgtctaggccccgtaaagaccaggaaggatctggcatttgcactctccaaggcctgaattcctctagaccaaattcataaacacagcagcagaaccttatacacaaccttatataaacttgagaaaacctaaaatatagggaaataagatttcagggtagaatggcttgctctgtgtctgtttcagggctctgtgtctccttagatggacctaaaacagtccacggaatttcctgtgcttggatgtggcacaggaaaatgaatcccatcttccaaaaggggccttgacatagctgagataggacttgtagataggaacaagtattgattcagtagcaacttgcatgggtgaatgactagaaaggataatgagtctcagcaaatgtcagatgaaatggaagcataaaggtcgtcatcccttggcaatatggaaagccccataaattagagagctgccaaatggctaaggtttagtttttgccattctgtctcaaaacagaaattatttcgagaaaaaacctctattttttgaatacttgggtttatgactaccattaaacaaaaatatttattccttattacttcttcactcacttatattgattacaaaagtatgaattatattaaaagttggtgttgtttattacaaacaagaattgaaatgagatcaactagtatatttgttcttatacgtaggtgacacacggtcatttcaatgcccactctttaagaccccttgggcttgtaaaacatgaagtacatattaagaggtgtgaatatgtacaataccaacaaacatggctgattatgagcctcccaaacattctttaaccaaatcagaaccctaatgtgtaaatttcgctgttgtagtaagaaatatacaattatgatatttgaaatgctattagaaattaagaaagaaactaataacactatacgttgcttttgaccctaataaaatactcataaaaataaattggatgtgtcaatgtgtccatcctttgagatcaaggccaattgtagcgacatagaatgttgaaactgaaagggttcttagaagccatctggcaaacactctcataaacagatgtgagaattgagatccagaaacatgaaaagatgtgtttagggcaacagcagtcactggcaaatccagtgtggaagatggtgtcttcacacattccacttctttttctgcaggcatctcaaggtcacagcagaatcatttcttcaaggtttccttactcttctataagggcaatcacatggttgatgcttatttaaaatatttaaaactatttataatcatgaatgaaatttaaaagagtcaagacactagctaacccaaaagttgggcttttcccttttgagaaaatatttttctaactgatagaacatttggtttctcaacttttatctatcattaatgatatgctccactgctagaatgatggaatggcctagattgtttagagtacacgaaattatctttaatgaagataatttcattatctttgtgataatgaagaattagcctatctttgtgataatgaagaaataaagatttcttcacaatgataagcttagttgaatttagaaaaattaatatgtggctcctaaagcattcataattatatataaatctctttaataatttttttcctaaagttatctctgtgataatatatattctagacatatattcaaatatatttaagatatattaaaagtagtaattttaaatacagtttgaggaaagaattaaactctgagatatttataattcaacattgaaacaaatcttaaaactttgtcatgcgcttgttacaattacagttttgtaattctgtttgcatcaggtatgttgcaaataataccacctctttattcatttagcactttctatctataaaacatcttttaaatatactactaatttcatccatgccttgctgtagaatctttaaaaatgtgttagcagtttatgcagttttttcttctagttatagatcaaaagattcagagttagccacctgaggtaggcagtgtggaaacctactctcaaatacatttttggtgagtgaacataatcctattttctaccaattgacacaaatctcaaactgatttgttagaacatgtattctgcaatagtcaagcaatacaggacctggaatacacaattagtctcttcaagaaactttttcagcctttcaccgtgaacaagaaacaaaaaaaaaaaaaaaaaagtaagaaacttcagcaagataaagaacataaactcatcatgacctttagcttcagaaatttcagaaattttaattgaaacattaaaaaacagctatatatcatgaaatatatgaatttaagtacttgaactctctaataatgtatcttcctaggtgtccctcattcatatgtcccattattcagtctgcttttgtcttccttgtgcttctctgtgttgcttctttacccattcaacaacataagttaggataacttggtgggcttttcttttttctttttttgttttcttgagacagagtctcactctgtcatccaggctggagtgcaatggcgtgatcttggctcactgcaaacttcacctcccgggttcaagtgattctcctgtctcagcctcctgagtagctgggattataggcgtgtgccaccacacttggctaattttttgtaaattttagtagagacagggtttcaccatgtctggtctcgaaatcctggtctcaccaggatggtctcgaactcctgaccttggtgatctgctcgtctcggcctctcaaagtgctgggattacagaagtgagccactatacccaaaccttactttcaaaagttcttacctttcttgtgtttttactatttagaatatttggctgaagtttttactctttctttttgccttccccaagcctaggccccagccatcttttctgactgctcccatttttgctaggcaaaacctagcaagaacctcctttacaccaaaaacaaattttcctaatgctctcttgtcaaggtccaacagtggtagagctgaaacagagccaatggagttgtttatatcatccagcttcgtatttattagccacatatgtgctgcaaatcttagaaagggaaggatggtgctaagttctctgcagatgctcaaatgctaaataataaacatgtgatacaagctgagattcacaataaagacagggaatatccaaaaatatgtacttcaaaattatatcagttatttcccctaggcagtttagaatacaggattttaaaattcttgatgagtaaagagggaggaattaaatgataggcaaacatgtagcctgcatattgagtaagaatttattgtcccaaagagctgttatcccaaatcagctggttctgatatttcgatattattcaagaaggtagttagtcaccattttaggaatggtttaactttagctgaaactgattagcagttttttctgaatataaaatatggagaagttattaataaatgtcaaatcagtctctctcttaatcgctctcactctctctccctctctctctctctctcacacacacagcaagagacatttgaatataccatcaactttcattggcttactaacgctatggcacagcagagtgtgtttctttcctttggagctctatagtagcataagaaaaccttgctgaaaattgagcaacactttttcatgctgaatgattttgttttacatttcctctgatacaaatagaaaagacgtctcacattcagctacctatgctagactacaccacaaataagctcatacctttataatgtgtctacatgacagtaacaactgtggtgagcatagaattattcatatgcctatacttatttcctatgtctttacttaacatctgggaaccactctcaaggtagtgtctctggtagttctgggaaagctgggtgcttctgtgttactagtatactaagaccttaagtaaggggtcctcttatgctctagggacttctctaacctctctctgaaaccctcaaggtaacagagctttagttccacacaggaggctcgagaaccacaaagctagcaggctgctatgatctgggtctctctaatgcctgtgcccgcccatatcttattctccttctcaacagacagaaatgagttccaaaatcttttcaaatcatttcttcctctggcaatattcaatagcagggccctcaccttggttcctgcaattgcctcacttcccatctctcctaatcactgtggcttcattccttttcagttttggttcccaaagtaactctaaccagggatctcttttatatgacagtatttagcagattggtattttaaatgttttagagtgtggttcctggcaggcctttttttgttgtttggtttttgtccacagtgtgagcaataaagatcttaattaaagaaattaatgaaaatgtcacctagagttggaagctcaattcacagtgttgggttgctggttccctactaatagattatatcctggcaacactgtcacagtacagcaataaaaactgttctggcatcttccaggtccaccacagagtctcattcttgctgttatgtctggactgaactcagagtaacccagaatcttcctcatacaagccttgtccacctatattctattctcgaatcatatctgaatcagcatttaaaactcaagtcactcctcccaataaaaccctccagtaatatcccatttaatttttggcttggcttataactttcatatatttacatatttcaacatatggaaggagacaccttcatttatactcttgccctggttcattcaaacattaagggtgaacatgcatcctgctgcctgttaaagagagtaatattaattttactaagcctaaaataatattttaaagtataaggacatactacagagaaaatcacatgatagaatataatgaagtaaaaatacccattctgaacagatctaccttgtaagagagtaattaagttaaaggcttgaggcactctccaaagaggagaccacacccaaaatgatcgaatcgtgatggtgtattgactgttattgataaataacattagcatattaactatatttacctcaaacttttcctaatggagctagtatattctgtaagtaaataactttccctcttctttggttcagcacacccaaagttcagtaatccagttgttgcatgatattcaattaaattgcacctttacgccaatgactacaattaaaatggaaatccattctctttctctctttctctagattacagacttgggctctttcatacattcaaaaacaagcaagccagatacacagttatcctcaacacttgtgtcttccttatccagaccttgcaaattcagttaggtactgtttctcaaaactcttatttagacccttcatcactgcttccataaaactccctttatttttccctgctttgttgcagtaatcccctatcttgtctactttctgtagattcatctttctaaaccattcaccatccacctctgcttttttgagcagtgcttcttaaagtatggttcccgtatcagcagcatcacatcactcaggagttgttagaaatgcaaactcttgggttccaccccagaactactgagtcagaagctctggaggtggggcccagccatctgtgtttcaacaagccctccaagtgattatcatgcattttaaaatttgaaaaccaaggttctaaagtcatatttttaaaaggcaaaaccaatcatgtcatttgcttgcttaaaacttctttaatgagtctcttctgaaggataaaagccaagttcttgggaagacgtgtaataccctttctgttctcatatttcagcccttctctttccacttcctccttcccacccagtgttttagtcatataaatgttttgaaatattgtgaagcaacctgctttttctgcctttttgccttttcctagtgcacctcttcccacacacaattcatccacctggaggggttccattcatctttccagatcaagctcaaatgtcccctttttcagaatgatttctgagggctaatttcaataacttacttacagcctattccacttcttccaggtccacctacataattttcccaaattaaatttttatacctccagctctttaaaaggaaagaaagtctgtttactgggcaaggaggcataggaaaaaatataaagggcactgcttatcccacctcacatcctcccacccctagttcacaagttaaagattgtcatccatctcttggaatagttatggctccttaaggatgttaatgccccctcctagatgttgtctcaattgtttattggtaagcccactcctagatatgcaggacccaaagcaatagtagaaagggaggcctacataccacatttaaatatttaaaagttatttaaaaactaagaaactttaataaaatatgttctatcattgtgctgccttaaatatataatttttaatgacaaatgaaaagtattatgtaaggcaatagtttttagataactaaaagctggcaaaatatcaaagatattcagtgcaatatttgatagcatacctgggcattctcttgatgagatagcaatgtttaggtaagtaataaaatgaaaccagcttaattcataaacacacatgtgttccataaaatttatatttctcctctttatttcatcaaaattatattgctatggtcaagatttttaatttcttgacagggatgagccaaaggatttaaaataaaatgaaattgtattgaagttagaaaattcaaatatatttcattaaaaattaaatataaaaacaaaaataaaattatttttttcataattcttaaatattcaaattatctattaagtcaaaaactgaaatgcatataaggaatatcacattttaatttcagaatatttcattaaagctgacattttctcatttaattttgtctcatttaacattgagcatccactatccatttgcttgccaatatgaagaattggtagcacacttcatacttattttctctaaccctacatatagacaaatgtaggagtactatgatttatttaataatccaaaatatacttatcgtgtacaaatgttatgctaatttgtctggactttcaaatctaccaatgaaacatgaacagatacaagaaaatggatgttcagctctacccaggaaaacaatcctcgattctgcaatgatttggtgcgttcattccacaaggaagaatttgaaaataatttatgtatattttctctatagtgctcaaatcctagcccaccccacccacctgctgcaaaataagatgttcatctctcatattgacagcagttcaaactgcaaatgttcatggcatttgagctttgttatctttttgctactaggatgtaagaaaaattgtggagaagaattttccggtagcccgagtaatattaaccacgagagtgaatgtttagagttacagattgcactgagccagtgctgtaggccagaattgaggcaacagaggcatttatgtttgtgtttttgtcatatgtggggccctctaatgcatggggcccaggacaaagacctttctttcctggatctaagcatggcactacctaggtgtttgatggctttaccctaggagtaaggttgagttttaaggtgctatcctagggaataatttcaatatatcttggagttggaacttctatacatttgcagtgcgtcacccgactttggtctatcaaagcaaaaaaacttggtcaggctttggtgcctagctatctggtcaaatatttatctaaatgtttctgtgaaggtattttacagacgtggtgagcatttcttaatcaactgactttaattaaagagtttacccttgataatgtaggtgggcttcacccagtaagttggaagccataaaagcaaaagataaaaacagaaaaaaaaaaaaacagaaaactgaggtatcccccataagaagggattctgccttaagactaacatagaaatcctgcctgagtttccagcctgccaacctgccctacaaatttcagatctaatattgcaacatcaactcttgcctgagtttatataaaacctacgcgatagatttcagacctgccagcccccgccatgtaagccaattccttttggaggaccccgactgacacaggtaaataattccatcttcttttatcccagtccccaaaggcagataaagaaaatgtaaacatatatatgtactatataccttatctttataccttctgatagcacgttggacaaaccacggtttctagaatttatggcatagtattataatcataggtttcaaagtctgtctcctattctagactggaagttccttgtgtgcagaggctgtgttatcacagcgctttttgaggctggaaataaacgttcaatacatgtctgtcaaaggttagagaatcaaaattaacacattacctggataagctggcatgtggtggggacaggagtaggggatggtggaagagcaaggagaaagaatcaaacaatgtggacgtaggaagcagtctccctgaagctaagacaccccatgagatggtactcatccagctttgccaagctcccagcacagtcttaatcacctctctcacagcgactttgatagctctggctaaggaacttgatacctgcaagcaattaactttaataagccagcaggtgatttccttgagaatgctgacgattcaatttgctgacagcagctctagattctctggctactcagccatggcttctacctctgcccttatgaacccagtgtgtggttgtgagtaataaatgaaaaggtagccaaagtgtgaatccttttaacagtgaaaattgtaatcagctttaaggcatgattatatattacagacagaaccaaaaggtcttttaaagttatgaagaaaaacaaaagccaacaagttgtacagctacattggcaccaaacttttatagtttctgtgaatgtgaaatgaagggatataaaagtactttcacctgtattaaccttttttttttctgttactcatcatagcattatctaacgcagaatcctaggaatgattctaaactctttctctctgtctcaataatcctaaatgttgcaattgccttattgtcctattttactgcattattttttacacaatggcagcctaatgagttcccccggcatcagtctcaggcatcacctatcaaacaactccactgcttgcgtcctcttcccaaaatgcaaatattatttcatctgcatgtaatttcttaatagttctccattgttaattgactacagtggagtcaaatcttagaattaaattttaaggaaaaagaggcaaaagagctattttactcaaaattaacactgaatatttcttaaattgtccaaaaaatacagtatgctccccattatatatgaaactgtgcagcaatacatgtttgtatatgtagtaatttatggtaaataaatttataataaaactgtaatattataattaaatataataatataatgtaaatatcattaataatataataaaataaacttataataaagagaatgtaagctttgtgaggacagtgattttcattcattttgttcaccgatgtaccccaaaggccaaaaactgtgcttgtcatagcaggtgatcaatgaatacttgttaaatgaaaatcacataacaattgattaacaccattttaacaattgatttgacaattgttatgtcactgacaattgtttgttaaaatcatttcaaataactttattttccctttttgtgcaacacatttaccactaaagtaacatagaaagtctgtgtgtggtggaaagtcattaatttacattgctttctaggtactaccgtcttccatgatctgcgctatccgttctgcacttatactttgacttcagtgtatcaaatcactcaatgttctccaaatatgctgtgcaaagatctttgcactttgattcctcaagccaatttaagtgtcctgtgatcttacgaactttgtttttcctctattttcaatgtttatttcattgcatttttatcgttttcttgtgggtctgccttcttgatcagattctaagactcttgattataaaatctatgtcttaatagtgtttttaatagtgtctctagtacaatgtcggtgtatcaatagacacatacagagtatctgatttatattaagtgtttatttgtctgtctgtgccattatgaccacatatgttacacttgaactttctgaccctaagttaacatctgataacatgtgttctacattttaggagcaaaagatatacttaattatttcaacaaactaatgagcaaacaattttagtatcagcctgcagtaaatactctttgatccagtatccagaatccagtacacagtatccactgtgtagcagcttctgcacatggggcatcaagggtaccaccccagaaaaactgctatgaccagaagtattgcagagaccagggtaaccagaagcacgatcatctcagaatatacctgcagcagcatgcctacagtggccttatatggtttgtgggcaagagaccattgtgaggaagtcagagaaacatatttgagtcactttgttcctatgcaaatatatgcctcccagagatcttcttgagttggcagagagggactttgctgtgggagaggggagatatgttttttggcctcaatggtagcagctaggcaccagtataatttgatattaatctagatgcctgcatttcaactcacctctcaggcgggaatatggactcaggcttttagaaagctttttcacaatgggggacaaagtagcaagtgaaagaaaagggtaaagtggaaggaaaaccttttcctgatggttaagcagttcctaacttacatgtatgaatgcatacatacaaatataaatactagcttaaagaagaataccctatcccatgcactccaggtaattaaatgtttatttcactctgatttgagatgtctcacgatgctaaggaaaatattggaaagaccttctctctcgttatctcaccttcagttaaaaaaaaatgaaagagagaagaagagagaaaagagataaatagaagggctatttgaaggtaagaaggtgaaggcagtcaccttttatgccttcctcccttcctcctgccaatcatccactctatttggttgactcccaagcttgctttataaacagctggagagcaaagcaaaacttcaactttagaaagataaggtcaactcatcctttcatttgcaacaagttgatagggccattgccgtgcaggtttggctggtcctggacaaaaccgccttctccagaatgggatttagaggaagacccttctctctctaatgtgactgaggaaaacagaaggaaggtaggcaaaggagatctgctctaggccaggcacagtggctcacgcctataattcaagcactttgggagactcaggcgggtggatcacctgaggtcaggagttcgagatctgcctggccaacatggtgaacccccatctctactaaaaatacaaaaaaatagctgggcgtgatggtgggcacctgtaatctgagctacttgggaggctgaggcaggagaattgcttgaactcggaggcagaggttgcagtgagccgagatcgcgccactgcactccagcctgggtgacagagagagaccctgtctcaaaaaaagaaaagaaaagaaaagaaaacaaaaagacctgctctccagtagcctctgaggccccaacttcccagaatgggagtgttgatcaggacctatggtaaatgtttcctactccagtccaacagctcactgggctaaacaaaagaggcccttcacagcctcggggcagacccacaaatatttttatttaattggtttgagatggggccacagactttttggactggtccccaggtgaatcacacgtacagacaaaattcagaagcactgggttagagggccagcatgagggctagagtgagagttcagatactgcagggagaggctatgggatttcctcacggaaagagacccaagggtgtggaaggcattttctggaagatgactgaggtacttggttatgggcaagacagtctaatttacaaaaacatgataaacctctcgagcaaagcttttcaagctgtgcaccccagaaggtgtgcaagatgagccatgacaacatataagaaaacaactgaatgtaacatttccattctaatttttataaaatttctttgttttacttattagtatagtagtgcatatgtattatttataaataaagaaacatttattaggagtatagcctcaacatcattttactaatgggcataaataattctaaaatttggaaactagtgttctaaagaaggaccatgattcctcactgaaggctcagctgagaaagctgtgataaccaggcaaaccagagaggaacttcatccagttgcctggtaagaatgatgaatattctgggttgctaagaaaatacatcagccagaagggagcaagagaggctgccctgctggggaatgtttgggagaccataaaaacagaaggtgggagcaacgagagggctcttcatcgctactgttaataacaaaacaatagcaacaaatgtaatacctgctcttacttactgaattcccagtaaggtcaagcactgtgataggcactttttgggcatcactgttaatcctcatgctgtcatacccattttacagattaggaggaaaaaaacctttaaaaaccataagtggtgcaacacagatattctactccaaactcaatgttcctgacattatgtcatgcagtttcaagagcatggatcatgagtgacattaggaaactgagagaagaagcatattatagcacttagagggtattatagtataaccaggttgtatttatcagctgtcttttctttcaattaaaatgctaaaggccgggtgcggtggctcatgcctgtaatcccagcactttgggaggctgaggcgggtggatcacgaggtcaggagatcaagaccatcatggctaacatggtgaaaccccgtctctactaaaaatacaaaaaattagccgggcgtggtggcaggtgcctgtagtcccagctactgaggaggctgaggcaggagaaggatgtgaacctgggaggcggagcttgcagtgagcctagattgcgacactgcactccagactggacgacagagcgagaccctgtctcaaaaaaaaaaaaaaatgctaaactgtggttgatgttttcataaacagagaattggtgctagcttcccaggcaatttgagagaatagattttcctgagtgtaagtaaacctacaagttaaaagaagtgacatccactgggagactcaggccaaatgtgatttcttccatacaaagtcaggtttatcaactccctccccccaccccaccacacacagaaacacacttttaatacttgcttttacactctgcatctgtgttcactttttccattgaccctccaaccaaatttgtggttctaaagctctgacatcaacagtgcattcctgagggtacttctctaggactgtcttcattttaagtctttgctcataggcacaactgtaaacttataagaagtttcaagcaactgtagagtaataagaatcagatctgtcctggggttgtggcgggggtgggcgggggaagtgtggctcttgagtagacagagacttggcatgacagtccttgtttaggattgggactcaagagattccaggaaagtcagtgtcccttccgtccaatcacagtgtgaggcccggtgattctggccttttctgctctatcattcagaaatgaagtcttttctgctctatcattcaggaaagaagtcttttctgctctatcattctagcttcttagccaccttgttggtttttatggattttctttttaccctgctcctgcctagcaagaaagaataaagaaaagggagaggaggggagagaaaggagctgactctgcagaccacaactttataattatttgaatataaaattagctggtaatgtctctctctttatgcaggctatgagatacatgatagttgtttctagtaacatatgttttctcatttttatcttttgaaatgttgttgaagtattcctaacttttatggctattaatggaggatgctgctaccatcctacccaagggcccatttttctaaatcctacaatcctctacgaatggaagcaatagcactacagttaacactctaaattgtacccttgtgcacacatacaggcctaaatcacttggccttatagccacaaaacacaattaggaaggactaaggtcatcaaaaaaaatcctaaatgccagttcactgcacagcacattctatagtcatcttacttacttgttcttgataaaaatgaatcccagcagggactagaatggtgaccctgattgtgaataatggcacacatgcagtgtccctcaatggctaccagaaaacaacagcatcagttaatagcctgtgttgtctcttaactgcccattgccagcaataggttttgctctatatagtctggattcccagtttcaagggtcttcactcctaccaggcaaaagtgctgtaatgagaacaagccaagaaaggaatgaggcaggcaacaagccaaaatccaggcagtgttagaacagccttgtcagggaagcagagaaacaaataattgaaattagaaaaaactagattttcagaggagtctcataaatcagacttgaaaatttaatttgagagcttttctctttctttcatcatattttttcccctcctggagctgtgctacaggcctgaacagaggaagtggaatgtaattaatcgatgtaaatctgcttcattaatggattgctactccctgtgtttcctctagtcaagaatgtttctgaaagtgctctctgacaacaatgctattcacagtctggataatggtaccaagcaggagaagaaacgatgaagtacttgcatgaagggagcccatgtttgctattgactggtagagaaatttagttagctcattaaatgttctgcttacaaaccctattcatgctttttaatcaattgatacttgtcctcctttctcacattgattaaataccaggaagtcctcacaagatagtgagatgtgaagttcccattgcagttaacaaatggtcctaagacccttagaaaacacatggttgtgcatctttatgcccacagggaatacgccattaatctgaactaataaagaggaacagcaggctaatcatagctcatttatatttggccctggaatgtgttatgtggtttttggcagaagatttaccttactaattatgtcttacttaaattaataatacagttaatttgcattcccttagcacacaccaattgacagtgagaagaaatgtgctaagtgataaggggatatcatctcgaaatttaaaagcttcattgaataatttgtgtatatatgtatgtgttgacactatatacatttaggacaaaaactctcaacatactttggaaagagaagttaaaattatgtgtgaaaatcgctatcaccttttggctaatttgcatcatcattgtttcaatattttatctcactacttctgagaccaataaattagaaagttaaacctgtaatcaacaaatatgtgtatatgtaacctaccatatcctgagcactgttctcagtattgtaaagggatttgaagaaatatacagtcattactctgtttcaaagtggggactggttccaggacccccatggacaccaaaattcatggatgctgaagtctctgatataaaatgatgtagtatatgcacaaaacctatgcacatcctcctatttactttaaatcatacctagattacttataatttataactcaatgtatgtgttatgcaaaatagttgttattgtactctgcattgtatagggaataatgacaagaaaggaaaagtttgtacatgttcagtacacacacaactactatagacctaaccacatttttcatctgtagttggttaaatacatggatatggaacccatagatactaagggccaactgtaggctattttctatcttaagatctaaaaatctggagaaagaaatattaagagatctagcactaatatgctttaggtgatctttgccttgtttgtagagactacaactcatttacaaaccatctcctatagacctggattgctgatgtggggaagaaaaaattaaggggtttacctttaagcagagtcaaggaggttaagaccaggtatctgattttccagtaaatgaagttgatgaacacaataaacccatgtatcattgctaaagtgctgtaaagtagagctttaatgccctctgtcaacttagaatcaagagtaaatatccactagcaattctacactggtataacaacattgcccagttactccacctttgaaatcttcccagacggacagttgttcaccatggcagatatgaagattcaaatatgtttgagctatacgaagtacatgataatgtaatgttgatctatctggttttggatgcatgaagcaatggtccaaacttggatatggaaaggaaacctcacttgtttcacaaatcacaggcatatttgtttcagatattgtaacacaatgattttcacccctctcacttttagcacaagtgttgcataagacccttggaagttggcctaatactagagatatcactaagtcttttttataatctatttctgattaattagtcctttaggataacatatacttatcaatatcattatgacattgcaggaaaaacaaaagcggtatgggtggattcatctcctctaaacttctttctttatggtcttgaacaaattactaaattgtaatgagtaaaatatgtatgttaatacccacattataatgtagttataagagctcgacataatgtatgttgagtgcttttgcaaagtgctttatattttagaaatactctccttttagtgcagccatactttgattctttttcattgcaatgacatggaaatttcaggacacaaaaatcagagtggccaaagaatttcatgggttcctttcaaaggataaaacaggaaattagaaagaataagtatgatataattcaaaatgtaaagccaatatctcgccaacttattaatacataaaattatatgccaatcttaacagaaatgaatgctacaacgtggtttgctaagctaattcaataggactacattaataaagttcctataacaattgagatggtaatctcatgttacagttggctagtctggccaatccaacaatactacattctattttgaacatcacttggagtggtattaccaaaaaataaactggaaagcatttagacaagaatggctcagacaaggtaagagctaaaagtaaccatttgaagggactataaaattcacctcagagaagagggagcatatggaatacatgagggctgacttcaaatatttcaagagttgttgccaggaagaactttaaacatagagtaactgatgtttaactcatgccgtgaactcatccactgtatgtttgaaaaccagtagcccagtagcctgttgggaagacagatttgtttcatatgtaagtaaagacaattcttcttattgaaaaaagcatggacataagatctgataaatccagcagaaaatttcaccttcaatcaagtagcaatgtgaccctaaatataaaacctctttgagcttatttttccaaactataaatcatgtcaacaataaggctgatacaaggattacctaagagaacatgtttaaaagcaccagcataatgctttaaatttcatagatgtgtaacaagaactaattctaacagtcatatgtcaaagatgttcaaagatggaattgagtgttatgggagacaataattttcctatgctagaaattgtttaggcaaaggctaaataaccacttggaagaatacaaaagaggaaagtcaagcttcagaattaaaattagattactttcaggattcctttcaactctaaatctgaagatcttgtgatacaaacattaaaaaaaagtttgcctaggaaaaaatatcaagaatagcaacagttatatctacaagagtaggtaaaaattgactaatatttgaaaaattagtctagctccctattaaagtatatagtttattactcttttaaactagtcaaggggaaaaaataaataatattggtaaaactcaatgcagatcatatttcattaaacaagaacatctttctttgccagatgtataggttagttatacactttcagaggatactatgataatgatcatatacaataacccagttgtcccattctttgatattaataattaaagcaatatttcttttggagaagttattcctttaaaaattcaactggtaggataaatctaatagagaagtagcacacagctaaaaacagaagttttagtaaattaatgagtggaatgttgaattcagcagtagctttaactaatgttgtgaactcatccactgtatatcagaaaaatttacagtacgttagaaaataatttgtgaaaccaatagcccagttgtctaggaacaaatgcacatcaagtaatagggaatatttttaataaaatttagtagattatggtgtaaggttttatacacaaatgtaaaggttttaattcaaatgtgataaaggagatgtttgtggatttatttagggtataaaaagccacatttttaatataaaactttattaatgtgacgaaattttggaattaaaagtagtaggacgcttacatcatatccctcactaaatgaagggcgtattgtttatgaaataatgttacatgagaaagaagacaatattgcacatacatattaacaaagtccttagctatccataaaatctagtttttccttcattactagtaacagatgtgtagcttttgcaagtggctaccagaaacactacatttcccagtctagcttgtagttggaaggaatcatgtggctaatttcaggagaaggtaagcagaaataatgtgtgacactgatacctgtaagaccagccctgtatttttcttgtacatttaagttccctgtacactctggatattagacctttgtcagatggatagattgtaaaaactttctcccattctataggttatctgtttactctgatgatagtttattttgctgtgtagaagctcttcggtttacttagatctcatttgtcaatttttgcttttaatgcaattgctttgggtgttttcatcatgaaatctttgccccatgcctatgtcctgaatggtattgcctaattttcttctagcgtttttatattacagttttgggtttttcatttaagtccttttttatttttatttttatttttggcagagtctcactccgtcacccaggctggagtgcagtggtgcaacctctgtcattgcaacttctgtttcccgcgttaagtgattcttgtgcctctggctctcgaatagctggaattataggtgtgtgcaaccatgcccagctaatttttgtatttttagtagagacagggtttcaccatgtttgccaggctgatctcgaactcctgacctcaagtgatctgcccacctgggcctcccaaaatgctaagattacaggcatgagccatggcatccagccttatttaagtttttaatagatcttgagttaatttttgtatatggtataaggaaggtgtccagcttcaattttctgcatatgactagccagcactctcagcatgatttattaaataaggagtcctttccccattacttgtttttgtcaagtttgtctaagattagatggttgtaagtgtgtggtcttatttctgagttatctattctgttccattggtttacatgtctgttcttgtaccagtgctataaaaagtggacatgaacagacatttgtcaaaagaagacatacatggagccaacaaacatatgaaaaacagctcaacatcactgatcattagagaaatgcaaatcaaaaccacaaagaaataccatctcatgccagtcagaatagctattaaaaagtcaaaaaacaacagatgctggcgaggttacggagaaaaaggaatatttttacactgcaggtgagagtgcaaattagttcaacaattgcggaagacagtgtggcaattcctcaaagatctagaggcagaaatgccatttgacccagcaatcccattactgggtatatacccaaagaaatataaattattctattatgttcacagcaatgtggatggaattggagatcattattctaagtgaagtaactcaggaatggaaaaccaaacattgtatgttctcacttataagtgggagctaagctatgaggatgcaaaggcataagaattatacagtgaactttggggactcaggggaaagggtggaagggggcgagggataaaagactacaaattggatacagtgtatattgcttgggtgatgagtgcaccaacatctcacaaaaacaccacaaaagaacttactcatgtaaccaaacaccatgtgttcccccaaaacctaaggaaatttaaaaaattttaaaatcattctattataggccaggcgtggtggctcatgcctgtaatcccagcactttgggaggctgaggcgggcggatcacgaggtcaggagatcgagaccatcctggctaatgcggtgaaaccctgtctctactaaaaatacaaaaaaaattagccaggcgtggtggcaggtgcctgtagtcccagctactggggaggctgaggcaggtgaatggcgtgaacccaggaggcagagcttgcagtaagccgagattgtgccactgcactccagcctgggtgacagagcgatactctgtctgaaaaaaaaaaaaaaagatcattctattataaagatacatgtattcatatattcattgcagcatgagtcacaataacaaagacatggaatcaacctaaatgcctgttaatgatagactggataaagaaaatgtgatacacatacaccatggaatactatgcagccataaaaaggaatgagatcatgtcatttgcagggacatggatggagttgaaagccattatgctcagcaaactaacgaaggaatagaaaactaaacactgcatgttctcacttataagtgggagctgaatgatgagaacacatggacacattgttggagggaacaacacacactggagcctgtcggcatggggtggggacagggagtgcatcaagaagaacagttaatggattctgggcttactacctagatgatgagatgatctgtgcagcaaactaccatgacacatgtttatctatgtaacaaacctatacattttgcacatgtacccctgaacttaaaatttaaaaaaagaccagtcctgtcttttcacattcccctgatctcttcctatgagctggaataataaaaaccagagtgatcttttatatcacatggtgaataaggcagaggcactaccagaataagaccttgagtgactatgtggaaggaaggcactgctaacccagaatactcatttgcaattgttatgtgagaaaaatacacttctatcttgtctgagctattgaatcttactttatttgtttcagtagtttagcatttgaccctaaaaactactctgactaaaactatgcaaaaatgcatgtttatctaatcatagagataacaagaagccctaggaaagtacaaagtgattgttttaaggtaatattttataaaatttaagtattttccaattatgtgacaacatttcttttggataattattatggatcagtcaagggccaaatacacaataaattgttcaatagattcagtcttcctctgaaatccaaggaaggccatatataaaaacaggagcaaattgctaggggaattcatatttgattcctaattgtacatttaccagaagaaaatttggcatttgaattgagcatttaaattcactactattcaacagcaatctgaatccccaagttcaattaaaaaggtcattaccctctagaactggaggtgctcttttaattacaatattgctaatgaattgggagacaagacattttggcttagttcaattagcacatttaagtcaaagcaaacttcagccaatatgggtgactttcccagtggcatgctttttctttattccctccttccctccctcccttccttctttttgtgtcttccctacttccttctttcctcggaaatttaagcataactctggcacgtaagtctctcatttccattttatctgtaaactgctgcaaagctgttaatagctaaggacctacaaccacatttttgttttgcaaaactcttcaaatttatatgaatattgagaaaacattttgatgagaaatttttaacatagctttctgaagcagagtaaaacataaatttcactttccctagctaaaacaataattatccaatcactttatcatggtgtattgcacatgcttttgctatgggaaagggggaaaagtgaacatatttaacactttgctaccaacaatggtttattgaggttaatttatattaggaaagtggagtttccggatgacattccaaactaaagaatactaatgaatagctcctgagctctgagctttcctgcctggctagaattcacaggacatgaccttaaatgtaacagtttttggtaaaaaagagaaaatcttcccttcaaagtgatttgaaaagttcagaaaattagctcttatgctcaaactaatagtaacaaaaacactgctaccagattaaatttaaataaagttcataacagctgtttgtaacatctagatttaactttaggggaaataattgactcaatttgcccaggttattctcttcctttgctatgccagtaaagggcttggagaggttgcccatgcaacatatcctacagatttgagtcagctagactaggtgtttattcatttattcaggaaatacactgagcagcctactgtgagcttggaggtgggcaaacaaaacagagaaaaatctagacctctctctctctgtaaattgacataaagatagttttagccaaggaggaacaatttccttctaatttagcactacagagtgttctccttggaaaagccatccacttggctttgtaccctgattagtctgttctcacactggtaataacgacattctcgagactggttcatttataaagaaaagaggtttaatcgactcacagttcagcatggctgaggaggcctagaaaacttacaatgatggtggaaggagaagcaaacaggtccttcttcacgtggtggcaggaaggagaagtaccaagcaaagagggaaaagctctttataaaaccatcagatctcgtgagaattcagtcactattacgagaacaggagcatgggggtaactgcccccaagattcaattaactcccactgggtccctcccatgacccatggggattatggaaaatacaattcaagatgggatttgggtggggacacagccaaacattatcccctaaacaaagtcataccttttcttttttttttaaagaaacagattctcattctgttacccaggctggagtgcagcgacatgatctcagctcactgcaacctccacctcccaggttcaagtgattctcatgcctcagcctcctgagtagctgggattacaggcaccagccaccgcgcccagctgatttttggatttttagtagagacgaggtttcaccatgttgaactggctggtcttgaattcctgatctcaagtgaccctcctgcctcagcctcccaaagtgctaggattacaagtgtcagccaccacacctggtcaagtcatacctttttaaaatatattctcctttattatattcaagtaagatatgttctttaaagaaaatttagaaaaaaaagaagaaaaaacaaatatcttctttctttgccaaagcaaaaactgctaacatttttaaaattttctttcgaatttcatctctttaactctcttgtgtgtagtagaaaaaaaagttgtaattatattgttttttaaatttgtgctaagttttaatgcaaacttttcataaaacatttagtggaagcatattccttaatttataacatattatgatttttcttattgttttcttcattgcagattataattaagatgatcaacttttcagataacactttcctaggagaagtgttgagtcaaagaataaatatgtatgtttttattttaaagtatatatgtatacacgaacacacacaaatatatatgtatatattttttatttgtttaatttgtattgttaaagggcttttccaaaagattgaaacaaattatactccatctaaaaaaaatgcttacttaacctcactcaggtatatacataatccacagcttactcagatgtatatataattttctaatgagttaggaaaatgattacatgcctaagattttctctgtatttgtaactaaagtatggtgatttgtgaaaagcttctttacatctattttctattaagatgttgttaaatttttttgcctatctttgaggtttcttttcaatggcttattgtgtgtaaaataaaccatgataaaactattaggtaatctttaaaaaacaatttctaagagtgctgtacatattaaaaatatgaactttatattggccacatttattgcaaatattttcccagatataattagttttaattttatttatgacatgttttaccaaaaagtacaagttttatataactaattgtgatgtatttcttatatcaagatgttaaccaatattttttattcaattcttatttttcacttctgataaatttccatggtatttgtctcaaagctccacataattctcatcattccttaaaaaaaaatattgactttttaaagaaacttcttttacttattgaattttattactcattccaaaaatggttaattttcttctctctcttttcttctctctctctaaacatataatctaaacaacaccttttaagttgtttttcttctccagtaattatcttccttatttccactcttatcacagaagccaaacttccagaactatataaaataataataataatgggaatctgaactattagttgttaatataatattgatatttttcagcatgttaagaaaatacctttttatttctaaatttctcaaaagtattttgttggtggtgctggtggagaactatttttacatttaaagccagaaatgattagttatataaaactctgactttaaatgtaaaaaagtgcattacattatgaattttattacagccaggcatggtggctcacacctgtaatcccagtgctctgggaggccaaggcgggtggatcacaaggtcaggagttcgagaccagcctggccaacatggtgaaactctgtctctactaaaaatacaaaaaattagccgggcgtggtggcaggcgcctgtaattccagctactcaggaggctgaggcaggagaatctcttgaactcgagaggtggaggttgcagtgagctgagactgtgccactgcactccagcctgggcaacactgtctcaaaaaaaggaagactgtttcaaaaaaaaaaaaaaaagaaattttattacattacggaatcttttttaaggcatttgcaatatattcagtggctagctttgcaaaaagttcttatgaatttgttttatagataagatgttcaatattgtcagcattttttgattaaatatcttttttatcttttattgataaaacaatattttttattatatattattaaagtaagttattctgtataacagactaggcaacagtgaaagttttctaaatgctttcttgattcaccttaatattgaattttgctatctataataaaaaattctataattattacctttttgttatctttgtcaggctttttataaggtaataattatagaatttttggggaaaataaatcaattggtagctttccatacttttgcatgtcttacaacaaattctatagcataggaataattcttttaaaaaccctaaatactttgggaccaaattcttatttagaggtaactaacattttgatactactcatgactaatggtacattaagaatgtttttattttctggctcaatttaggtagtgtatattttctcagaaaaatggcttctgagaccttcaaacatactaagatttaattttacataatatttccttattttaaaaagttattcttaatatatttccattttaatttataacatttataactttatatatatttactcttactatttgattcactatgggtcagtcttgttttgtttgaaataaccagagttgattaagttatcaactcttctgatacctttcttctaataaataaattcttgcttttatctccatcattgtctttcctccattttcttctacttttttaattgaagaggatattatagaagaaattgttatttcttcacaattcttccttagctctcactcttgccatggttcactgtgggcagagtaaattccttggctccactgacctaggcctgaccatgagagttgctttaataacatttaggtagaaaagaagttgtgtcacatccaaataggggctttatggagcattccatgtgtccctctccacgtgtcttgtgttcttacccttgccttgggaacatgcttcccatttggcggctgatccttcagtcagcatcccagaaatagaaaaatgcataaagcagacatcagtccaacctgcagagtgcagttgagccacagcgcccaacaacgacccagcctctcttattcaacgtgctgggaaacaaacatttattacagccattgagattctgtactgtcatggaggaagacctagtgaaaagtgacgaatactttttttttttttagactgagtctcgccctgtcgcccaggctggagtgcagtggtgccatcttgactcactgcaacttccgcctcccgggttcaagcaattctcctgcctcagcctcccgagtagctgggactacaggcgcacgccgccacacccggctaattttttttttttttaattttagtggagactgggtttcaccatgttgcccaggctggtctcgaactcctgagctgaggcaatctgcctgcctcggcctcccaatgtgctgagattacaggagtgatctgccgcacccaggcaactaatacaattttacattattctttctatcattataaattgaaccccttctttatgctccatcttacctgtttattaataataaggctaaaattatgccactgtgtacagctttgtaaatgggccaaaaatttaataattttatgttaaaacattctaaaagtatgaaattatagttattatttcctatttgacctaatatatatttacaatatatattttaaaatttctatctgtgtgcttttatcatttaatccgtattattcgtttacagcattcttgcagtgttttcagagagatgtggtcttacaatttttgagttttcaaatagatttaggttgcttatatggcttacaatgtgatattttaaaatcacattactgttttggtaaatagttgaaaaacatttgatttttaataacactttaaatgttttaaacttaatctgaatatttgaatttaatttgggatataaatctatgtgccttgattatgatgactggtaagattcactttatctctgcactgtgtgctttaattttcttcagtgatacaaaaccaaaacattcatatcctcctaaatttttaagcgcattcttaaaccatttcctctgattaacaaatttatgaaaaatacaaaaacattggcctgtgcatgtttcatcccccaacacacactagtgtaaaataattttttatttctagttcacttaaattttcagtatttgacaagatattttgaggatacagttgttgattatgactgtttaatggccaaacttttcatatatttattctctgggaatttttttaacatttgcaaaatattccgtggccagtgttgcaaaagtttttaaaaatctttatgttgaactggaatcatgcccacaccactgtatatatgttatttaattctctagttcttagttgccgcattctcatttttcattttattggagcatattttcaagtaggattattcaaaaatgattcatcaatgatatatgttttgaatcctttacaatttcaagaatgtcttcacatagaaatgacaacatggctacatttataaatattgaaatgcaatttttttccctgtgagactccatataagtgacttcttctagcatttattatggtgcaaactttgaatctaacttaaaagttgtacttttttttttttttgagatggagtctcgctctgtcaccaggctcgagtgcactggtgtgatcatggctcaccgcaacctctgactgcctggttcaagtgattctcctgcctcaactcctgagtagctgggattacaggcatgtgccaccacacctagctaatttttgtatttttagtagacatggggtttcaccatgttggccaggatagtctcgatctcgtgaccttgtgatctgcccgccttggcctcccaaagtgctgggattacaggcatgagccatcgcgcccggccaaaatttgtgcttttaagtaacatccttctcttccctgcactgaaggatatgactttgttattgacattttaaaaatctaacagtatattctaggcataggtctttttcaccagctttccatgaaacatagtgatccttttaaacttacaaagccaaaatcttattagttctataatagctgttttattatgactttgattattctttttggtcagtttgttttggcttaattcccaaggattgtcagctatctacaaattgcatctttgttttctttccttgatatctattatgtttttgattgatctgcattcttaatgtacttttcaaagttgttctttaagtcactgactgcatttcatagttagctgattctgtttttaccacctccaatgaatacttttatcagtttgatgtattctttctaattttccttctcatcccatattttttatgctcacaagctgcatctctgcaaatgacaactttgtatcatctttaatctcttctgtagtgaatttgtcttttctggttctttattgaaaaagcaaatatacattctagaaaaaatatgtttctaaaataattacttctgtttgcaatgttaggacatcaaatttttcttatgttagctctttctgtagaaagagtttggtcttcatcgatttgaacaaggggatctttacccatatacacgtttcatgtaaataagtgtatgtattcattttaatctccatcactatttccctgtgtacatccagatattccttttctgatcttgtcaatgaaacccagattaagtgagattgtatcatctcctgtttccctaatccttgcagtaaagtaggtgtatttatttctggataattttaagcagcctgaaattattttcttctatttcccgcactactggtattttacagttctacttataatttgctttataaatgtgttgtgtggttttcccaacccttttcacctctaaacatgctgtatggaagttgcaatctccagaatagaggaagaaagatagtgatgtgtgagggggatgtggaggaggatacaaaataaatttcagtcatctcagtcacccatagacctgggattatcactaaattctctagatatatacagagattataaatctctgaacaaaagatccagagtggggatgaatgaaagacatctcccacccattctaatcacttctggatccattccatctctactgtatttagagcaatggttctcaaactttagtgtccatcagaatcacctggaggacttgtaaaaacaaaacaaaacagattgctgtcacactcccagaccgtctaatttaataggactgtggtggatcctgataatttgcatttccaacaagtcccaggtgatgctgatgctgctgctctgggcaccaaatttcagaatccctaacttacagcaattcttccaagggagctcaatcacagattgaaatattttttaactttatatcagtgtgtattttcacagctatcccacgagcatgtaaggaaaggtgaattaagcatccacagctagtgatttagttaaaatatgttatgtttatatatatttatttacattatttatgcattttactattagatttctttttaagattatcttatatatagatagctatttaaaagctagttggaaatgaaatgtgtttcattgtctaatagaaccattaaaggtacattgttaagactaatttgtaacgtactggccattatatctggaataaacttgtttttagtgggggattaaataaaaatttcctaatacaaaaattgagctaagtctgattggggaaagtacagttgtgtgtttgtgtgtgtgtgtgtagacacaaacatatacataaaatatatacatatgtgtatacatatatatctgagagacttgctaaagtttatacaaagaaaaattctaatttctggctgtgtgtattaaaacatgaagaacaaagccctcctgagacaacattaagcacgtgcaagataacgtgggaatggagtaggaaaggtgtttgttcctggctggccagattcagatcatttggggaatcatgtcttgagtgcagaattgtgggtcactgtgtttctctttctctttgttgctttgagttattaaacaagagcgggggactttattaaaaagaaaatggtattaatgttttagtcctgttaatatcttgaaagttgtttccctaagagtgaccagacatggtgagactttactcaatcagcaagaataccaccatgtactttaataatgaaagaaattaggctggggctattgtaagaacagtttctgaatgacgatgcaaaatataataaacacagaagtcccacactggcacagcatctgtgaggctctggggtttatgctccctaggtttagaagattttatgtttcaactccacagacagacattttcagactacctttatgtgattacactgtaatattcaattttgtcaaattatttttctttcatgcattgaattagtccctttttcctaattctctttggaattaacaaatttagattttccagcacatggcagttccatttaagtggaataaaataagctctgttcatttctcttttgctttctacagtttgcttttctctgtgtgaaaatgctgtttctttttcaaatgtattattattctcacagacacaaacagaagctccttttgcaattgacttgcctctctttctgccattacaaaattatcactatggtagtttcatgagttagaagataagtatgattaaattccacttgaccttgtttaacccttcattcatagaacacttcctagagcaagggattttgaagctgaaatatctctttgaagctgatacataatatggagaggaaaagcaatcttgccttgaactttgaaaagcttacaatctagactgtgccactgttctaaaagcgtggtccatgaacatcataggtatcacttgtggatttgttggaaatgcagattcatggaatcacctagtgaaacagaatttttgtttaaacaaccattccaaatacactattttataaaatcctttaggtgattcttatgcatattaggtttggaggctactgctataatcaaagataaattatgattagattttttaaatgatatcttagtagatttcagaagtgaaagcaatgccttctggtgcagataaaggaagtcttctggcacttgaactgaaagtaaagaaggctttttctgggttatgatagtggatcaatggctaggtggaagggaagagatgatacaagcaaattcccaaggccaggaaaacacagatgtatcattgcatagggggcaggtaagtcaaaatacaaagtctaaagacattaccaaagtactttgtgagtaccatggaagaaaacgtctgataccagcaagagtgaggggaggcctcacagagcaatttatataaggctgggccgagatgggtaatttcaatttacaagtcatctaaactgacggctgggaaaacacaaattcagattttcagagcggaagagaccttcaggataaactaatacaattcactacacaatgcatggattcctcctctacaacaggttggatgagtgtttggcctttgctgggttctactgcacattcactagcattgcgggaagtcagggaccccgaatggagggactggctgaagccatggcagaagaacataaattgtgaagatttcatggacatttattagttccccaaattaacacttttataatttcttacacctgtccttactgcaatctctgaacataaattgtgaagatttcatgggcacttatcacttccccaatcaatacccttgtgatttcctatgcctgtctttactttagtctcttaatcccgtcatcttcataagctgaggaggatgtatgtcgcctcaggaccctgtgatgattgtgttaactgcacaaattgtttgtagagcatgtgtgtttgaacaatatgaaatctgggcaccttgaaaaaagaacaggataacagcaatgttcagggaacaagagagagaacctcaaactctgactgccggtgagccaggcggaacagaggcatatttctcctctttcaaaagcaaatgggagaaatatcgctgaattctttttctcagcaaggaacgtccctgagaaagacaatgtgtccctgaggggaagcctctgaaatggccgctttggggatggctgtcttttatggtcgtagctgtgggatgaaataagccctggtctcccatagcgctcccaggcttattaggatcaggaaattcccgcctaataaattttggtcagaccagttgtctgctctcaaaccctgtctcctgataagatgttatcaatgacaatgcatgcccgaaacttcattatcaattttaatttcgcccaggtcctgtggtcctgtgatcttgccctgcctccatttgccttgtgatatcttattaccttgtgaagcatgtgatctctgtgacccataccctattcatacactccctccccttttgaaaatcactaataaaaacttgctggttttacggctcagggggcatcacagaacctgccgacaggatgtctcccccggacacccagctttaaaatttatctcttttgtactctgtccctttatttctcagaccggctgacacttagggaatacagaaaagaacttatgtgaaatatcgggggtgaatttcacccaatacaccaggattctctcatacattaggaagatatctaattatcaagacaaagcgtcctcttctggtgttctcaatttctgtttatttgtttgacatttttacctgctcatgagtcagtatctctggtgatggaatattttaatatgtaaacatcttaccttttaactatactgctcagatagtaggtttatattttacatcatttcctctgcccctggttttctaccgtttatacatgattttttttgaataacaacctgaaagaccaaagctctaacttattttcattgatatggagtaaagtggtatacatttaaattatgtattggacataagatccaagattttccaacacacaaaccgagaatgcatttaccttcttggtatgatcacaggagcaccaacatgactggctgaccccaaacacctccccactggctgattataatagacatgtaagatacatgtattttacagggataaacttgtaatattctttcagacatctaaaaggtgaacaggcatcattgtatccatgtagatacagaatagtacctaatctctaaagaggaaaaacccttagaattagaggaaaagatcgtacaaatttaccctctgcaaataaaattaataaagtcatcagcatatgactttttacctagatatagacatttacttatatgtaaattaacccttaatatgagatattgcaaatattttctgaaaatatgagactttatctgggtttatctgagatactctaaacccattttggggagatactagagtatattcttgaacagacctgacttgcctatttctgctttaaggaaaactataatccacctaattggattgtaacatgtctggtgtgaggtacttctagttattcataaaggggaaaactgtataggaagaatgcattcagaaagagtagaaatgagatccatagaaagaaggaggaggaggtcgggtgtggtggctcatgactgtaatcccagcactttggaaggccaaggcgggtggatcactaggtcaagagatggagaccatcctggtcaacatggtgaaatcccgtctctgccaaaaatacaaaaattagctgggcacagtggcgtgtgcctgtggtcccagctacttgggaggctgaggcaggagaatcacttgaaccagggaatcagaggttgcagtgagctgagatagtgccactgcactccagcctggtgacacagtgagattccatctcaaaaaaaaaaaaaaaaaaaaaaaaaggaaagaaggaggaagaggaggaaaagcagaaagagggaagaatgaatgtaaactgcaggtggcagggctttagtctgcaagaaactgactactatgacagagcaaatgcacgctctcagacctatgagcttctaaaatgatccgaatccatgctgaaaaaggaaactttggatcactttttaggttttacaaataatcttcatgcaccaagaactgatatgatcaatttgttaaggtttgcttgtctatttagctcttcttagtatagtttttattcctttgaattggccaaaaatactgtttcttcaaataattaaggactctatgtcttttgcacatgacattctaatttggatcaaagaattaagttttgtttttgttttagtgttagaagcaccttatagatcatcaacttccatatttttaatgaaaaggttaacattttgtcaagatcactcaactagttaatgagagcattggggttaggacattggggttgtcctgtcttgtgattcaggacaactctatttccagtgctccatatcacctatttctagacagtatctaatgatcactggcttcttagaggttagtagagaaaagttgtttgccttgcatttatattttaaatatttgactttatttcaggataatgttattatataattggctaatttgcttagtttaaaatctcaaatactgttttataaggattattgtctaatccatacccctaaaataaaatgcttaccaaatggcatagagaaaaataatcagtgtaattaagcctcttttgtgtatgaataaatgaaactcctgaatctgaggtataatcactatatctttaggagttctagggtttttatgttgaggaataaattgtaataaaatatttcagaagtcagcacccaaaaatgattgtttaatgacctttgaaatatcttacttgatttcaaggtgctaaattgttttaactacactaacacaaaagctctttaaaagctaagagtcacaattcaagaccgtgggttcattattttatatggattggcacaaactcagtcacctgttcacagccagctccacccccagcgcttctcagctctcatccaccatgctgtcatcacattcttagttttcagtcaaacaaggtctggagctctctttacactgcatcatgttaacatcttatttgttagcttcaagtgtaatgcctgttcaagtttggcatatgcagaagtaaccacataggttctaaatattttaaaacttgatgtaaaaagtccagattacctcatatttagttattctgtgattggccaaggtcaaacagtaaacttggtaaaaatcacaccaaagaacaagcttatctgctggtattaactctaccatttaaaaatacattgtcaaggtgtgcagaatatctaaaggactaaagtttctgctcaccatcccttaaaagccaggcctgctgacaaaggatgtgctccataagtgtctgcatttattaaatcatttaattaattgtagaatggctactatatgtcccatacatggaggatctaatggtatataatgcagacagccttttttttttttttttttttgagacagagtctcactgtgtcgcccaggctggagtgcagtggtgtgatctcggctcactgcaagctccacctcctgggtttacaccattctcctgcctcagcctcctgagtagctgggactacaggcgcacatcaccacacctcgctatttttttttttttttttgtatttttagtagagatggagtttcactgtgttagccaggatggtctcgatctcctgacctcgtgatccgcctgccttggcctcccaaagtgctgggattacaggcgtgagccacagcgcccggcccacagacagccattattttaagtgctgataacatagctgggaagaaaagacacacaatattatccatgataaggcattagataataagtcatattaatggtatttacaattgagatatctggtagtcagttaaccttccaccaactaactatatgccatcggcatgttccttaattttcttgtttgccaaatgaaaaagaaatgcaaactagaaggtctgttaagcttttccatctctctggctgtcttcggtccaatcagacgtaacaaagttggttttgccattgggagcaaatgctaacaaataatactagataatattaggaaaacaaatttcaaggtaaaaattattagtgaagacaaagacaaatattttatgaaaggtataatagaaaacaaaagattatggactttgaatccatttagacctagtttagacctaggtacaaattctagctctactatcttctaacagtgtgatgtcaaaaagctgattcaccattcttaacattctataaaatttggcaaataatatctaactgagataaagcctgtaacatagtctggcatgcaaaagcatttacacaggatagctattaatattactacaagtattatttgcatagcattttttttccttttctaagtcctcacacattagctatgtcattttatcttcacaactactctgtaaagtggtattgtccccattctgcatttgaggaaatggaatcacaaagaggttcactcactacaataggtaactataagtggataccttctatgtctctctacacaaaaattgtggtagagagagagagagatgaaggtgagagtcccttgactccccataagtatcaaattttgcacaactatttttctcccaataagagtcaatcctaaaatgtctgcactcacaactttaaaaatattccttttctatgttgccaaaaatggatgcagtgtgtgtgtgtgtgtgtgtgtgtgcgtgcacacacatgtgcacaaaggaatgcagtgtcatggaactgcgattagtaattagtagggattattcatggcatactttatagatttttagtcagtaatgtcaagatgttttccaagagaaaaaaaaaagtcttttcatcaatataatggagattaaaagcataacagaaataaaatgctggtgaaatgtattttatacaaaggcataatagccaaagtcaagtgacagagccaggaatagaacctaattcaaatgttttgactttatttcacttaaatgttgcttacaagcttagaaagtatatattgtctcgggccttaatgctttttaattttttactgtgtgttcatatcttggatagaaaaggcactcagtctgttaacaaggtcaaaataactccttcctactcttaggaaaataataaataaatttgaaattcttcaagactaaatggttaatagcagccacacttgtgagtaggaagtctgcctttaaataatgatcacaaccatggaaatcttgagacctgtctagctccggtaaaactgcctgcaggtcacactctcactgcatcactacaatcctgttttaatgcagcaggtagctttatagctgtgaattttctgaacataaattgaattatggaaaactgacctatgcacgtcacttagctaccttccagtcataactcagatctaatctttcttagctccccgcagaaaatgtctaagactgaccacaaattccagaaattacatgtgggttggtcatgggaatgtggttttcatatactgggggatttagaaaacaggactccaaaagcagagtcacctgggcctgtgatgaataactactctggtgtgggctgttctgctccagttcttaggaaggaaggtatcctagaaacaagcaaagaaatagataaatcctgggtgatccctatgcttttcctcatttatcttcctcttgctttctaaaaaaggtttataacaatcataaaaataatacaattacgtccacagtgaggggatttttttctccactggcaccaactcataggtcaaatgggagattcatactgacaagagtccagacttctctacacagcagaattgacagtgacagtccatttcttaaagaaagctggtgtctgtgcttcctgctgtcagtccttaccacagagctcatcgactctggcatcaaaggtatcagcaccatctcatgccaaacctatacgagggaatctaactgcaaaggggctttggaaattgaaaaagtttgattacaaaaaacgttcgaatctggagattaataaccttcaaagttctgaaaacaaaaatgtgagatccatttgtgtgtctctgtgttgaaaaagcaattccgcagacattttcactgacttcaaggttaccttttttaaaaattatactactgctttcatgtttctgttctgctccttgccaatgtagttaaaaattgttccatttttgaaatcagataaatctgctaatttgagtgtgactgtcctcttgtggctgctttcctaggtatattttatagctgacagatgtactgcagctcctatataattaatatcctggagtttctatgtttaaacaaaaatgcttaaatcatattatttaactgttgatcagagataaattaaaattttcatgaataaaagacatttttaaatgggacattgtctcagcatttcttttatcccaccagatgttcattttacctgagatttgttaaatgaataaaccaattaacaattaataaaataattaattaattcagtttatttttagagcaattttaggtgctcaaaaattaagcagaaagtacagagagttcccatacacccctgtcctcacacacagacaatatacccctctgtctatatcctgcaccacagcggtgcatttgttacaatcgatgaacactgacacttcattatcacccaaagtccatagtttacataaagattttctcctaggttgggcacggtggctcacacctgtaatcccagcactttgggaggccaaggcgggcggatcacctgagatcaggagttcaagactacctggccaacatagtgaaaccccatctcttccaaaaaaaaaaaaatacaaaattagccagccatgttggcaggtagtcaccatgtagtcccagctgtcacctgtagtcccagctacttgggaggctgagacaggagaatcacttgaacccgggaggcagaggttgcagtgagccaagattgtgccgctgcactccagcctgggcaacacagggaaactccaactcaaaaaaaaaaaaaaaaaaaaaaaaaagaaaaggaaagaaagaaagaaagatattctcctggtgttgtacattgcatgcggattgacaataataacatgtatccaccgttgcagtatcctacaaaacagtttcactgccctaaaaatcttctgtgctctacctcctcacctctccctcttcactatcccctggcaaccactaatcttttactgtccacatagctttgtcttttccaaatgtcatattgtggaatcagataggatgtatcctttcagattggcttttttcacttagtaactatgcatttcagtttcttccatgtcttttcatggcttggtagctcatttttttgtgttgagtaatattcccattgtctggatataccccggtttatttattcattcacctactgaaggacatcttgattgctttcatgttttggcaattatgaataaagcttctatgaacatccatgtggaggttctagtgtggacataagttttcaaatcccttgggtaaatatcaaggagtgtgattgctgggtcttatggtaacagtatgtttagttttgtaagaaactgccaaactgtcttccaaagtggctgtaccaccagcaattgcattcccaccagcaatgaatgacaatgcttcttgctcggcatcctcaccaacacttggtattgccagtatcttggattttggccattttattagatgtgtaatagtatcttgttgttttagttggcaattccccaatgatatatgatgttgaacatcttttcatatgcttattggacatacgtatatcttctttggttagagatttgtttaggccttcagttcatttttcagtttggttgttttcttattgttgagttttaagagtactttgtacattttggatgataatagtcttttatggaatctatgtatttcaaatatattattcatgtgtgtggctttgttttcttattctcttcatattatcttttgcagaacagattgtttttattttaatgaaatccagcatatcaattgtttccttcattgatcatgactttgatgttgtatctaaaaagttgttgccattctcaaaatcatctagattttctcctatgttatcttctaaaagtgttatggttttgcagtttacatttaagtctatgacccattttgagttaatttttgagcagggtgctggggatgtgtaaagattcatttttccacatttggatgtccagttgtttcagcatcatttctgaaaaactatcttttctccattgtaatgcttttgctcctttgtcaaatgttggttgactgtctttatgtgggtctatttctatgctctctattctatactatttatctatttaccttttttgttcaaataccatactggttcaatcattacagctttacaataaggcctgaaggcaggtaatgtcagtcctccaatgttgtacttctctttcaatattgagttggctattctgtgtcttttacctgtttatataaactttagaagtaatttgtcaatgtccacaaaataacttgctaggatttgtattgagattgcattgaatctataaagttgtgaagaagtgacatgtttgacaatactgagttttcctgtccacaaatatggagtatctccatttatttagacttttaaaatatctttcatcagaggtttgtagttttcctcaatttaaatttatacctaagtatttcatttttgagggtgttaaggtgtaaatgataatatgtttttaatttaaaattccaggctgggcgtggtggctcatgtctataatcccagcactttgggaggccaaggcgggcggatcacaaggtcaggagttcaagaccagcctggccaatatggtgaaaccccgtctctgctaaaaatacaaaaattagccaggcatggtggtgcatgcctgtaatcccacctactcagaaggctgaggcagaagaatcgcttgaacccgggaggcagaggttgcagtgagcctagattgtgccactgcactgcaacctgggtgacagagtgagactatcttgaaaaaaaaaatttccacttgtccacttgtttgttgctagtatataggaaagcaattgacttttgtatattaatcatatattctgcaacctttctacaatcatttattagttccagaaagagttttttagtcaatgctttggatttttgacatagacaatcatgtcatctacaaacgaagacagttttatttctttttcccaacctaggactttttaggtttatatttattgtaatattatttgtactacctcattggattgtcccaataaatgaataggtgtgctgtccatagacattgtcttcatcttcctaatgagagaatgatgggctaagttgctcagattcacatggtattgaaatcagtatttgtttcactctatgctctttcctactacattagactatactgccttccaaggttctaacaagttttgattttaaaagcagcatcacatttcttacttaaattagtttatacatcaaatcagttaatttaatgggcaactttcctaaaatttcttttaagtgtactacacacaaaaaagaaaaacccataaactaacaaaataagttaaaaagcttacaatggatttatgtagtataaaaataggtggcaaattttttggcaattaaaaatgtttgaatgctaaaaactgcaaaacattgatttaaaaaatcaaaggaggcctgaataattggagagatataccatgtttgtggattggagaactcaatactgttaagatctcaatcctttttaaactaatataacgattcaatatgatttctatcttaatcttaacaatagttgtgtaggtactgataggcttatactaaaatttacatggaaaagctaaagaaatagagtagccaaaccaattttcttaaagaaaaagaaagaggactgacaacacctgatttcataacttactataaagttacagttttaaagacaatcttgaataaatggtagacacatagatcaatgaaacagaacacagagaccagagacatacccacacatataggccaatagatatttcacaaaggtacaaacatgatttaatagacaaatgataatcttttcagcaaataacgctgaaacaattagacatccatatgtaataaataagtaaactttgaccctttatttcacaccactaattaactaatatacaataattaatgcaaaccctaaaattatcagacttccagagaaacatagaagaaagtcttcataattctggattaggcaaaagtttcttatctaagtcataaaagcataatccatatatagtaaatttaataagtttgatttcattgaaattaaatgttctgccatggacaagatactctgaagagattagaaaaacaagccatagaaatagagaacatatttataaatcccataaataataaaaaacttgcattctaaatacataaacaacttttaaacaatacaaaataagaaaatagggcttgaaaataaaataaaagatatccacttcagaaaggaagaagtatagctatattctcagatgacatgatcttgtatatagaaaatcctaaggaagacacacacacacacgcacacacacacacactgtatgaacaagagtgactctatttaaatgctaatctgccatgtgactcctgactaaccctaagtctaggaatgcctccaagatgtctagctgatgtattactttttatatagaaatacctgttcactgtaagttttccctttcctccaaaacaacccttgatggtgttgcatacatcataggctatgaggcccatagctacctactcattccttctggagcacatatactttttccccaattcaagcctggactaagggggttgtggtgcagagatctacctatcttgcagctgtgtaagacatgcttccatttgtaagttctcccaataaatcactattttcctataatctagatttgtctgcctcactctttgctttcttcactgttagcctttggaggatgctttgtatatacagccctttcatggaacacacattcacacagcaacaattagagctaaaaagttcagcaaggttgcaagattcaaaattaatatacaaataacaggccaggcacggtgactcatacctgtaatcccagcactttgggaggctgaagtgggcaggtcacctgaggtcaggagttcaaaaccagtctggccaacatggtgaaaccctgtctctacgaaaaacacaaaattagccaggcgtggtggtgggcacccgtaatcccagctactcgggaggctgaggcaggagaatcgcttgaacctgggaggcagaagtttcagtgagccgagattgcaccattgcactctagcctcggcaaaaagaatgaaactccatctcaaaaaaaaaagaaaatatatatatatatacacacacacacaaataacaaattatatttcaatacactgcaataaaaaaatctgaaaatgaaattaagaaataattccatttacaatagcatcaaatagaataaaatttattgataataaaatttactgaataaatttaatgaaataagtgcagactgaaaactacaaaacattgttgaaaaaaattaaaggagatctaaataagtagaaagacaactcgtgttcatggatcagaagacataatattgttaagatggaaatactcccaaactgatctacagattcaatgcaatccctatcaagatttcagattgtcattgaataaattacaagtttatcctaagattcatatagaaatacaagggacctataaaagccaaacaaccttaatggaaagaagaacgatactggaggattcatactttctggttttaaatcttactacaaagataaagtaatcaagatagagtggtactggcataaaggttgacatatagatcagtggaatagaattgaatcttgaaataaaccctcacatttatagttgatttatttatagcaatgtaattgaaaaataattgtcttttcaagaaatgagctggaataaatgggaatctacatgcaaaagaatgaaattggactcttacctaacaccatgtacaaaaaataactgaaaatagatcaaacacctaagtgtgagagctaaaagtataaaactcatggaagaaaatataaaaataaatctttatgaacttggattaggcaatgacttcttataaatgaaaccaaatgcacaaatgacaaaagaaaaaaatagataagctgcatttaatcaaaatgtaaaaccttcatgcttcagagaataccatcaaaaaagggaaaagagaacccacagcatggaagaaaaattttgcgaatcatatatctgataagggggttacatcaagaattcataaaaatgggcaaaggatccaaatagatatttctattaaaaaggtatacagatgaacaataagcacatgacaagctattcaacatcattagccaacaggaaaatatagagaaaagccacttcacccccacgatgatggctataatcaaaggcaaatagtaacaactgttggcatgtagagaattgaagccttcatacactgcagatgagaatgtaaaatggtagagcctggcaccactgaaaaacagcttaatggtttctctaactgttaaacatagagttatcatatgaccgaaacccagaaatgccactcctacatatatacccaagagaaatgaaacagtatatctacacacaaacttgcatatacatgttcatcagaattattcataacacccaaaaaagcagaaatgacccagatgttcaccaacatatgaacagagaatgaaatgcagtacacaacagtatacatcagaactgggcataagccggaatgaagtactgatgcatgctacacataggtgaaccttgaaaacattatgccaagtgaaaaacaagtcataaagaccacatattgtatggttcctttatatttaatgtccagaataagaaaatgtgtagagatagaaagtagggcttgaaagtagattaatagtttgatagattaatagtagattaatagttacctagtttcagggagatagaaaaaatgttttaaaattgattgtagtgatagttgcacaactctgtggaatattggaaacaatcgaaatgagtgaattgtataaaacatgacttatatctcgataatagatatctcaaaaaagatcattgatatcatttgtaattagggaaatgcaagttgaagcattatgagataatattacatacatattaaaaatggaaaacagaacacacacaaaaattatcaatacgaaatattggcaagggtgtggagcaactggaattcttatacattgttagtgggaatgcatgtgccatatgactcagtaaatccgcttctgggtgtctacaagagaaacaaatatttatttacagatagaaatctatactcattcctcagtctaaacgttgccagtccttctgtctctaaactttccctctattctcatctccttttcctaattcaacttttaacccccaaattctctttagttcatagtttagaagcccacttctcaaaattggaatgtttaatcctaaactaattcaatctgcatataagttcccataagacccagtaattacaaccatacacaattgccatttacttttatttagctcctcctaaatgctaggattcaaagaggtagagtatatttcttctgattgtgattgaatctctagcaccagcagtgcttctgttttatttttaaatttatttgaagaacatttgcccttttgcaagcataatgcaaactttaaacatcatattgctagctaagaaaaatttaaagcaacatagataattctcctttgacacaatgatctgactagaccaatagctggaataaaataatgagaggaagacattagagtgaaaaaagaggaggacaggaagagagatcatttgcagtacacagtcactaggctgattcaaagcaccaaagtgaaactctctaaggatgtttcacttttatattggaacgccatatataatttcataaaaatgtcaaagtgattttgaaaactcaaatctcttcaagttgcttatacttaagacaaagcgatcaacgcaattcagagtaaatttgactttgttttttagtgatgggagcatttcttaaaaagcatcaaatctaacatttctatcttgcagaaatcaccaagcctagttaattttctcatgaaagggactttctgggtatacacagctacagatttaactaggtctaacatacacatgaataatcctttgcaaggtcccccttcctctctcctgacccctaccctaacattgcttgcaagcagcagaggagataaggggaaacagctgatctcctctgtgtttctctaatccacttcaattcacctcctaattcaagataaatcactacaggaaagaaagctgggaggaacccacttccctaaatcaagttcccttcctgtattttactagatagttgcaatacctgattctcaccaaaataacgtcctctagatcttatagacatctttaacaaaaatccaccttgttgagccttgtcttttcaaaacttgaccctagagcagaaattgcaaaactagtgattcttggcattatgtattgtcataagtgatgggattgtgtttttgctttaattttgctttaaattgattcagctctctacatttcaaaacaaacaggcttttacattgaaatccatatttcttagttcttttgagaaatgtgaatgtctgtcaacactaggcctgcattcatgcacagcaataattgactggggacgagtagaggccaacccctttagactgagtgtatactcattatttcagcacagcctcatgctcctgagccctttctttcactcattacttcttggtaacctactgtaagcatttgaattttctgtctccaccttagggctgagagggggctgagtgatagggagtggcaactctaaatgcattttagattaggaagaatattcataacaaaatgcccttcgagtctatacttctattaggaactcaatagcctattgaggattaagtaaggaagctaactagtatacatagcactggttaaaagacaaaatggttccaatcaacttacaaatggactacttgtactttctcattagaagaagatgactgattttcttaggtcttgtgtcctgggctaatcgctaagcaatagctaagcagttacttaagagttagaaagaatgactgcatgcagattttacaggcagaagtgtgggcttcccagctctctgcttctctaattaaggaaggtggaataagaagaaatctaatcaactcagaatttttgcagcctgatgtactcaatagcaggtctcttgtccaaaagcgttcagaaaggtttctcctctcttcatttaaataattaaacatataaaacttgggctcactttctacttttaaatttattatgctacctttatccctttaatctctggcattgatagaactgagctgatatctacttttccatatattagctgtgtgatcttaagtgagttgcttaatttctctcagctagggtttccttatcagcaaaatggtaataatagtatttatctccatcattgtgagcattgatataatgaggtaatgagtgtaaagtattttgcatgattttggcacagattactaaatattttattttcctttattttcttcccttttcttttctttttattatttttaaagttattttcatcctataaaagccataaaataaccactcctgcagtatgtctggttaactagcctcttccattcaccatcaaattacctacatgtatgaaacaaataaaagaactctcccctttggtttttagaactttcaatgccaggaatggagaaaattattttaatctcacatcttccatttatagataatgaaactgaattccaaaatttagtgatttgttaaaagcacttcagcatgggagtagaactcattcattttaaaacacaaaagacaaaaatggaatgaggctttaaccagcagggttcagtatatataagccctaaagagcacgtcgtagggactcattatgcttgtgtttaattgagtggaatagtgaattgattaaaaagaacagatcatccccaaagtgcatgatcaggctgatgattaaaacaaagtttggtttcaagactgggattattcttcagctagttgtcagttagcatgtttgcttgttacctcttgaccaaataccatgttggaggtcaatctggggaagttttcaagttcagagaagtttcacccaccaattaattgtatatcaaaactttgggccgggcatggtggctcacgcctgtaatctcagcactttgggaagttgaggcaggcagatcacctgaagtcaggagtttgagaccagcctggccaacatagtgaaacctcatctctactaaaaatacaaaaattagccatgcgtggtggcaggcacctgtaatcccagctacttgggagactgaggcaggagaatctcttgaatccaggaggcagaggttgccgtgagcctagatcacgtcactgcactccagcctgggtgacagagggtgagacttgtctcaaacaaacaaacaaacaaacgacaacaaaagaactttgggtacataattttagcagagaattttgcacatgacaacttttgacctgttaatgttgctgaaaaacaattctatctgaaattgaaagttggatacaagggtccaacaacatatacatttgaaaattaccttatgaagtgaaattttcaaaaggaaaatgtcaccgcttgtcagagctatctgaagattcaggtgatctcttttcaggcaagatttttgaaaaaaacatttagagaagaaagggaagacaaatgtttcctgaacgatgatgtccacactgtgtggcatttggtactttaatgtgttcgtattcattggatcctacttgcttcaggttgcagtggaacacttcttttacaaggcagatataagagatatcaagtgtttttcctaagaacacctagccaggattcaaacccaagtctgtctccatatttcatactttactcaataaatcacgttgttgtccacatttcaagattttctatggggttaatagatgttcgtttattcaataattcattcaacatttattgaacactgcacttactaaatgtcagactaagaaacaaaaacaaaggttctagacagtatgtccagggtccagcacagtatatggtcacaataggctttaaagacatatgtattaaattaatgaataaagacacttctgctctcaacttgctcattatctacctagaactgcactgtctgatatctggccaccagccatgtggctattgagcacttaaaatgtggccagggtagattaagatgggcttcaaatataaaatacatcccaaattttaagtcttagcataaaaagaaatataaaatatctcattaatggcttttatattgattatattgaaattatagtgtttggggtatattgaattaaatgaaacatattaaaaccagtttacctgtttagttttttactctttttagtgtggatcctagaaaatttaaaactatacatgtaatttctttcaattcctattggccagccttaacctagtgctgttaagtcctggggcacttgcttttctgtttcaagttcattattaaaactagttctattctctctcttttatgtatgataataagttaggtttaaatgcagtttattttaaatgcaatctatgtttgtgagattagaatcaattgttaaaggttagaaatttttgtattcagatgcaaaatagtccacacgcaggctctactgaaatatgacttccctttagtccctttcctggtgagaagctaccacagttctccagatatgttactgccagctatacaagaggaagtctaacccgtgcagcctgataatcaaatatttaaggctgttcaactgcctctatcccatctcatgctcctgccaacttacctatctagatttcctttctacagtattcctggaacacaggaatgagcactgtacctttattcatgctgttatctctacttggagttttttgtttgtttgtttgtttttcaattccaatgcctgcctagttttcaaggttcagcttattgtttacttcttgccaaattcccaaactactataatcccatataattttctcttttctccgaattctaagacactaacattccatttgaaaatatctatacttgattgtgggaaggctcttacttttctataaatgaatcattacccttttcttatattccaaagaccgtaagtagaaaatttataaagaaatcactacaacatggaaaggaactcaccgtgcatttggttaggcttttaaaggtcatgttcagccacatctttttaacagtaaaaggactaagatgctgagcagtttataaccaagggagtgggcagtcacaccggtgtgctctgttctacataagtaaagcattcccgcctatagcatcccttccctaccaaaacaggagagctgccaagatgctcacttagaacagttgttggtttgtgtacaagtgttaagtatgggtttgttctttttcttttatatttttttgagggaaagaagaaggaagaatggaaggggactggaaaagctgtatttatttataatcaaacatatccttatttgataacagatgaccaattaaagcaatgtgtgaaacttgaacagcattctgtcaaaaagcaaagaaattagcagagctcatagcaatcagcacttcttgcaaactgcaagagtcccctctaaagccttctgtcttggcactggggctttgctaaatagggctcaccattttgcgagtgggaacaatcagctttgtaggtggtagggaagtattataattaaatgtccacccactttttcctttctgatgaaaggctcccatgaaacttactaaaataaggtacataaagatagatgaatttttgatgagtaagtcaaagcaccgacaaacctggctttccacatagagaaaattctttaatttatagaaaaatttcggcctagatcattaatactgtcatatttaataactaatacgataaaatccatagggtaactggagatttcactgttttcgttggtagtgattgtagtgctcagcatgaattgacttgcagaaaacaaatataattcaaaaaaagagtgaaatttttcaaaattgattttagagaaatattaagtgatagccatttaatcataatagcctttttaataataaataatgcatttattgaatgtaatggcattcttccgaataatagttatagtaccactttaaggttagaaactatatctctgatatagcaaagggcttgaaagatgttattgaattgtcagaaactttttatgagggagctctggaacagagtctatagagtctgcttttgataattaatggtaatggcatttactaaaatcactgtgaataattaattttaagtacttatatgcagtagagtagggagcttctctgctttataactgagctcagacatatatttcaagtccagttactagcattcacaaagtcaatattttagaaagaaaaagaaattaaaattaattggtactatgaatgttttccttcattcaatgtggatttattgggcatgagctgtatagactttgctatcagaggagcctcaaagcaataatcctctctagaactaatgaatatttttatttttaagctaaatttcatatttttatcttcctgttcaatagattttattggcagaagccagtagagataacggtgccctaaatcaccaacaaggtgagatcaaagtactggggaggatatgaacacatttgtcattaattgaacacatttgtcattcattgctaatcactatgtgaagatgacttttaaaatactcctgacgacttcttatccttccccactgtggttctgtggatccaagaacacagagtaactggatgctcaaagtaggaaaagtttgcataataggtactcagctcagcataactaagataaaattagccacaaagatctagattctccagttactggcactatccagggttttataaccatcattacccatgatcattttatagtaaactacaataatagatgtggtgacacatctgaggtctcctcctgtattattagtatagcgggacacctcagatgtgtcaccaccaaggaacaggcatgttcagaccaaattcttcggccactgtcctcctcattcccgtttgtttttttgaattccccagaacttcttgtttttcaaattattacccacatacttttttaatatttcattttctgctttgtgtttagtcctactttttactatctttttgtaaaagttacacgttaaccattatttaaagagttcctttaacagtgtggaggttttcttcaaagacttgatagaaatctttaaatatgggcttttttctcatttaagtcttacttcaacatgttcactgattttagatttctctgacaaacatggttgaggtatcaaaacaaagacatgttgataatagctttttctcaaagtcatttagaatgtaagactttctgccgtgctatgtcaaattgcccaacttgggaataagatgagtgtatgtgcatgtctgtggggtggggtggtagggagcaaggaagtaggggattggtaaatagtctatacaaggagaactcatattgtcctctaaaactgatatatttaggctctcctattttccacgagtctatcatagacacttgtgtctcaatgtttgtagtaaattactgatgattttctctgttgctttggttaggaagatcctttcaaaaacagatttttctgggagataaatgcagtactttttcttcttcatgagataaacacacacacacacacacacacacacacacacacagagagagagagggagagagagagaaagagagaaagagagagagagaaacaacctagtgtgcaagcagtatgcctaaaaatcatttttattttctcctgttataggaatctataagtctgtaagtctctcagttgaaaaaaaaattgttacatcatagaatttaagaaacttggaatgaccttagatattatcctgtctaactttcactttatagataaagcaaatgaaaccctgagaagagtagtgaccacaaatactttgctattccttctattgagaaatgtagtctcactgctcccttttcctgtgtctgggcagtctctgtaattggtttgaccaatagaatacaaatgacaactgcagcttcctaattcttgcttgcatttgggacttctcatctcagaacccaaccaccatgctgtgaaaagctgaagctacatgaagaagccatgtattgatgcaccagtcgacaaccacagctaagcccccaactgacagttaacgcacttccagtcatgtgaatatgccatttagcatgtccggactaggccaacctttggcaggctccattccctgccagtatgtgacagcaatcacacgagaaaccttaagcaaaaattgcccagctcttcccagtcaacccatagattagtgagagataacaaatagttgctttaaatttcaggatggtttgttatatactaaaagctcatcagaaatgaaagtgacttagaccaaaacttctaagcattaccagagtgaaaaccagaactcaaatatcaccccaaacctcgtataatctcattataatgtgttaaggaaacatgtcgagttaaatgagatccagtttcagtctcccaatagttcataattccaaaagattttattctttcaaaattcacatggaatgcagaatttccaaaattcttgaactttaaaacaaattcttagagctgtgtctacataacagtaaaccatcatttggtataaggtagcattcccaagtgttcctcgaaggtagtgtcttagtaatgtgccatgaaagaaagagagataagctgatttaatttgtttaaactaaattaaagaggtctctttgcttcaggatttttcaagaatgtaaattttccaagaggagctatagatagtacttattttctgagaattgttcgaccaaggcacccttcttcatcaaaaaactaaactgagaaataggaagaggaattcaattttgtcagcataaaccaagttttgctttcagaggatttcataaaaagaagttgttttcataatttggtgtgtcttcagcttagagaacacatttttagataacacttttatgactgtcagggactgtgcttagttatgtcttttacaacctgttcccatttcttcccgccttacttttaacattctttggtgtctacagttaataaatctttctggaatgtgtagacgaaggaataaataaaagcagataaataataaataattcaattaattaaaaattatcctgaaatgtttcattaacaatgtcaatgactatgaagaggcccaaaggtttttgagtcaacctctcatttagtttaataacctggaaattagctccaactctaattagcttggtttgggttttatatctttatttacatctaaggccaattgaaattgtaacacttgccatatctaacagagttcttgggaaattcaaagaagatttcaaagttggaggtggaacggctttgggctacaaaaattgtagcaatcatgtattcatccactcctttcatcttctagttctggagattgagatccagaaagagagtttatagcgcaaatgctagctgcattggaaacctcctccccgtggatccacgttaaagatgttaggaaagttctctttttcagtagatgttatattgaatggtgtgattctaattcacgtgctgattattagacagactatttacaagcatttgggccgtaaaaacatatttgaccacagaattcatgactggtataggaaggtgtggcagtcaaaacatttaataacccatatggcatggccactgacaaccagagtagacaccagccatgaacaactggtgcagccatgctgatgagtatgagccatactgaatatcatctgagatctatggatctagtagataacatttcccacttcttgccactggtttgtggccttgtgaatactttcatcttatttgtattagacattcctccattcaggctgtctcttaaatatacttgtgttattgacatccataatacagtaagttctattatctctctcctgggaagctatcagcacttcacagctccttcagcaatatgctatcctgttccaaaaatcatggtgcattcccatgtctctagtttccaagcagagggaataatagttttatggtcttcttttgcccctgtggggacatgagccagttcactacccctacttacttattcctggatatctctaccctgtatattcctatattcttgttctgtagtcatgctacatagttaaatatgacttgaaaggctgacagagtaatgcagctacaaaaagatggcagagaaataataaaataatatgtgatagagtatttgatacttttaagtcagaatgggaagaaaatatttgtaaggataaatcaaagtattctgcatttagccagttcctttgtgaagctctaataaaatatgtgtttaaaaaataagacaagccaatgtggagtgatctatacaatcggacatatacaccttcatattactttggccagactctgctgtatttgtaacacggtgtcaaaagtttttatttaggtacaattcaaccataaatggagaatgggagcctcattctcctggactttagtgagttacagttctagcatgcttacctctacaagcctgctggtgtgttcatgaaatatcgcagcatattcttttatttccttttcccggccattcttagcagcttcaatgagaaccaaaagagggactgtcgtatccaggaaagagtctgacacatgatctataatagccttgcggagctgagaagaaatgaaaaattcaggttttttttttccaggaaatagttcactgtgtttccttttcttacaatctcagtagttacacaactcatttttcatttttgcacaattcctaaaatcacaatacttaaagatatacaagaatgtcccttaagaaactaaaaaacaaaatatccaggcaaaaagaaaaaatcatctagcaatatttcctttcctctcaaaagtaatttttcttaagttgtatttaacctggaagtcagattaaaaatggtaatactttcttttttgctcaaagaaattgtgttattagaatatttatgagtgtgtacacataatattgtacatcttgtatttttataattacaaattatagaatgttttctaccttgttggaggaactgatgataaattttgattagctaaattgtagacttcatagtaattaagccaagttagatcaccgattatgccagttgataacagattaatagagcaagaagaataataaatgagtttgatgtccaattttccccatttgcattcattgttcttgccctcacactttaaattattaaacaactataacattctgctacaattagttcttttcaattagattacatgtaagcttattaatgacaattaggcaattactctagtcagcagatattttctgagatttaaaactgcactgaaaaattaattcattgtgtttatataatatcgagtctttaaagatcataatatcgggccaggcacagtggctcatgcctgtaatcccagcactttgggaggccaaggcaggcgaatcacgaggtcaggagttcgagaacagcctggccaacatggtaaaaccccgtctctactaaaaataaaaaaattagttgggcatagtggcaggcacctgtactcccagctacttgggtggctgaggcaggaaaatcacttgaacccaggaggaggaggttgcagtgagctgagatcgcaccactgcattctagcccaggcaacagagtgagactccatccactccccccgacaaaaaaaaaaaaatcataatatcctgaaatgtttcattaacaatgtcaatgactataaatgggcccaaaggtttttgagtcaagaccttcatatagttcaataacctctgtacaataaaacagataaatagctgtcagacagaaaaatgtaatttttctgtcaaagttacattttagagtatttttttaaaagaatagacacttagtttagttttagattacttgggaatgaatagtaatacattttgggagagctgaatgatagagctaaatagaaagtactgtcttctataatgatcatagaataataaatccataataattacaggtttctggaagaaaaatatctctgcccaaaatagtgagcttgctcagaagcattgtgaaattttctgactatcaacaatttaagaaaggcttcaggaagatccccaaggaaggattctgcttagtatgcagaaaggcaaattactagtggcaactaatatttactgagcacttattaggacaaagtatagagtgccaaggggttacaaggcaaaggggagaccttaactgaatgaataatgtgtttgctgtctataggaagtacaccagggaagtcaggcgtaaggtcacgaatttatttgagctgggaactacaggttgtgtaagtttcagatactgaagagaaaagtagagattccttctaatttctcagagtgggggcattttttaatgattatcctcccctttattcttttcttctttcattcataattaggacatgtagattattcttttcttctttcattctaattgagacatgtagaaggaaagctcagatgaaatctacactagagatatgccatgaagggccagcatatgggaactaactcaagcggagagtgtggatgagaccatatagagtgaggagacccacagaggacctcttaggaaacactatcatttacaggagtcatgattaaagagtagggcctaaaaagagactgagataatagccaagaaacaaagagacaaattacccacaactaaaagacaaactttcaaatatatctctgtgttaatgctcttcaaatgtagttatcctaccaaacataactataatattcccatcatggacttgttaaatcttctctgctgtgtaaatgatttcattcaattcagtaaatatttctggaaaccatttcctcacctttctaccaagagaaaggtattgaaggaaatgttaagatggaaattcatgatcccttataatctagtagaagagtgaatattacaataatacattaaacattacaataaagaaaaacttagagactgacagcaaaaaaaaaaattagagtcaaattttaaagataaattaaattaaaaaaaaggaatgagacttgtcccttgggcttgaatactaagaggttattgataaacttggtaagagcagtttcagtggaaaagtgggctgaagagtcctattgctatggtttgaagagtgaatgagagataaggcagtaaagacagtgagtataaacttctgtttttaataatttgattgtgacatgaagaagcaagacttggtatttactactctgagatatatgtttaaagagtgactgtttttcatataaagacttcactataatttcccatctgcaactatagccaaaaagtcttattactcccctttgctttgctggaaatacatattgatttattgccaaagcaagaataacaggtgaaaaagaactattgtctcacattgtgccaacttttgtcatcttttcgtcccatgacagaaggaaatgcccagaaatcagtgacttgagctggatgtgaatgaaacctttaggagctagcacatggtcagaggcagggatgtatctctcccactgaaatcatcttaacccatgcaaaaaacaaagtgtaactaattcaaccaacccacaatattctcaccagtctaaccattctccctgtctaacttgctggttcctgatcctttaccttcactattatgaactacattatagacttttggtgccttatatctcatcctctggatctatctctgatttcagcttttgctggggggaacagttccatgtcctctgaagacattccatgcttcttgtgtgccttccttgtgtctctttgttattctatctcagggcctgttccaagtctctgtgaaattctcaacccagcataaacactgcctggaagttcttcagcgtccacaccactgggggaaaccctcaacctatgcggatagaaactactgcataaaattcctaccctccatccattagtcagacaattctgggaaacattctgttattctcagagatcctcaagctctcattgcctacagcagcaatctcaatagcatatcatttcctctttccctgcctcgcttttcatgttctataacacttgcttccaggaatcacctcctaaataaatgacctgcactaaggtcctagttttagtcactgctttcaggaaaacccatctaaacaggtacctttgtctggtattaatgttgtttgatcatgcaccaagtaagagactccaatgtcttatgtaaactactcattgctaattatactctactaccttggctctgtacatcactgggttttgttctgccatgccctgaattatactcactgtaaaagaggaattattatgagacaggactagaaatgtaggtagggacaagatgtgaaaggactagaatgttatgctaagcaattttcattatatgttctgacatattcatatggaattgttttcattaaattgtatagtcatatatacctacatataacagcaaagtagcctctatcttatttatttccgcattattttcctgcccagtggcacaatgcattcctttcagttgggtgatatacaaaaagtttaaagaagaatgcaatatgccaatatagaaatggaagccaaagcactaaaatctgaagttagtgggaggccaataggaattacagatacatactttcaataaatacctgtttgtggccaggcatgaaagatgttagaacaaaaccaaactgaggtgcttttcatcttttctcactacagtttaataaaaggctttgagacatcaatttttctatttcctactgatgtaagtggtttgggatctcaaaataatatatatcactacaattgaagcccaaagtgaaagccctatgtgaaaagtctaaaaaagccccaccattcccaccaaataaaggaacagaaagaatgaaattgtgatgggaaggggaatggaaaggggagaaagtgtttcagaaaggaatcatcttcagggaaacagaaaaatacatttagactaaaatattttatgttaaaatattgtattaaattttaataaattaacagtatttaaattttaataaatattttaaattaaaagccattttaatttaaatcaaatagcaaaatgtgatttttaaagcttggaattaaatgtactaataattatttcactgtgtatgtactatgtaagtttagtgaaacttgtctcttgtggatacataatgttatttgatgatgaggatgatgaccaggaggtataaaagcctacatatttttttctgagtggtgaactggtactatgcaacatggaagagagatggacctaacaattcagaaactcagcaactaaagaattaatcaagtttttgttttgtctgtttttaccaaaatcccatttgacatacttcatctttactttgatatttatgaaataaaagacatttttcttaatatacacaaatacaaattttagcctgcctttagtgaaatcaaatatattttagtatgtatagtaaaatagaaataagatatatttgttgcttaaatttttttataaagtaaagaatgtttaaaaagtcttcctccttttactgagagagttgcaataggtatacagttttcaaatgaatgatggaaaaagaggctaaagaaagaagaaaatttaactttaaaaaggcatttaaaacaaataataaagaaaataatacatgatggtaaaatcagtgtattaggcactgggaggttctgaaagtgaataggccataatccctagcccctggtgtggtgattacacatatgggctggggttggatggacctgggctagaactgtgtctctatcacgtagctgggtgatgtttgctatgttaactcattttgggggacaaagataacaataccatggcattatttattgttttaggaataaaaattaataatgtaatgaatatgcttggtagagagctttgcaaagcatttagtaaatgagagatgttgtcatagctatcattataaggacttaaaatgcagtgggaagaaaactcattacaaaagaaaaaaatagaagaatataatcattgctgtaatatgcacatgctgtaagtgttccaggaagaaaaaggtccattccagctggtgaaaacagcaaaggtttcatggaagcaatagcatttacactactctggaatttagttgcttatgagttggggttgtgtgtaaggagagtgagtggggaaggcatcaagctgtacaagtcatatgtacaaagatgcaagtgtatttgagcgggaggtgatgcaaattctggtaaataacaagtagattctttcatcagaaaacaggttaatgtgggccaggcctggtggctcacacctgtaatcccagcactttgggaggccgaggtgggcagatcacaaggtcaggagttcgagaccagcctggccaacatggtgaaaccctgtctctactaaaaatacaaaaaagtagcagggtgtggtggcatgcatctgtaatcccagctacttaggaggctgaggcaggagaattgcctgaacctgggaggcggaggttgcaacgagccgagatcacaccactgcactccagcctgggcggtacagtgagactctgtctcaaacaaaaaaaaaaaaaagagagagagagaaaagaaaacaggttaatgtgttggtgtgatgaggaggacacaacactgcgaaggagagctgaaggaaaaggaacattaagaataatggggattaagtcagggccaaatcacagagaacctagaacaccatgccaagaacatttgtctttgttctctagtaaaacaggcaagaaagtcacagaggaagaagattgaaacaaataaatactctcgcctcctagaacattccatcttgatgtcctcaaatctataatttgcttctccttagatatttctaagcaatctctgtcattcctcttggaagaaatccaatcaccctctgaactgaagctgaaatgtttctgcattactgatagaaaggccatggttaagaaaggggataaggatgaatgggcaggaagatgggctctgcttattttttactaaaaaaagttttaaaagataaaaccagttctaaagcaaacgatgaacattaaatactccaaagaaaaacattttaagggcagtgctttctctttcctgtgagaagaactatatgtgagatgcttacaacaactgttggataaacttcttaagaacaagaagtagagataacttatattgctgttttaattaactgtgacttctaccaaaaatgtaaacatcaggatgaaaaataaagtactagggggagggtaagtgaggataatgagaaagaatcatagcaactaacttcatcaaaacggaagatcatggaggtgttcaaagacagcttctaacaattccatccattcctgtacacacataccacttctcctacaacagacagaacttctgcctactcctattgaactgggacagggtttttgactgttttttacttacagattatagaggaaatagcattctctgactttggagctaaggcactaagaatgcttgtcagcttccgtctcccttttcttggcaacttgaaacagcatgaaagagatctaggctaccctgctagagattgaagccacatggagaggccctaaaacattaggcaccgtatcgagagagggaacaggaagaagcactgaggttccaaacatcaagtcccaaatctagccacagatgccatttgactgccactatgtggaaaaccacaagtgaaaacggtacagaaaatggccccgctgacgcccagccaacccaagacatcgtgagatgcaaatatcgttgctactgtttgtggtggtttgttaaacactgatagaaaattgaaacaatggagatgttaacctgtgaaaccatacagaatgttaataccttcagagcacagcagttttctacaagatgggagtatcttcttactatgaagaatagtattagtaatccccaatgctatttctatatctcactgatggtagtgaggtggaaatacaagtaggattgcaatataaaatacaagatgctcggttacatttgaatttcagatgaacaactttttaaatataagtatgtaccatacaatatttgggacataattatactaaaccatgtttgttgttaatctgaaattcaaatttaactgggtgccttgtgcttttatttgctaaatctggtaattccacacacaagtaattgcattttcttgactttatttagaaaaataataattctaaaacctttagaagtataaatgtagattagctctttatgcataatgttgttgaaggcaatatagagggaaaagacacgaacgagagacacaatcattgagagctcatagagacaacttttctgagtcctaggtgaagcagatggggtagaaatcctgaagacgatggagaatagggatcattccacgaaaggggaggatcgctctgaggatataaatttctgagtcctggtacaggttctgactcggtgccccatcctcttaggcaggtcacctcaccacactgacctgctttctcatttgcatcgtaagacaggttgtgctaagttccttctgactcttacattccatgattacaagtgtaaatggtagaaacagaattcacattaagggcataaagttgagaaactgagattttcacagacttcaacattatgtttttatgcagctattattaactggctggagatctctattccatttccaaatctacgtccaaattaaaagattgcttagccattttactaaatcttgccattaaactacgataatacattgcattaaaagttcatagttgaaaagctttttctcccttttgatgagttaatgatgaccaagtgaaagttctgcatgagaaagaactctggttattgaacagaggaaaggaatgaagagcaaatgtctttgaaaatagctaagtcttcctatttctggaaaaatgtttaacttgtggcatcatactagacttataaattgtttaatgaaattctttctaatcccatgttcctgatgacttaaggttaaaaagaaggcttaacttttacaaaaactaatttttgaagtatcatgaaaaaaaatggaaggaggaatgggtagggtctctgaattacttactagttaatcatttggatttaagcatttggatgatgaactctgatgtaatacaatcaattgatcaacattccctaaaaacttgctatgggtcaggcacttacatgcattttattgattcctcacagccctattgcatattattaatttcattgtataggttcaaagcagctcagagagctgaaatatgtgccgaagatctcacaactgatgagaacagaaccagaatttgaatgtaattctgtctgataaggcacacattctttctctgctttgtatttgccacaaaaaacatttgaggtatgaatatataaatgtggaaagtatatatttactctttttttcctgttctaaattaatttgaaaggaacaaaacaagaaacaaatatgcctgcaatgaataacagtttcatttagcccctatgtttctgactccatatctctctcttccctcacctgtctgcgaaggtctcttgtcttcttacacatgttgtctaaagcaatattcagggtattactcctttctttttttccagcctgcaaagaagaaaaaacgacataagcaatggtatcaattaatctttatcacttagcaatttgctttctaaatttcctgaaaataacagcttgaaattcaagaataggtttcaaaactgctatattatatatgattcatgagcatttcacttaagactaagtagaatggtgattaaagctcacattattttcatctttatgcttctgtaatatttccgatacggagttaggttgtattcagtgtgacaataggcagagcattatcttcatgaaactctgatcttcatttttaacaagtcaaatcttaaatcactaagcaggcaattagcttaaaagcattagatgcccaatttgtcaacttctgtgggagtttctaaagtcatttccatggtgtattgtgtaagttatgcagagccatattggaattttgctaaacactaaataaagtatgcagtgcaaattcatacaatttgcaaaagttgaccacaattttagctgacaatattccaagaacaaattgttttaagtaagaactggacgctgtttttggctctttaagataatttgtgcaacacctttttattctttgagcagaacagctctctgttatatccttaacctaaatctttaggctattaagcacatagagagtcaccttggttggtattttctacatattatttttgtgcaagacaactggattaaatctaatcatactttttgcagtgatatctcacataaaagagattggaaaaatcattatgtgattcacctctaggaaaattgctgctgtttaaattaataaactgaaaagggatcttgagagaagaccttgaaaatcaggaaggcaagtttaagcagctgataactgaagggggttacagcacgaactcaatgaaaaaggacactgaggccaagtataaaccacgaggaagcatgtctgacactttccccaatgactaaactcatgcataaacccataccctgcagtggactccctaacaagaaatttaaaaactctctatactctgtcctaacctacttttttactcttatgtactgctatatactctcctttacagtagcaatattcctataattttctgtctcttctccccagttcttacatgtaatgtacctttgatttcagagatcatcttctaaaacacctactgaagtcctatctactcctcactggtttctacagggagttcttccaacaaccctgctcaaaagtaaagtctcacttttcctttttccaacagcattttgagtgtttttcaatataatcattttatttatgtgcatcccccttatgatactgttagaatcctgatattggcaaatatatctcaattttttttctattcctgatagtaacttacataggacttatcaaatagagttgactagactataaatgagcaatttaattcaaaacacaacatagtttgattagaggcctactgttttccaggaaggtgtcattctagagactctggaggagattttagcatttagctctcaaggcacagctaaagttctctatgagctgaggttgctggtatctacctcaaactcaggtcaacctatattttcccaacagcagtgttactgatatttaaagtgtgaaaaatggccatcattggagatcattcgatacactgcaagatatctggcattcgtggacccaggtctgctaaattcaataccaaatctggcgcactgtgacagccaaaaattggcaccacatatgttcagctgcctcctataggaagacacagtagaaggccagtaagtctttaccatgttttagtttcttataaagagattgtggaatgtgtacaccatggaaactgtgtctagggaagagagaagtaagaaaagggaaataggagagatttggttaggttatttctatgagcactaataacattctggatatcagagcaatggcagcaattacacagatgaaagttgtggctaccttcacagctcctactcagcattctctatgctagcagtggggaattatgaagagctaactcatgactatacaggacaatggcataaacagatacacaatgagctctcagacagtttataattttacctaaagaacccagcccttattctctagcttcatgcagtgtttgctcttggttgtatcgctttccacttcatgaaagcagagataataaaaaagaggcagaagtgggacagacaaagagacctcctacacacacacacacacacacacacacacacacacatgcacacacacacacacacacacagtatcaggaataatatgggagactcctgttgtgttggctgtaaaaacccgctagcttctgtggtgtgattcatcagaacaactaaaaaatgtcagctttctcagagctagcagcagaagcataccaaactttaaataaaggatgacaggaggtgacagcacaaagagattcaataggaactataaaaattattccctaatttctacccagagcttaaccctagtttaaaatgtttcactgggtcaaagacatttcattgtctaggcaataataaacagtccctatcatgacaggaagtttaaaggtctcccttcttgcttttttctcccttgatcccctatccccaaccacaatcacctttctactttttcacctccggctttttattggatccttgctctatttatctagatttatttggcttcagtcaagccattttatgcctctttattccttttgcatagcataaaaataaataaggcaaggagaaatagccccgtcctgcttaaaggccctcattccttcttttttcaaagccttaacaaatcatcaatgagctcggactaaaggtgaattctgtgttctgagacaagagatggaaatggcaggatattaaaacacaactgcagataacagtcagaacctgcctatatcccgagtgctcagaaaagagactgctccttaaagaaatccttgacagaagccattattaagtcagcaaatccctgctaatggaaaagggaccacttacagtggagtgtcaggcagatagacactcacatggcacaggtcagcactgtatagggaaagcagtcacattcttcatctgtaaacaaactgccaagaaagactttattaaaaaaaaaaattctgggccgagtgcggtggctcagcctgtaatcccagcattttgtgaggccaaggcaggtggatcacctgaggtcaggagttcaagaccagcctggccaacatggtgaaacaccatctttactaaacatacaagaattagctgggcatggtggcgcatatctgtaatcccaactacttgcgaggctaaggcaggagaattgcttgaacccaggaggcggaagttgcagtgagccgagatcgcgccactgcactccagcctggcaacagagcaagactccatatcaaaaaacatttaaataaaaataaataaaataaaatagtaaataagaaatagacaaccaaaaaatcccaaccctcaaagtgcttactccctagtggagaaacataaggtctaattatgtccctcctttgctctaaaacccttcactgtatccctactgatgaaattaagaacaaagtcttgatcattgtgttcaaagcctcatataatctacttctgtatttactaaaccactaataagacaccttaatgggtcttttctattctctgcaatatgattacaactcaagaactctgctagtataaatacctctcttttcatttcttgtctcttacttttcttgttatggactccttccttccttccttctttcttttctttcttttctttctctttctttctttccaaatgttttgttctgttgcccaggctagagtgcagtagtgccatctcggctcactgcaacctatgcctcctgggttcaagtgattctcctgccttagcctcctgagtagctgggattacaggtgcctaccaccatgcctggcttatttttttttttgtacttttagtagaggtgggttttcaccatgtcagccaggctggtcttgaactcctgacctcaggtgatcctcctgccttggcctcccagtgctgggattacaggcataagccactgcacctggcctggttatggacctctttcaaggtataactcagttactaaattttacatagagcctttgttgatcttctcatttgcaattaattactctcttccatgatactttcttatagttcttatacttcttttataacacttggtttaataaataggtcaacatagtcaacaaatctttatcatctactatatgcgggacaccatgctaagaactagtcgctgcctttcaggtgcacaaatctagtgatagacataaacacagtagtttatagaggtacctaggataacacatggattgatgagagcagcactctcaataatgatgaaggaagcattcttgagtaggtaacaattgagtattacaggatatataaaagtcagccaggtgaagagaagagaaaaagcttatcagggacaggtatagcctgagcaaaggtaaaggtccttaaagattatttggttattagtaaaagtgttaggagaggcctgatcctggaggtctttgctatgccaagaaatgagcttaaccctatagacaactgggagtcatagaagttaagaaaatgaatgatacaatcagtccattatatcaaaccggctgtggagtctgcacaatggatttgaggagatgacaagcagaaatagaagcattaaatggtcacagtaatagtccacagagagatgaacagtgttgaaactaatgcaatggcagtcaggataaagaaaaaccacagacttaaggactctataatagagtaacctgggtaggaggatgactggcagatgctggcaggtgaaggaaagagaacaatctaggctgatgtcctggtttccagcagtgacagctggctagatgatggagttgtgaactgaaattgtcatttcaaggagaaagccaggtcaacacaaggatgatgatttcagcctgggaactgctgaagggctcataaagagctcatttcattagtatttgtcctatgcttaattacttacctgaatgtgtctttctcactagatggtatgatccttgaaatataaaaatatcttacatatattttgtccctcaaaggatctagcacagtgctttgcacatagtaggggctcaacagttatttgttaaataaatagagaaatagaagactggataaggttttggcagatcccattacgtttctgggccttaatttccaaacccataaaatgaatatttgtcctaaattgtttctatattcctttctaactttaaaattctatgaaagggccatgttctctaaaaggaagaattgtagaataatatgttacttttattgcacaatttcttgcataaacagccattgaaaatatgtcaaaacatgtgtgtgtaatacgaagctgaaaataaaaggagacgtttgaaataggaaggccatgatgctcaccctataaattatgaagcctcaaacactaagagatgaggtttaaagcaaataaaaatttatctaattcatagtcaaatgaaaatcagtgcagaggagccctgtgtggaattcaaacagcaggaaaatgttttttgttgttgtttttgttgttgttattgttatgttttatttttgttttgtaagtgtgtgccattttattcaaccttttaaaatgatgcattttccttttaatggtaaaagatgaaatatgatacccttaaacttagttcttctctaaagaaattgcttgaaaaatagtttatgcttagcacatagcacaggcacagattctagtctacatttttcaggcatgaaagacacacaaacagacaagtataagaaagaaaaatgaaatctctccttctagaataccactgtactgaatggcgtatcaggaagacacctgatggggcatgctaaatgatctgtcagaaataaggtctataatgtgaaaatacaactaaaacaagccaaaaattaactctgagttttgaaatgaggtttttaaaaattaaccatataagaatagaatgatttagcta

SEQ ID NO: 892 - DNA, 243522 bp, Homo sapiens
accacagccagatgaataaatccatatgaatactgaaatacacacatactctgagcactaatacttttcaagaaaggtaatgatgcaggaaaaaaatgtctatgaaatagagcattttatagagttcccaaatttctgtctgttgaatctcccggaagtggcattcccctttcttgcaataacagacgattgctcaaatgcctcataagaagcggtgggcatcgtcaactggggggctttggttttgcagagggacgggtttacttttgtttgtttgttttgtttttcagacagggtctcgctctgtcacccaggctggagtgcagtgacccctgctgattgcctggcgtaatacaaggctggacctacaggaagactgactagcttccttcgagccaatattcttttttactttttagacacaggaggctctcgcggtgtgcccaggctgacttgagctccgaggctcaagggattttcccacttcagcctcccaaatagctgggactgcaggtgcacaccatcatgcccagctataagccaatatctttacatatgtattccacacttatttagaggggtgacatccggcattcagtggggaagacaatagtggtgctctaagcctttcctctgttgcctgtaaccaattagctcttgctccaaactcacacacttcactatacgatcacacagtgcatgattcaatttacatgaaatgcccagaacagacaaatctatacagacaggaagtaaacttgggcttgcctaaggctgggggttggaggcgggaggattggggtgatggctaaggagagcagtgcttcttttggcgataatgaaaatgttctgaaattatagagatggaagcacagctccgtgaatatattaaaagccattgaaccatacactttaaatgggtgaattgtatagtatgtgaattacatcttaataaaactgttaaaaacccttcaggctgggtgcaggggctcatgcctgtaatcccagcactttgggaggccaaggcaggcagatcgcatgaggccaggagttggagaccagcctggccaatatggtgaaaccctgtctctagtaagatacaaaaaaatagccaggtgtgatggtgcacgcctgtaatcccagctactctggtggctgaggcaggagaatcacttgaacctggcagatggaggttgcagtgagccgagatcacgccactgcactccagcctgggcaacagagtgagactccatgtcaacacacacacacacacacacacacacacacagattcctgggccccttcctaggaattcaatgtgttgcatgggtgtagatatctgtattttaaggaagcactccgagtgattctgatgctgtagggcatgagacaggcatttggaaaccaccatacaaggcttcgcttcagagataagacaaaagcttcctttgtttccacatttccctatcagtccaacttccttgtagaagcagcaacagggaccttccctccttacaaggccatctcaattattatatggaaattccattttacagaggccaatggtaactttccagtataaacataacagaaagccttggagacagtgtcaaactgctgacctgctgggcctttcttattcgctggatgaatctgggacttcaaacaatcactgtgcctgaactaacgagggggctgtaaacatgcctgcaagttctcccagctccccttttggggcctgaaaatttatctcttcgcagtgagcggaaatattttccttagctgggtcccctgttttatgcctttgatttacagaagcttctcaacaaataaatacaagttgactgttaggtcacagccttttggagagctttccaaaagccttcaagagtaagggagataaactggaacaatatttggaaaataatcccagttgttttatcactttcctgggggctgagacgctgattggatcttggcccctcaccggcaccctatgaggcagacagggcttcattagctgctttctgcatatagagagcggagactcagagaggttaagagggttgcccaggattccccagctggccagtaggaaacttgtctgggaccttcattccagatttcaaggacctgggcttgctgtgttgcctaacagccataaatattttagagaagcctgctgggatgtaaggaacttcagagattttagcccccaccatttagccacagagcctgggtttatggagccactaattcattctgacagtgcctgatcacccgcagagcctcagcagggagatctacacatttcaaggatagctagctcaggagttctccccaatgcccattctaggccatctcagagctctgctagactcgctctccctaccctcaatttctcctggaaaaagcaaacatgaccaggtttatttgtaagcccaggtggttcatccatttccaagacagtcaagacctggccattaaatcatacttgtgtttgtgcgtgcacgtgcgcgtgtgtatgtgtgtctgtgtgcgtgtctgtatgtgtatgtgggctttgtttgtttgtaatgacttcggtttaagaaggctgcttttggatcttcctgtctggcctgagtgtgggacacaagctagcgcttgctgacctgaatcagcactgtgccgctgtgagcataagtctgcttactcacggacagaagagaagttcatgggctttttcgggagcagcctcagctgggtggtaactgttgctcacctccagaagctgggggagcttcagcagccacctaaggcaggcacctctcagcgaagaatgaggcagtctgtccccagacgtttccactgtgtctctagccacaggagtctcttgtggctggagagcccatgtgtgctacgctctgtgcctctgtgattttctcctaccctcatcacagtctacatggtatatatcccaatgctcacctatggatgagaaaacaggctcagagagaggagagaggcactagagaaatccctgctagtgcagtgaggactacaaaggacattccaagaagtgctaggcagtgtttgaaaggcagattttgtttgggggggtcagaaaatgccttgtgaggctgggcaaggtggctcgcacctgtcatcgcaatgtgggatatgatgaggtttctctttaagcattattcccaacaccaacactttgggaggccaaggcaggcaaatcacttgaggtcaggagtttgagaccagcctggccaccatggtgaaaccccgtctctactaaaaatacaaaaaaattagccaggcatggtggtatgcacctgtagtccaagctacttgggaggctgaggcaggagaattgcttgaacccagaaggcagaagttgcagtgagccaagatcgtgccactgcactccattctgggtgacagagcaagactctgtctcaaaaaaaaaaaaaaagaaagaaaagaaaacacctcatgagcagcagttcctttttcagcttgatccagaaggatgactaagggttcatgaaggtgcaaggcaatgccaggcgggaaagagcagccaggagatgggcggagactggcgaaaggcttgtgacagggtaggatgctgggcacttaaagagcaccagcatgatatgggtagaaggagaaattaccaggaaaggaggacagaagccagactaggggaggccttagaggttaaagattttggatcattttgtgacattacagggttagtttttcagatgaaacatggaatagcaggaccttatatcacactcttcctatgaggaaatattccaagtttcacacgcctgctttccaagggacttttggatcacagcagctgattcaggggatgaagagtggctttggacatcagttctcctcttctcatatccacgtgtcttctcttcctatccacattgtaaattctttgagctcaaagacaccgtgctttgtagaacatcctcccctcacaacccactccccaacagccttaattatgtactattaaagtaaacaatttttgataaggatgacattaaaaagataaggcatctaatggttctatactggatgaaaataaatgcaatattctatccaagcttaacatgatatacaagagatttatttttttgtttgtttgtttgtttttctgagacaaagtctcactctgtcacccaggctagagtgcaatggcacgatctcagctcactgcaacctccgcctcccaggttcaaacgattctcttgtctcagcctcccaagtagctgggactacaggcatgcaccacccctggctaattttttgtgtttttagtagagacagggtttcttcatgttggtcaggctggtctcgaactcccgacctcaggtgatccacccgccttggcctcccaaagtgcggagattacgggtatgagccaccatgcccggccgatatacaagagattttcttaaactgcagggtcaaaacatgcttcccttataaaaggtgtgaccagatagtaaagagattggtttccatcctccaaaaacaaatatccatctgattacagtgacatcatgtatagagtaatacatctatttcactatgtaatatgccaagaatgaatttacgacctgccctatcactgaaattgcggtgggggttcaattgggatacactaggttgtaagagttagaaactcaacttgaattagtttaataaaaaagtgaatttctgggaaggattctggtataatgaggagaatgagggagatgggatgtgtataaaggcagccccaacatggttagaatgagcccttcccaggagaaagatctctgaacaaaaaatcaatgttaactattaggcatctgctatttagactttgagacttgtttctataacgttattagaagaacacagtgtggtaaaaatgaaagtcactttttggggtcagacaaaactgagtttaaactgctgatctgccacgtactagtgctaagaacttagcaaatcacttaaattctctgaacctctttcttctcagctaggaaaattaccatttaaggatttaatgagagcatgtataaaagaaaatagctctgtgccagacactcactaagagcttaataaacgttgcccccatccttcccttcatttgtcagggaatgaagattaactacctgtattaaatgagccaatatggccgggcgcggtggctcacgcctgtaatcccagcactttgggaggctgaggcaggtggatcacctgaggtcaggagttcgagaccagcctgaccaacatggtaaaacccagtctctactaaaaatacaaaaaattagctaggtgtggtggcatgtgcctattgtcccaggtacttgggaggctgaggcaggagaatcgcttgaacctaggaggcggaggttgcagtgagctgagatagtgccactgcattccagcctgggcgacagagtgagactccatcaaaaaaaaaaaaaaagccaatatatgtagagtactaggacagtatctgatattcagggtaagaatgcaataaacattagctgccattatcatcattttgataatatttgcatttccctataagaatatccctaaatgaatccaatggcttctcatactgcccaccttcctgggggagaaaaatatttttaaaaggtgacccggcctggcgaggtggctcatgcctataatcccagcactttgggaggtcgcagcaggtggatcacctgaggtcaggagtttgagaccagcctgaccaacatggtgaaatcccgtctctactaaaaatacaaaaattagctgggcgtggtagcaagcatctgtaatcctagctacccaggaggctgaggcaggagaatcgtttgaagcagggaggcgtaggttacagtgagcagggatcatgccattgcactccagcctgcacaacaagagtgaaactccatctgagaaaaaaaaaaaaaagaaaaaaaaaagcagatgaccctttttctctatcctgttttcattttaaggctgggaattgtttttgctctgcagtacccaagaggctctggacacttagtcaatattaattaatgatgtttttggtggtgtgccaggtttttgacactaaacatttttatgccaacttcgttgaattaaggtagaattaaatagctgtgctgcaatcctgtctcagctgtaatcaccatttgctttgctcatctttcccatgctattcaccccacctaatcagtccagttttattgcatttacgtagattgtattgatgcatctgctgaagctcctgcaggaataatcatctctcatttttctcttctgtggctgtgggtattggaagaccctgtctctccctcagctaggacctgagtagaacctgtggtgaagagagtgtagagaaagcaataggctttgcaaccatggtgagttaggagtgtcagggctttgtttaccctgagagtttacctaggttgaaggctgtcaaagaaaactttcctttaacgtaaaagggtgacatggacatggttcccttaaagcggcttctcaggtggaagatcacaacctcttgatggcagtggcatggaataaagcgtcttagtgtctcctctagtgcctaatttagtcccttgatcaaataacaactacagtaacaggaggaggaggaggaattaacacttatgaagagctaggcattattctaagcacatcacatattatagattatttatgttcagaacaactctatgagatggttactattattatccccattttacagatgaggaaactaaaacaccaagaattaagtaactcgccaaaggccacccaattattatgtgggggacgtggctcttgaacaacaggagcacactttggagtccatgattgtggatgttgggtaactatttatttggctattttttttaattttttttttatctgtagagtgccttttaaagttttctctgaaagaaaaaaaaacagaaacagtctatagtgggccaaatatggccttagatgttaacgcgtgctttattttatttaattgtcagataattctgcaaagtagatgctattttgctatttttgtgttttggtttttgggtttttttgagacagagtctcgctttgtcacccaggctggagtgcagtggtgtgatatcggcccactgcaatcttcacctcccgtgttcaagcaattctcctgcctcagcctcccaagtagttgggattacaggtgcccgccaccacacctggctaatttttgtatttttagtagagacggggttttgccatgttgaccaggctggtcttgaactcctgacctcaggtgatctgcccacctcagcctcccaaagtactgtgagccactgcacctggcctttttttgttttgttttgttggtttattttatcctcctgcctcagcctcccaagtagctgggattacacttgcaagccactctgcctggctctattttctctgtttttacagaagaaggctcaggatcagagaagtaaagaagtttcatgagattacacacctagtaatggggaaaggtgagacttgaagcatcatgtctgtccaactcaaaggccatgattccatgcatttcctaccactgccagctttgcaccagggatggaaaactttgagtcattttctgcaaagttttcacaacactttcctttggggtatattcaccaggctaagcagatactattatccaggtgcacatggctaaaattactgtacagggagagtactgtccaaaagacccagaaacctcttttctaacagtagacaagcagctctattccaatatggagcacaattttagccataagtaacaataccaatcattacaacaccttatatttttacattataatttcattaacaataagctccttacatttttatgatactatgtgcctgacactcttccaaccatttcatgtatattcaatcactgaattcttacaaaaaccctatgagggaggcctagttttcttccgtttttagattgggaaactaacgcacagacaaacaatttgccaaaggtcacccagctaggaagtggtagaagcagacctgaccctaggcagtgtggctgtgaagtctgtgcactcagccacgggctatgttgccgttcattagttaattatttgggaaatgttagttccgttcctctctccatagattaggcaatggggattaatgtgagaattaacgatgtgtactgcatcacctgatatgtgtactgaatgatttaaagatttctttgtagggtgtttacatatacaaggcattgtaccaggctgtgagaatgccacacctgccttcaaggagctgaaatcagcaaaccagcaaatacaacaccatgtgataaagaattaatatgggaaatggtggctattctcctttcaccgtctattctctgtatctttctgtcaaactcaaggctcccagagaatggcctgggctttcttgccctctgacttctggttaggtgcagcctatggacagatattggaaggagaggaaaggagagggacatcagagtattcattccccagccccatctcagccttcttcagtctagcagtgccgatgatcttctctggctatgacttctgctggacgactctgcttctatggccccagctcccacgagggtgtcagtaacaccactctctccatttgctccttcaggcttaggggtatgaatggcttctcaagttttctggttcccagatgcctcagcattccttgttggtttctataactctgagtgtaccgtttgcttcctgtggggcccctgactgttatgaagggtaagcagaggagataataagaggagcattcaggaaagatccctaatctagacttggagggagacgggaggctgctcaaaagaagtgaaatctgtaactcctaaaggatgatcaggaattatccagtttggggaagtggaggtaggaagaatatgctaaaaagagagaatgacaagtggaaagatacgaaagcaagagcataaaatactcccaagaactgcaaagtgtccgtaagataccgttcaaggtagagagcggtgaagaagcttaagtaagcacctccagatcatgaaggtggaacttttctttttttcttttttctttttcttttttgagacaggttcttgctctgtcgcccaggctggagtgcaatggtgcgatcttagctcactgcaaactccgcctcccagatttaagcgattctcaagcctcagtcgcccaagtagctgggattacaatcacccgccaccatgcccggctaatttttgtatttttagtagagatggggtttcactatgttggccaggctgatcttgaacccctgagctcaagtgatctgcccacctcggcttctcaaagtgctgggattaaaggtgtgagccaccgcgccctgccaaaggtggaacttttgaggtttgtctgaagtttgctgatgaagttttgctctatgacttgtcatgtaatcttccctttgatttccttatgaagcattcagtgaaatctatattgcttaccaaaagttctgaagttgggtttcggagtagccaagatgaagtgctgaggctggtctgaaggagctctcggaggtaatttagcaataggtttgagattgcgctgtcagattttgaagtttatgaggccacccgcatcattgctaatgtgtgctgtgtgggtggagaatggatgaggccaaaaaaatttaggacaaatagtttggagatggagaatcagcaaagaaaaggttgagaggagaaggcagctagaactcaaacattataaaagaaggcttgttctccgcctctgcataatccttagtaaaatacgcctgggttacagcaaatgctatttaaaaaataacactgagttctgactaggagacatgagacaggcactctctctccctgctccttcattcttgcctttttttgtggttctagatattaagcaccacccttgttggcacctgtgttgcccctgcagatgccttgctctatcagttatctccatagccccttgttggtcaacaccctcttccacactgctagtcattacactcattatggcctcctggcttctggtggttaagccaccttacctctattacttcagggctccatcatccctatccacattaacaagcccaactcagaccatcttctcaatggctgaccctgacctgcagtggagcaccaccactgaatggattagcagtgctgatgccccctcaccagcacattccagtgccctggctgaagggcgtgtcctttgggccctccaagggttgctcctctggtggatcttctagcttgacatgaaatagccatccaagcatcctactcgccttagcctctgtcccttagcgttcctccctcaagcatcttcagggcaactcgggcatgtccctttgcctcagtgttggccattgctttgccaggtttcccggagccaaccccacagtgaccttgccccatccctggaggctgtctgtactttatctcagtctcttgattgtctatatattttcttttctttttttttgagacagagtttcactctgttgcccaggctggcgtgcagtggcatgatctcaactcactgcaacctctgcctcccaggttcaagaaattcttgggcctcagcctcccaaatagctgggattacaggcgcccaccacaacgcctggctaatttttgtatttttagtagagacgaggtttcgctatgttggccaggctggtcttgaactcctgacctcaagtgatccacccaccttggcctcccaaagtgctgggactacaggcatgaggcaccatgcccagcctaaccacctgtatttttgaaattacttgtggagtttgatactgggaatacctttgattgtgtgagtctaacttgagaacccagtgatttatgattatatatatgtgtgtgtgtgtgtatacacacacatatatttgcatatattatatatacaatatatactatatatgacatatatagtatataaaatatacgctatatatgacatatatagtatattaaatatacgctatatatgacatatatagtatataaaatatacgctatgacatatatagtttataaaatatacgctatatatgacatatataccgtatatgacatatacggtatataaaatatataccgtatatgacatatagtatataaaatatataccgtatatgacatatatagtatataaaatatatactgtatatgacatacatatagtatataaaatatatactgtatatgacatatattatatatgtttcaggaaaatatgaacactgactagatatttaataatattaaataattattgtagaggtttttggtgtgataataatcttgctgttaggtttttaaaatatatgcatatacaggctggacatggtggttcatgcctgtaatcccagcactttggggagccaagatgggaggattgcttgaggccagctggagaccagcctggccaacatactgagaccccgtctctacaaaaaaatttttttaactagctgggcatggtggtgccacttgaaggccccagctactggggaggctgaggtgggaagattgcttgagtccaggagttcaaggctgtagtgagctatgatcacattactgcactctagcatgggcaacaacgtgagaccctgtctaaacaaccataacaacaacaacaacaaatatatatatatatatatatatgcatatagaagtgtttactgattagagtatttgatgtctgagacttgcttcaaaataattcagtgtgagagaaagaatggggggcatagagacatagatgggccatgataattattgaaactgggtaatgtgtccatggaggtttattatagtatcttccatagtattatatacagtatataaaacctttaaaagtttgaaattttccataatacagagatttttaaaacactaaatcaaatttaaagcaaataataagatacctgaaatgccacaagggtgaatatatatatatatgtgtgtgtgtgtgtgtgtgtgtgtgtgtgtgtgtgcacgcgtatgtatgtgtgtgtatatatgtgtgtgtgtgtgtatatacatatttttttttttgaggtggaggcttgatctgtcgcccaggttggagtgcagtggcgtgatctcagctcactgtaacctccgcctcccgggttcaagcgattctcctgcctcagcctcccgagtagctgggatcacaggcatgcaccaccatgccgggccaattttatatatttagtagagatgcggtttctccatgttgttcaggctggtctcaaactcctgacctcaggtgatccgcccacctcagccttccaaagtggtagaattacaggcatgagctaccatacccagccaagggtgaatatatttatatggagtattctaacaaccatatatgaaaatatgaacttgactacagaaaaataacatagttcataaataagacattggtagaaggagaaacaatattaaccacaaaactggaaagcagttttcaaccctccactcagtaaaatacaaattaatatagaaatattatattaactctttctataaaataggcaaagaacagaaaaaatattgaggcaaagtatttcatagggtgaagaaaattcaacagtttaaatttttatctttctgcaaaccatttttccaacatacttatcaaaaaatcttaaaactctgccctactacttgacccaaagtccagcttctgtgaaattattcttagacaataaacatagatatgtgtgaacatttaggtatacatatgtgccataagtcattgtttaataataatgaagaccgggtgcggtggctcacgcctgtaatcccagtgttcgaggtgggtggatcacctgaggtcaggagttggagagcagcctggccaacatggtgataccccatctctactaaaaccacaaaaattagctgggcgaggtggcgggcacctgcagtaccagctacttgggaggctgaggcaggagaatcgcctgaacccgggaggaggaggttgcagtgagtggagacggtgccactgcactccagcctgggtgacagagcgagattctgtctcaaaataataataataataatgacaaaaattttaaataatataagaatactaattaggattgaacaaaataaggatgaagggtgacctgcatatccaacaacagaaaatcgttaaaggaattgtggtattatatacagatagaaacacacattttatccagacattacatgagactatgtaatgacaaggaaagatatccaggaaaattagataaagaaagaaaactggaaaggaggactaccagaatttttcatttgtgtttcttttgtagctctatagaggaacaacaacaaaaatggaatagaagaataagctctaaacattaaacagggataatatggtgtggagaggggtagcttatggatgttttatttttcttctttttatatatctatatttcctaaatgttctgtaacagacttgtattactttaatgacattaaacaaaaccatctgttgattcaccaatccacttcgaggaatctttcctaacaaaataaccaggaatatgatcaaagattattagcatagtctctggagcattatttataataggggaaatattgtgagtaatccaattatcccataataagagaatgattagataaactattgtattaagaattttttaaaatcgcatatttctgagaaaaggttgattgttctataaccacggtaacaagtaccattataaccaggttttaaactctatcaatcaatgcaacttgcttcagtgaacgtgctttgacaaatcaaccaatcagtgatagtctcttacatatgcaagtcagccaatcgggaacagagttagtctaatagatgagcttctgaatgccaaccaatcagcaacagtctcactggagtaaccacatttctagagttgacgtcaatctacttatatccctgaaaatcttccaatccctgaactctatgcttccccaaaatccagtataaaatcattattctgctaagccagattctacctgaccagcatggctcttccttaccataataagcaataaattcagctttgtgttatgtggtattctgtgtgtgtgtgtgtccgtccctgtatgtgtgtggagtgtgtgtgtgtgtatgtatatacacactgagggagcacacatacacatatatacgaacatagaatttcatacattcattgaaaattttgttttcaaagaccacataatgacaagaaaaatatattcaaaatatattatgtgcaaaagcattgaatacaaaactgtgtattgtacagtcctaatgagagagagagacaggagaaaatacaccaaaattttaaaaaatatatctgggttgtgagactatgggtgattttcatcttattttttccttatattttcaaaaacctccatagtgaccatttatcacttttataatgagggggaagactttcttaaaaagtcttggtttagcattatagccctaaaccagttaattttaaatgtcatctgaaaagtttagaacctccttatgagttcttcttttatgattctttcattgataacaggctatgacattaagccaaaggcctccattccaaatatttattgtgtgcttgtgtaccagacaccaaataaggcacacagacagctgctaagatgatgtaggatgaagctgggcatggtggctcacgcctgtaatcccagcactttgggaggctgaggcaggtggattgcttgagcccaggagttcaagaccagcctgggcaacacagcaaaaccccatctctacaaaaaaaaaaaaaaaaaaaaaattagccaggcgtggtagcacatgccttgtagttccagctacttgggaggctgaggtgggagaatcacctgagtccggggacgtcaaggctgcagtgagcggtgattgtgccactgcactgcagcctgggtgacagagtgagaccctgtctcaaatcatccctcagatgatgatgtttaatgatgtaacaccttcctgaaaactatatggaaaaggacattttcattaattggactgagcataggagactgtgttttcctatcaagtatgttcaaagcttattattagtggggactatcaatgcagcaagtaaaggcaagaaatgcagtctaggtgtttgttaggcaggactatgagtaatggtctataaaatacaacaaaaaaactgggaacgacctagagtgtgtagtagaaagtgaaaaacaaatgttaatttcttctactatctttttctttattttggaggagagagctttggcttcttcttttcttaataaaaatagtgtcaaggtcctaattgcatttaattaagccatatttctagcactgagaatgcagaaggatacactgtagcctgctgttctccatttcctaatgcatgcaagcagctctaaatgagtaagaaatgatgattgaatattgtgaacaggcacaatagttaatctcatgtgaatagacagtaggagtggaatgtgtttgtcttgggtttgttagaaagattttcatgatcaaacactgaaagaggattttccccattttcttcctgctgacaatgcatcactgatagtttgacttaatgaggttcttagatttaataaaatagaaaaaggcagtgagccatttcccaaaatgacttgaaagaaatatttggcagaaataattgagattcagagagtactggtccatagaaccctaccaattcctaccaccctggactatgcccgcttgctctacattttctgctgattttagaaatcaccccatcgctgcctgggtggcagtaacttcccttaatagggccatttatcataaactatgagttgctaaggaattaatcaaaattttccatgggtaagcagtaacttgagagtctgtacaatccttaataacgataccttagctttgtataatctgctggagtttacgtagtgccttcatggacctttaaccattcagatctcattctaatcctgtcaagaggggaccagtatcctgactttacagttgaaaaaaattgaggctccggaatccttaaatgagttgcctaaggttttgcagtgagtaaatacatggtagcattcagacctaggtgttatatccatgtctggtgcttgatccaatctagctgaacaactatccctaaacgagcaaaaaagattctgatttgaggtctgaggaccagggatgaagtcctggcccttgcctcttggtagcacatgatgtaaggcatatcagttagcctctctgaatcatagttttcttatttgaaaaacagagacaactgtgctgctatcaatttattctcattactcagccccaaatccaccctttattgcctgctttgtgaaactgcggcttcctgagagatgcaactgccacctggccatttggggtgacttgtgccactgagccaaccagcagaaaaaggtgttactccatgggctagaatgattgatcctagttaccaagggggaaattgagctgctactacacaatggggaagaggaaccatgtctggaacacagaggattatctagagaccctcttagtacttctatgcacaatagtaaaaggtaatagaaaactatagaaacaagcaaacaaaaaaaaaagcaacatgactgaggacttaggccctttgggaatgaaggtttgggtcatttcacccgataaagaaccttgaccatctgaggttctgcctcagggtaaaatgaatataggatggattctgggaggaggaaatcatagattattccatggcatcttacagaaatcaggactgtggtcatgtgaaaggaaaatatcttaggcccccaaaatcactaaggaaaactcaagctggaaactgcttagggcccacaggcctcccattctattcaaagtcatccctctgctcactgagatagatgcatatctgattgcctcctttggaaaggctcatcagaaactcaaaagaatgcaaccgtttgtgtttcacctatctgtgacctggaagcccctccccgcttcctgcctttgcttcaagttgtcccacctttccagaccgaaccaatgtacttcttacacatattgattgatgtctcctgtctccctaaaatgtataaaaccaagctgtgccctgaccacctagggcacaggtcatcaggacttcctgaggctgtgtgctcaaccttggcaaaataaactctctaaattaactgagacctgtcccagattttctgggttcacagtagctttgcagattttctccttacttgttatatgtgtatgtaaaaagtaaagtaaaggttcctcttcaaagagactctcctccctgactaattaggaatatagtaacttctcttagaagcaaaatttatttaaagacctgtgctaacattcttaaatatctgctagccgtaataaaaaaaaatcaatgtactttatgttcttagctcccacaatttagccttaatatttgccctggcatgcttatactggtccaagcaagcattaggtcatagcctgttcctcttccatatttggcggtgcttttacctttctcagcattccccaagttacttcctccttcctttgttcttctctgcctttgcctcttttagaaagttctaagttgctagccaattgggacaaatagagaatgtgaggtctcgttccagccaatggaaaccggacatagcagtagggtggatgtgtcaggttataaatgaccctttattcggtgtactttcgtggcaaaactgctggcaagtgtaccctttctgcagaaagtcaaaatggccttgctgaggaaattaaatgtatgttcaaatgctatttctttacggcactggggcacaagcattttattactaaataagcatttcaaacagtatatattcatttgtatattataaaaatattcttttctctccttcccactgttattttatatctaaattgttggaggttaactttataatttagtgttcaggtaacaaaatattcactggggcccagcgcattggcacaccctgtaatcccatcactttgcaaggccaagatgggcagattgcttgagcccctgagtttgagactagcctgggcaacatggcaaaacgctgtttcaacaaaaagtacaaaaattagccaggcttggtggtgcacaccatagtcccagctactcaggaggctgaggtgggaggattgattgagcctgggaggtcaaatctgcagtgagccatgattgcgccactgcactccagcctggatgacaagactctatctcaaaaacaaacaaaaattcattgggactgtgactgaacttgagaattattactattgggattgtgtgtttccttattttgaggaaatggtgaacacgtgttcatttttacaaagggaagctgtattatgttaggtgaaaacatagaggtgttttgttttcatgaaggagttcaaatgtttgtaaaagggtgcatatggaagcgaagaagccaaagagatggacagtgccccttttcaactgatcgcttttcagttctctttgttgttctgctttgtgatactgtggagctggaccctatacatgttgacctctgtcagccagcactgtgtacagctttgtcaatagagagtgccatagggactctgcaggtgcaagaggcttctttttccagttccagtgttattctttcccacttgctcctatggcacataggatgcatggcacgtatatagaatggccagggacattcatactcttgcaagtttggctggcacactggtgagagactcatggttccctgctcaccagcctcagcccaccagctgataaccagctctggcctgggacaactcaacaaacttctcctctatctactgggcaacaggcacactcctacctgccacaaggtgtgagacttgacctaccttccaagtttgttcttttcttggtcactctccccgactcttaggttattcttcagagttctcttttatctcctcccagtcccagttgctagttccttattaccagttgataactctttatattacattttttctcgttaaatttctgatggtatttctctctcctgattgcagcctgactgatacaaaaatgatattgattttgagtatttcacagggttattatgatgcttaaataagctaatgcacagagaagcacttagaaattttttaagaatttggtaaatcattgtataaatggtctcaatgtatcatccttcttttattcatgctactttatagcatgaatcactgatgctaagattggtcataacatttgttttggccaatggacatctacacacatgatataagtagaagtttggtaagcatttgtatactgacatgtgcccctgaacactgccctgacattgccatgtgaagaggaatagtctagcctcctagaggatggacaaccacatgctgagtgaagcccagccctaagctggtagaccagtggggtgcagcttcacgggtaagcctaagcaaggccaacagaagactcactcatttagcccacagaatcacagaaagaaaacattgttattttaagaccctacatttaggggtgatttgttgcatagcaatacattatggatgcaagtataactgaaacactaactgaaaagatatataagttaaaatattagtaaaaactttttctgtggtaagtgactgaaatctaacttaagctagtgtaagcacaaaataatatgtattggtttacatagttgaaagtccaggagttggttaagcacatagttagatccgtatgctcaggctacatcctcagggatcagccgtcttaccttcatttcctgatcttctttcttttatcctcaggcagacgttgccttcatggtggtaagagggattccagagtctcttatgtcctcaaagcttcaagctcagccaaaagaatctcgatggtttccacaaaaaatcttgggccttggatcaactgcccacccttgaaccaatcctggtggccccaggctgattggcagacctgaatcacctatcccatgcccagaactttggcttgaccaggctcatccaaaacaagggaatccagagtgtttccccaaagaaaatcagggggctattactgggaaaaagaattccaccacaagtataaaaaatactgttatcaataaaacatcacctgatactttggttcattaaagatgtattactttggtttttcttggttgggaatcatttggataccaagaatataaatactcttgacttaagaaatgagaaagtttatcagaagcatgcaggatactcctgaatccacaggcaatgtggctaggtgtcatgaagaattatatccaagaactagaaagtcataagagagtcttttcttttttttctctctctccccctccacaattacatggtcttttgtctctgcttttcattgatattaatttttaactctctaatttctgtggggaacccattctgcgaggtttggttaaagctgacccaacttcctgccacaggggcaggctcatctctcagaccagccaatcagggtatatcatctccctggccacagtgatgaatctagcttgatcatgtgatccaagctaggtcaattggagtcctcctgggacctttctgccatagtgatcctgagtcctttttcctcaggggttcctaagttaattcgatgtgtattgaatttcatggccatcatgcttggcatatggaagagagcttgtttgcgagcagagagaagaaaaacaacctaatgatagaatttgagatctcagatccaaccatgacgtgaagccttaggtcttttaattgcttgagccctggggtggtgcttcaacttggcctaacttctcagagtcggcctaactttgctcagttgctctaaggttgtactatttctcttgggaacaaaaattcccaaaggaaagagaatttatgagcagtaactgtggaggagttaattttttaaaaaatgtcctcaaaaaaaggtgtaaaaatatttctttagtggagaaaggctctttcctttccacctggcggcagccatccattaaaccaaggtggatgcatacaagcacatccaggagctatgcaggaagaagcagtgtgatgtcatgcactttcttttgagggtccactgctggcagtactgccagctctctgctgtccacagggctcaccgccccaccaggctccaccgcagcaggcctcataaagctggctgactgcgctacaaggccaagcaaggttatgttatatgtaggattcgtgtgcgccgtggtggccaaaaacgcccagttccaagggtgcaacttacagcaagcctgtccatcacggtgttaaccagctaaagtttgcccgaaaccttcagtctgttgcagaggagcgagccggatgccactgtggggctctaagagtcctgaattcttactgggttggtgaagattccacatacaaattttctgaggttatcctcattgatccattccataaagccatcggaagaaatcctgacacccagtggatcaccaaaccaatccacaagcacagggagatgtgtgggctgacatctgcaggccaaaagagccgtggccttggaaagggccataagttccaccacactgttggtggttctcgccgtgcagcgtggagaagacacaatactctccagctccaccgttactgctgatataagtaaagtttgtaaaattccttcctaatacacaatttaggacagtccaaaaaaaatatttctttaaagaggccctactctttaaaaagaactccaatggaaagttcctcttatattccagttgtattagtctcctattgctgctataatcaaaatgcaacaaagttagtgacttgaaacagcacaactttgttctcatacagaggtcagaagttaccagtgggttggcagaactgtgttcctgctggagaattggcttccttgctttttccagctaccaaaagctgtccccatgccttggttcagggcccccttccggaagtggcatcatcccaacccctgctttcatcaccacatcttcttttttgatattgagcttccttcttacctcatataaggacccatttgactacattgggcccacccaggataatctccccattgcaaaccccttaatttagccacatctgcaaagagccttcaccatgtaagataacaaattcacgggtttcagggattaggatgtggacatcttggaggagggcattatttaacctaccacactggtggacttatttatttatttatttattaaaaaaaatctgtgttacccccaaaatgttgtaataagaataatgagaaatttggagtcacctgtttagaggaaatgtttgtcttctaagtcaaagtgtataactcaaataatctgtcattctgctttatcctgggtgaggaaagacactggaatttcaagcacatttaattcctttgtaaagatgatactgctcctacttttcttaaaatatactcattttagttggtatttgtgcagaaaagtaaaatgcagacagggacaagaaaagatagaaatacttgagaaaaatgtagaatagaaagggcaaaaattcacaagcaacttctttgcactgcttcagaaagggagggggagaaaaagagaaacagcaaagacataccacaaatatttgccattctcataaaatggaacttgagtggaaagtataacctctgacttggtggatggagagggccagagaaagcttcttttttcttttatctgaccacatttcaaaacaataccaggcaataattgtctcttagagtaaacggcaaagggaattgatttttaaattacttttaaatcataaaatcccacaattgtaactgcattttgggtagtcatccggcagtataccaggaactttactggagaaaaaaatccaggaaggcattgagaagcactaacaaagcatgtctctgttgaattgatgttaactcttctccttagtaattgagttctcatcctaggaaaatattatttatgagaggtgaacattttttttaaaaggctgccctgaaagaatagcagaaactatgacattttttaattttataaaaccatataaagagatgcctgacaactttgatgattggaagctttaaaaccaaattaaatctataagcaggtttttctcaaaaagaaaaggcttgaattcaatatacatgttctacatttatgtcaatgttctttctttttttgttttctttttaaatttatttttattttatttattttttgttttttctttgtaatgttctttcttcattaatggaaactgaataatttctgagtgaattatctgaaaatcaacttgccaaatgccaatttacagaaatttaatttagccaatgataatttgccaaatatgcaattctccaaatttatcaaacatatggatttatttaaaaaaacttgcttttaataattatttcaatgtcatttcttacttttcaaacactaaattaacattaaagagtatcctaaaaaaacaagaagtagcttataaaaccctaccatgtaataaatgctaacatttttagttctaaccaggaaaaattgtatacatagactcagtaacagtttgcagaagaactcaatgtggaaaaggaaaattattcaacttactagaaagaatacctaaaaggggttagcataacagactgtatgattaatagttcaaacttgagttaccttaaccataaacatgaaattgtaggcccggcatggtggctcacacctgtaatcccaacagtttgggaagctgaggtgggtggatcacctgagctcaggagttcaaaaccaacctgggtgacatggcaaaaccccatctctacaaaaaatacaaaaaattagctgggtgtagtggcatgtgcctgtggtcccagttacttgagaggctgaggtgggaggatcgcttgagcccaggaggtcaaggctgcagtgagccgggatcatgccactgcactccagcctggatgacagagggagaccttgtctcaaaaacaaacaaataaacaacaacaacaaaaaaaccaccaccaccaccaccaacaacaaactgtaaaggaggaatttaaaaagggttaaaaaaaaaaaaacccttaaaaggctaaatgaagaaatgaaccagacagtgatgagagcaatcacattatataataaataagggctatggataataaaaattacaaacaaacattgatttgttacttgaaaagtaatggagaaagtatcttaaaagtactaaaatattagaaaattaaactttaagagtgacctaaaaagagttagaaagaaattaatataaacataaaaatccctcaatgaaacattaaggtgttggttagagttgatttatgatattaaatatattcatcagaatactaaacctctctataatttgtggccatttgactatctgaccattccctaatatgctgctagggagataaaatcagaaccagtcaacaaaaacttcacaggaaccttcaaaagctgttaaaagtactgcattcaatttgagatgctgcaagacagggagagagctctaaactttaaacataaatttaaataaataaattaaaagaacaaagttttggtcaatgtttaagtttattgaacaggtcatcttttggcagaccacaagactcatatcattgaaatcccataatggcaccactgtgctcttaaaaatccaatctcttgccatagccaatcagatctccccttggaaagctcccacctacttacctgttctcatctcaccttcagtcagacgtgctggctcctttatgttccaaaaaggccacttgtgcccgttttggctttgagatatttgcttttgatagtccctctgcctggaagactcttccttcacttctcacgactgtcttctcatctttcgggttttggtttaaacatgacttcatcaggatggccccgcatgatcaccctatataaaacttccttccccagtatgtgagtctgttttgccttgctataaaggaatacctgagactaggtaatttataaagaaaagagttttatttggctccgagttctgcaggctgtcaagcatggcaccaacatctgcttggcttctggtgaggtctcaggaaacttgcaatcatggtaggatatgaagggggagcaggtacgtcaaatggtgagagagggagcaagagagaggaagacgggaggtcccaaactcattttaaacaaccagctgtcttgtgaactaatagagtgaaaacctcactcattacacaagaatggtagcaagcccttcatgaaggctccacccccatgacaaaaacacctcccaccaggccctacctccaacaccggggatcacacttcaacatgagatttggaggagacaaacatccaaacgctatcacccagttaccctccaattaccctattcatttcttttaaaaaaatccaaagcctatcactactggaagctgttaggtttctttgtgcccttcacttccttattatctatcttcctcaccaaaatatatgctccatgagagtttaaagttatactttaaacctagtgcctcttcctacaaacattgatttgttagttgaaaagtaatggagaaagtatcttaaaagtatcttctgagtagctactaaataaatatttgttgaatgaatcaaaggatacatttatctttgagaacagactgctccttaattttttaaaaaatccacttaactgcatcttttagcaatgtgaaaataaagagcttttgcaatggagtcttttgagacaacacattttctgccagtcatttttaccccatgtccaaatgaatggaagattccttttccactagaaaaacattcccccacctagtggaaaagtacttgaatccagaatgcactgactacagggatttggaaggatctataataggctgtctatgaagagtccatgcaagaatgactcataagagttgtcattgaagacaaatctgtgagggtgtaggtgcatggatcagcataaatcagccagtagtccatctgggaattgtgtctgcttgtatacatcaataccttctctgggaggcttggtttcaaaggatattttacagacaacagtattaatccctagaattagcacagaggaagagatgaaaggagtccaattacttttgcaacctaggtgccccaagcagcctctccgactttttttcactttccactaactcttgtccttgaagaaaggctaattagaagttagaaagaggttgaagttcccccaaagacagaatttcagagaattgggaaaactttttcaagcctggcaataagaaatggttttgatagccattaaggtgacctcatgttcaccttcaagcaagattttgagaaaactggggtaagcctcaatctatttttactcaatgaactgaaagataaagggaaagaatgtagacattctgttgcctgtcctgggtaatcaataaggaaactgctctttttttgaagagttatatgggcttaatgatcctcagatcctgagttcagaatttaaaatacatatgtatataattgttgcatagcccactctgaagtagtagaagattcaatgaaaatgcatgtggaatgctgactataaattatcacacatattatcatcatctagtcaaatatttatcttttctggggactctatgctcatggggattgataatgagatattaagccttttgccattaatattctgtctcaaattgagcccagctttacagaggaaaaaaaaattgttgtcatctcagttttcgctgcctgctctttgtaaagaggcaggaggatactgtcagaattggctctagggaaaattgcaaagtcgaggttggcattcacttttcctttttcctgtttgtcacccctcaccctgagtctctcatttccttagggtcttcctgttatcctcctgccttcctgagggtttgcaatatactgtcccaatgaggcagccccctttgctgggacctctaccttcctctcctctgtttgttactgcactgtggtcctcaagccttagaaatgaagttgccctcagagagttaaactctaaatgaattcctaatggatcagagcagagattagcaagtaccttaaagcggtcaagtggctccccaggcaataagaatggacattaaccagattgaagatataataatgtatctaacaaaaaaagggcaggggaggatttggtcagccaaggagataaaaatcacttgtcaaagacaagactagcagcgttcatctaagcactgagcataggtagaggcccttctgtcttcttattgtagtcctgggtggatgctaccaaatgttcaagttgtaaaactcctgcctctgattcccctacctccagcttcttccattctctccaagcaactgtctgatagtttgacgtcccatggagcttgcctacatgggaaaaaatgcagtaatcaagccaacacaaacattatgcatgtctaataattgtttttcatattgaaaatttgcaagcaagtaccctgattatatgacagtgtgggatgagctatacagatccttcacctccaggactcaacgaagtttctgagactaccaggctagtatagaaggaatgcccaaatgggaccagtccactgtggtccactgtgggttgtgtgtagagaaactgtaggatgtcacgggatctgtaattaaaagcaatgcaaatttcttaccattatgggttgaattgcatcccccaaaagatatgttaaagccttagcctcccagtaccacaaaatgtgaccttatttggaaacagaatcattgtagaagtaattagttaagtgaaactgaagtcatactgaaaaagggtgggctcttaatccaatataactggtatttttacaaggagagagaaatttggacatagactcagagggaagactgccatgtgaagtcagaggccaggctgagtgatgttgcctccaggcaaggaatacctgggctaccagaagctagaagaggcaatgacaacttctcccttagagactttggagggagcgtggtctttccaacaccttgattttgggcatctaaccaccagaacaaatttctgttgtgtaaagccacccaacttatggcaatttgttatggtgaccctaggaaatgaatacacaaacgtaagaagagaaggcacttggtggcctcacaaccctgcactgtatgaagtgaagtgtggcaggagaaaacagtctgtcagacctagggcttagtccaaaggggaaggggaaggataagaggattcgagatggagaagttggtgaagtcctgccttagtctgtttgggctgctatcacaaaataccttaggctgggtaaattataaaccacagacatctaccgctcacagttctgaaggctgggaagtccaagatcaaggtgccagcagattcagtatctggtaatcccattcataaggactctgccctcatgacctaattatcccccaaagcctcaacctcttaataccatcaccttgggggttcagtttcagcatatgaattttggggtgacacaaacattcagaccatagtaagtcccctctcagaaataaagtctcaaggcacacaacccctttgggcctctgtttagcatgaatgaataaaataaaggaaccaggaattagaattttaaaagtttttattatctttctgactgggcatggtggctcatgcctgtaaccccagcactttgggaggccaaggcaagtggatcacctgaggtcaggagttcaagaccagcctggccaacatggcaaaaccccatctctactaaaaatatgaaaattagccaggagtgggggcgtgtgcctgtaatcccagctgcttgggaggctgaggcaggagaatcacttgaacccgggaagtggaggttgcagtgagccgagatcgcaccactacactccagcctgggcaacaagagcaaaactccgtctcataaataaataaaaacatgaaagtttttattatctttctgttttccttttgtgattcagcgaaatcctgaaaagtaatgtaggtagcaagaaagaggagtcaagaggggctgtggtcttgagttaggtaactgggaagatgatggcaccccatagcctagttttggggagaagattcccaaagaagagagatcatggacataggaagagaaaactgggtgttggtcccatagtctccccttgccgagcttccttagaggcggttcctgggaaactgcttcaggatccccacttcagtggcctcctgagcaatcttttcttcacttgccaagtcttactcatgtctgtaaattatataactactccctccattactcaagccagaaacctaggagtcaccctggattcctcccttttcttcactgtctcatccctcatatcagggaattccacagagcttacctccaaataaatgtcctttactcaccatctccacaatcccactgtagtccgattttgcgccatcacttgcctggagcccacaacaaccttctaattggtcttctcacttccgctcttgctcctttaattgtttcttcactcaacagcaaaagtgatcttcttaaaacaataatctgataactccctggcttaaaaccatccatttcaatgaaagtaaaaccctaactttttataatggcttacaaagcattttacgattgaatcctgcctctctctcactgtttcctcagttgtagctgcaccgttccttcagtttctctaccagaaactcttcccaccacagggcctttgcacatacggttacttttgactggactattctacccacagtagcatgactagctactccctgttctaagtttcagcttaaatgtcacctcagagaggccttccttggtgaccaccattaatagacatgaatgcatgtctattaatctttatctcagcacctcatttgtttctccatagtaaatatttaacttgcatttacttgatctctgtctctcatctctgtcaatatgtaagtccatagatgtaggaaccgtaattgtcttttctaccactgtatccctggcatatagcacagacccatagtaagtatccaataaatattgttcgaatgaatgaatatttagtgtaaccacagctgaacatggccccaggactgaaagttgggggacagggagcaggatggggtgggaggatggttagaatgatttgctgggaaaaggattttctaaaatgagcatgaagaataatttcactcagtataactatttgcagtccaaaatgcagaaaaaaagtattatcggtacatgtttattgaggtattatttacaatagcaaaaaagttaaatgatctctaggctataagtggagaaaatgtatatttgtgaagacaatactagtcacgatattgaactttaaaaactttcaatgaagatatgtagaagcaaatctcagtgtggtctttatctgttgttattttgtcacataaaaggtcaagtgtttttgcatatgtgcatagggtttcttttctttttttttcttttcttttttttttttttttttgagacagagtcttgctctgtcacccaggctggagtgcagtgatgcaatctcggctcactgcaacctccacctcctgtgtttgagtgattctcctgcctcagcctcccaagtagctgggattacaggtgtgtgccaccatatccgcctaattttttgtacttttcgtagcaacagggttccaccatgttagccaggatggtctcaatctcctgatctcgtgatctgccccccttggccttccaaagtgctgggattacaggcgtgagccacagcacgtggccagggtttcttaattatttattttttgtatttgtggtttaaaagaatgacaaatgtatttttggttaacaattgtatcatactttttttttttagacagagtctcgctctgtcatccaggctggagtgcagtggcgccatctcagcttaccgcaatttctggctcctgggttcaagcaattctcgtgcctcagcctccgaagtatctgagattacaggcatgtgccactacacctgtctaatttttatatgtattttttaatagagacggagtttcaccatgttgtccaggctctctccaactactgacctcaagtgatcagcctgcctcggcctcccaaagtactgaaattacaagtgtgagccaccgcgcccaaccaatagtattgtacattaatcctgatgaaacctaaagagtagacacatctttcatacacaaacacacacacacaaaatacaagtggattcagaagttttcagaaggatattagtggcccaaagtcatggcaactgccttgtagagggagaacctagtggttcttcctaagatagcctaagcagtagagtttaaagtgtggtccccagatcaacagaaacagcgaattctcagacctactgaattagaaactcttggggtggagggcagcaatctgggtctaaatactccttctgagtcattctgatgcacgctaaggtttgagaaccactggttaaagcaacattctgatgaccagatctaggtttgctgagatctgccaaaggaaggaagttcagtttccactcttcgtgagcagggttgaagccagtttccctgaggatcctctgtaagcagaagggcccacccatccttctctaccttgagcaagcctctgatcctgccaggagtggtgagacttacaccccttaagctcctacctttggccagggctcctcccttttttccccactggctcttaggaggatgggattcaacaacaaagcttgttttatcctgactctgtcactctgtgtctctgggcaaaaggctgcttatctaatgggagaaagctgcttttagtgccgtctctgcaactactatagaagacttacttttaacctagagtaataaactccctacacctgtccttgaattagatggaatgaaaccagatctagagttccccaaagctaaaaccgagactccagacattcccattatacattttaacaaaggaggggacagaggcccagacagtggatgtctctgaggttacacagtttgtaagggacagacctcagattagcccccaggtctgcggcttctaattcagtacttttgtggctgtactttattcagtgtcctttctacttcctactcaacagcccagggctttactccacatctatgaggtagggcctggggatttgggctgctatgaatacttatgcagttttgtactgaagaagtcaaaaatatgccgccccaaaatacactgctctggcataatgactattttgaattaaagacgcttttacaaaagcagcaggtgcaagaagatcactctgaccttcattctgtttcttagaagcagagcataaaaatcccatgtgaaagataccggccttgtaccaaaaagaataacattcttatcatcaaggacaggaagttgaagctgagggaaatttgtacaaaccaaccttgtcaaacgaacccttatctgcctcatcacttctctagccaattaactaccccagctcaagcccctttgccttcttacatttcacaacttactattatttgtgcaattcagtatgtgattgactctctcaactgcttctttgggtcttcatttttgtatgagggctcctgtgccatgtaaaacttctattgaataactttgtatggttttctcctgttaatctatgttaggtcaatttaatcctcaggcccagctgggaaaccacgaaaaaggaggtggaattttgcccccactacaatattgatcaaggaggtcaggatgcagagaggggagtaagggtaaggcacagcctgagccaaaccccaacctctgccctggggctgcatctgtcagaagagaggcccttttacaaatgcagatgcctgggtcacactttaggctaatgaaatcaaaagctctaagaaaggggattgccattaatacacatatgtgcatgtgtgtgtgtgtgtgtgtacatatgtatatatacacatatatatttttgttttgttttgttttgttttttgttttgagacagacccaggctggaatgcagtggcgcaatcttggctcactgcatcctccacctccctgattcaagaaatactcctgcctcagcctcccaagtagctggaattacaggcgtgccaccatgcctggctaatttttttttttttttttttttttttttttttttttttttttgagacagagtcttgctctgtcacccaggctggagtgcaatggcacaatcccggctcattgcaacttccgcctcctgggttcaagcgattctccctcctcagcctcccgagtcgctgggattacaggtacctgccaccatgcccagcgaattttttttttttgtatttttagtagagacaggatttcgtcatgtttcgaactcctgacctcaggtgatctacccgcctcggcctcccaaagtgctgggattacaggtgtgagccatagcacctggccataatttttgtattttgaatagagacagggtttcaccgtgttggccaggctgggcataaactcctgacctcaagtgatctgcccgccttggcctcctaaagtgctgattacaagcatgaggcacagcacccagccaatacaatattttttgagacaggttttgctatgttgtctaggctggagtgcagtggctgttcacagatgtgatcatagcacactacagccttgaactcctgtcctcaagctatcctcctgcctcagcctcctcagtagctgggactacaggcatgcaccactggacctggctcattaatagttattttttaaagcttatcaggtgattctaatgttcagccagagttgagaataactgtttgaaattattcccaagcttcctttactatactgttgcttaagtgtccaatcctaacattgttatcaaaagcaagagactgtagattgactcaataattcaggctaatataatccggtcatctccacaaaaaagcactagttgatgaagttaaatactttctccaattctgagccagaaattcaatactgcatctcaaacgatcttaaaaaaaaaaaaaatctgttttaaggagagagactatttctatttccatccttaaagtatgattactaaaaactgaaaaattcagttctcgttttgcaaagcagtgagatatttaggtaggtgggagtcattttctcctcctggcttttcagccttggccctcaaattagggacttccaggctcttggaagtgttggataaaggcttccaccttccttcttttgcaggctttttcctgcggtgggatttatagaggtgcattgagctactggcatacatcttttcttagctaggctgttcacaggacacaaatatcctttatttcttcaggtgacaggcacaagggcaaaccctacccctgcagacagctggtcctcaggcgtatctatctaggagaactcagaaaagagaaagattaagcctgactttgtcatagattcaagccccttattccagtccagctttactagcaataaatctaatattttgacctccatttgactttgggcctatttctcacctgattcagaatgagcccccttaaatcctaacagttaagtcaatctacatgaccaaaatgaccagcttgactgtcttatttgttgtgctgcaaaacattcactgcaactttatcaccctagctttcagtcaatctaataggttttggctgagagaaataagggctggattagcagaggcctggtcatcctgattgtactcctgtgttgagctgaggctaattaattcagtagaatgctgcttttgtgatgttttataacgattctggactaaacacatgaacacagcttgaattggtttatagctcccatgaactgacagaaattagtttgttgttgttttgggatgtggtagttagaattggtagagtcaggattacctagaagtcttcatgaaactttatagtctgactttcactatgattcttgctctactggaaagaaatggttgctttattcttagaaaagagatgagatgcaaaaggtctagtttttttgactaggaaaactaatttaaccttttattttactgacgtgtttccacctataaaagaaactaaccgagtaattctgtaatcattgctaccatgggacttattaatatattactaaatagctgcaaaactagtagaatattaatgaaaatttgtgccaaaaatccataagatgagaattttaaaatgtataataaccttagatgatctagatacataaatatatgtacctagaattaaagacattgccttgattctagaagctgcaaattaacatttaaaataatgactcacctttgttcaagtttgaatcttatgatgaagctaaatttctcaggttttaaatcctgaggactgcactcagaagaaaatcagatgttttcagccacaaacattgcttaaaagaaatttctgggaagagaatatattgatagaaattatgtagtcaaagatttagataaatttatgggcaaaagactttttagtgtccccagcctacatgattaataattcagagccaaatttaggggcactccacccagaaggaattacattatccaatttctgtcatgtcatcctgaagtgtaagcagcaagctcattaaaaatgaatgaggtaatcagacaaattctatgaccatgcgtgagcttctcattaatgttttactagacagcattaagaaagactaaatagactgcactagatctggaagtaataaatggacttcaaaagcaaagcaacttaacgaccttccagtaaacagaaagacttgaaagggaaaggatgaaggattttagaaacctatcagctacacattttggctgcatctacaatggaaaagcgaaatgcagtatgatcaattacctgcttaatttgatgaatcaacaggccaggtttaaatattactttgaagcccgaaataacggattgggctgttattagcaggttaaagttcctaattctcccttcactgagtactgtttgactagtgcacagtttctcagcagtaacagtaccggtgttttggcctgggtaattctgttcagggggctgtcctatgcattgcaaggtgtttagcagcatccgtggcttctactcactagatgccagtaacatcgcccagctgtgactaccaaaatgtctccatacattgccaaatgtcccctgacatttatacctgagcctggtgaaaggagtcacacctgttacagaggcagagaattccaagagtaccaatatcccatttccaatgggaggctgtacaaaccattaaatgaagggattaacttgcaattgtttggtcaatttggactttgcagacaattaaactagttaattcagatcaaaattttttctttgggatttgacttatcaggattggcatctaaattaattcaattagtggacttactgctaggcatatttttaattttgacttgaggtttcaagctcagaaatatctcaagtgcaatgatcagggttcagaaacagatggagctgcctcatcagcatgattgtatttggggggctttgttactatgagcacacacaaatacacacatacacacattcctctaagaattctttccattggtttctggttatctggtttttgctctggtatctacaccgcttctcccctttgcataaacgtcattccagcttgacttagcagatagcttgataattaaaagtgtaagctttagagccagataaaactgtgcttgaattctgactccaggattaatcagtccttcattatgttaacaacaacaacaacaaaaagaatcagttgtaatagtacttccgaggtcgtcagaaatatatgaactggttaggaggtgtcaggtccatgactacgccaaatgtcatgccgagctgtgccaagccatgtccacgagcgcctgtacagcagaagcagggcagttataccttttgaaacaatagtggctccaagtcaaatatgcgcttacataaacaggttatataacaagtggaggtgtgcacctgcgcaccaatcccgctgagtcatgcaggcctgaatgtctgccttggcctattccttgaccaaagcatgccatgtcctttacaggaggttagtgcttctgtcaataacagagatggatcgacaatgctaaaaaagggaagggttaatatctcatgtaaaattcttgatggagggacccctgagctaggaactggatcccttcctatattcctgctctgtaatttttaatgagtggttctcatcctcaggattaatagatagctgttggacttccagacatgatttcctcatttccagcaggaggaagggaaagcccaaagagcatatggcctttttctaaagcccctgttgatgacttcttcttttcattgaccccaggtgtgagaaaggtaggtaatgcagtgtttaaggcaggtacagctgcctctggtaacttagcagttttgttatttagaaagaatgaatattggatagatgctggtagtttttgtcactttgaaactccttcccagtctccattggatcctaagcatccaagaatttacttgactttaagaaaataaggacagcccggattccacaataattgccatctttcctgatggcttcttcaactatatgctctgttgctgggcaccagtgctttgggtgggcttcaaaaatcctgccacagaaactcccatgggccagaggctgctctccaggccacagtactggggatacgatctccatacaggcatatcagacaactagtgagctccaaagagctgggtgggaatgcacctcacacactgtagaacttgccaccatgttttactcccctactcagtcccagggaatttaactctaccatgtttgcttgtctctgcctcaactcccagaaacaccctggggcttaggttttgagaccttaggttttaaacctctatgggcctagggtttgagaacttacaccaaataattcttcctgtagctaaggaaattcaaaccttcaacatacagagactgggctgctttatttggggtaagagtggggagtacatacaataaggctcacaaacaaggttattatggaaaaaagaaaagacttaattttacattgaccagtgaaagtccttagggatttaaagagaacatccaataaaaatgtatgatcatctctgtgggagaatgcaaattatttgattgttattttaattttaaaataatgggtccttttttgtccttttcccctaatgccattgtaatgctaaaagtgtaacacttaatgagtactactgctcttcatcaaaaggtagctccttttatttttctacaacttatagaaatctgcacctgtgaattaatgtttaatgattcattcattgtctgctgtcaggcttgtgtcttgcccttttgaaagaaaatactatttaagtaatgagtgaggtatcatggaatttcctaaatatgtacaactcagaagaacagttgtacatcactgcgttttgtaaaacagagtatgtgtggcaaacaggaacttttatggatccaatagccactcctccccactttcgtgcctacctcttttcttccttgataactgagccctggttttgttcaagtatttaccttcccacatactgaaccccgggagggaattgttgatgagtcagtctaaaccacttgttgtaatctattacttttgctaatgattggtttaagtgtgtgcatgtgatgctcactgagtctggtgggagaaattcagggaaggtttcttcctggaaggaacacaaatgagaacttgtgccttcccatgttcggatgttgtaatgtgagggcatcctacaaccattatggtctttcttttgaccataaagaaatacattgttggtatattatgactggcataacagaaagatggcaggtacctgaaccttgataacatttgttgagttgctgcactaaccctgaaccacccttcatttgtaggataaaaggtactgtgtaagccatttattcttaggtattctgttatttgcagccaaagcattttaactgttaaataaaataatttgctgctacttgcctgcacaatatctgctgtcctcttttatcttgattatattcttggtagcactgaccacatttttctagcttcccttgaaactacagctcaattgagatataaacagaaattgatggatgtgggttcggggatattgctccctacagggcactaactcagccaggatgctctctctcttgtccttctctatttctgtctttcttcctgttttctgtatgaacaatatggaggtataggggagcactcctgctgccatatttgtacataactttaagaatagaaggcacacgtgaaataaggtagagtagaaagaaataaggagtgtgagtctccgattgaccatggaatcaccatgccaccactggactacctatttctggacgttttcttgtttaagtcactattgtttaggtttactgatatatgcaaccaaatctaatcctgacttgactgttgcagctgctgaatggcatttaaagtgatcctttatgaaggaaattaatatagaagcagaagtcttatttcttagattgatttttttaatttaaaaattgccatttagttattttgaaacagcaaagagctactcaaattgtatttgatatctctattttttccataattatcctaagatattatcttttgaagctgattgagaaagcaaggaatagaagtcattatattacttgttactatgtttacaggcatgcccaaaaaaggagtccaaaactgggtcaccaaattcatcccatctccatatagttgttgagcacataaaacgttagagacactatgttaggcactgtgtgtgtgtgtgtgtgtgtgtgtgtgtgtgtgtgtgtgtgtgttcgagagatagaaagatataggtcctactatcaaagaacaaaattagtttagctggcagaaaataatacaaaaagatacagacaattttttagaaacaccaaaataaaaaatacaaagaactgcctaatgaattgaaggaaataagcaagaatgttgacttctgtatcttatatggtttttatttcctttttttgtattttttcagacttcctataaagaacatacagtttttagtaagaaagaaaaaaattttggccgggcatggtggctcatatctgtaatcccagcactttgggaggctgaggcaggcagatcacaacatcaggagctcgagaccagcctgctcatcatggcaaaactccttctctactaaaaattcaaaaattagccaggtctggtggcacgtgcctgtaatcctagctactcgggaggctgaggtaggagaattgcttgaacccgggaggcagagattgcagtgagccgagattgcgccactgcactccagcctgggcgacagagcaagaatccatctcaaaaaaagaaaagaaaagaaaggaaaaaactttataaaatatttttattgctcaaaaaatgtagttgttacaagtaaggaatttggagccaaagctcctccatgcattatgtctggggaattctcagctttctgcagttctctcccatagctacttaaaattcttcatttgatcatagtgggtttagttgcaggttttggacctattaaaatgcagaatctaatggaagataagtataataactcttaatcagaaatgctcatgagctttttaaaaatcaaaattcctggttctcactcccagtgactcaggttccttgtctggcacagggccagaccatgtgaatctttactcctcatgtgattcctggttgagatctcctggttgagaaccccaacccaggttaagtttaggttgttatcagttaattgaatgttagtataaacgaggatccaaagaaaagtgtgatggaggtaaggggatgtaaaagcacagtagcacctgaaattgaaaagatgtgagacagtcagccttagagagaagcacaaaagcttgcaacttcaccattctcccagggccttgcctgcagaggttataaaggaataagatgtatgaaaatatacatataccttttggccaggcgcggtggctcatgcctgtaatcccagcactttgagaagctgaggcaggtggatcacctgaggtcaggagttcgagaccagcctggccaagatggtgaaaccccatctctactaaaaatacaaaaaattagctgggcgtggtggcatgtgcctgtaatcccagctacttgggaggctgaggcaggagaattgcttgaccctgggaggcacaggttgcagtgagccaagaccgcgccactgtgctccacagcctaggcaacaagagtgaaattccgtctcaaaaaaatatatatatataccttttagggtatttcagcttattgtggcaatgaaaccaccacgtctagatctcagagaggtaaaacacaatgaagaaaaagagagaaagggtttgaatctcctgatgaacaatgtaaaatcatcttgaatttatctcctttttgaaggctaattaatttaggaccaaaagtcacaagagggtcactgtaggtatatccagagggtaggatctgggtgtctccagatatcattaaaaattgagactataattaacaataatttattgtatattttattcaaaaacttattgaattatcacatggtagcccctaaatatgtaaaattattgtgtgtaaatttaaaaaataataaaagcaaagaagaaaaaaaagaaaaggaaaaagcaaacaaagaaaagctgtgctaaaaaaaatgagagatggtgttaaacacaggtcactgcttccttgtgctatttaagggacatatctgggggccatcgcagtttcaatacagagccacattctgtgccatggtttttataaacaattcccactacaaatgtgtgtatatgtgaggataggtcatagtatatccatcttcgtttatcactgacaaaggaagataactatacaaatcattttctcttttatatcttgctaaaacaaaagaagatctgtcatgggccctaaataaccagtggtttctactgataattttttgaaagctcttaaagctctacatcccattgtgtcccagtaatttcttcctgaattcttaattagagtattactacttgaaaaatgagcatatttttattgcaagaggaatgataataaatcttataattttaaactaggaatcaaagcccctctgagttaggaggaaatcaaagggctgtaaaatgtatttcattcgttttcccctgggcggtctgattcttctaatgtcagactctgcctgctatcttttcataatgggctgaactatgcagatattcaagatgagacattacatttgtacgttactaattatacacatagaattctgatgcttacaaacgtttaatgcatcaaagggcaaaaggcctttattacatacttttgattttgtcagcttctaggacttaacatcctcttggatttagtttagaaagctttagctaattgaagaagtaatttttttaaaaaatcagagttaaagaatgctaaggaatttcctaaatccaacgtgatgaaaattagaattccttgtgggaatggagactgattccttagtgtcctggtaagcctacatattttcctttactcatccctagaaacaaaagagaattacttcacagaaaaatggtcattttcaattctatccagagaaggaattaccatattaagtatttgtacagcacagagcattgtattattgctggtaggtggatattttactttattctcagtaaaaactaaaatcttttccttatagaagcaccaaactaagtactttttaaaatcacagaaaagcagttttttgtaagtgcaagaaaaagagctttgtgttacagacttctacagaatattgaaaatggccaaatgtgattttttggaggaaaacaaaatgtactttctccaatggcaattcttcccgcaaaaggaaagtgaagaaaaggttgtagtcttaaaatgaatcattgaacgctaatacccagttacaggttttattgctgtaatctcaaaaggccaaagaccaatatcatttcctatcacatctgtagccaggtaacaaccttttagaaaagatcatggtccgggaacacacaccaaaataactgatgtattctgcaaaaagaaatagtactctgcagtgcccatcaacaatcctggagagggatgaatagcctcactcagcctatgccaccatttcttttttttttttcttttttgagatgcagtctcactctgtcgcagaggctgaagtacagtggtacgatctcagctcactgcaacatctgcctctcggcttcaagcgattctcctgcctcagcattccaagtagctggattatagccacgcgcccccatgcccaactaattttcatatttttagtagagatggagtttcgccatgttggccgggctggtctcaaactactgacctcaagtgatctaccggcctcagcctcccaaagtgctgggattacaggcgtgagccaccacttccatctgcaaagcaagctctgctatggtagggcatcctgtgtaatgatacccagctaaagttacacattagtgatcactgatagtctttctttatatttgtccataaaaaaacgctaagtatgtctcctcttaaagctatgaacaatttgtagttttcaagagctatcaagctatgtaatcttttttcatctccaattaaataggtgtgtcccagagccatgctactccacactttgcctgcctagcactgtgctggctacattgctcagtaagtacccactgaaggacagttcaatgactgtggtgtggtggctaatgcccagtgaaggatagtgacctcactttgaaccctcactggcagctaacctaggaatttgtgtctcacccattccaatttctgcaagttattaatataatgaagcactttctggaactcgttaaagtgagaaaacccttcaatttttctctgctggcattgccattttcctttgcttccttttttgttctcttccttcttttttactacttcccttccttttcctttctctctacactcataagcatttattgttgggcgctgagctagaaattggggcatatacaaagaaaaagatgtgggtctcttttttccacaatctgccttaaaaggagctcccagtttagtgagttgccatttataatgatagttccatttattgcctattcacttcatacaagatacactttatacattgttgcatttaatcttcataacagtcttgagaggaaattgttatgggcaccgtatgttacagattagggaaaaaaagctcagagtggttaagtaacttgctaaagagccagtaaataacagatcggattcaaacctaggtctgattccgaaacctgtgtttattccacaatatttcatccccagaaaggaaaagatgagttccacattggcggatatataccactgaactaacaaggtatctttcctcttatgagacaaaatttccttgaaaaagtttgcatctcagtttgatttcaatttatccaagcatataaggatatataaagcacaaaaggcaatggttcaggtcatgttacttaaagcctgacctataaacctgcaccagtgagtgaactatgtctcagtctgtcatgagataaatacagaaattgagaataaatatttgagaacttttataggaatttaacacagtataataataaatatggcattgtattatgggctttaaattttttaattaattaatttttatgtatttattttttaaggcagggtctcctttgtccctttgtcgctcaggctggactgcagtccatacatgatcatagctcaccgtagcctcaacttcccaggctcaggtgattctcctgcctcagcctcccaagtaactgggaccacaggcacacaccaccaaacccagctagtttttgtatttgttgtatagatggggttttttcatattgcccaggcagttctcaaactcctgggctcgagcaatccacctgcctctgccttccaaagtgctgggattacaaatgtgagccaccactgtgcccagcttcttttttttttttttagtttaatatttttagtagttcattttcattgtgttttataaaagtatgagtgtacaatagattgggcattttttaaaacttgtccttttccacaagtagtttgtgaagcactagtttatataaatatgtaacatttaaataatgttaataaattgtcaatatgattttccagtgataccactaggattcccagaatagataatttccctttcctgggccagctactattgttcttgtgagctctaggaagtatatttgccccagaacttctttagcatggaacgtgaaacaaaggctctgttttcaagaggtgtttgatgaacattgaatggaccaatcagtgaccagtgacccctgagataaaaatgtttcctgagtgttaatttatatttctcagtgaaaaaagaaatgtggacacattggtgcaccttccagtaattttgatcatgagactgaacgacagacgttgaagacagttttgagtggtgtaatttacacacgacattaacccagagttgtgtcctttaccctaccacagtggagtatgtcagggaataatacacagcgaaaagattctctcagggctcttctctgggcagaatatagaggtataatttggtacttggaagagacatcctggacaatttatgtacccaggaatcagaattggcttattcatgacttctaagggaagtcatgcatttaaggagttagttattgcaactgatgataaaatgctgctgctggcagaaaatgttattttatgaaagcttttaacagaattcttcctccagaacctgaatgataatatatttaagatttcaattgcatgtgtcatttccttattttcacagccgtgtcctggctgtgaaaacatcttctgcctacagtgacaccttaactggagttgatagggttgattttctgctggttggtgacaaatgtgaaaccatggaaaaatctgcagttgcgggctggccctgtccccagagaccagcaactctgggccacaagactgctcttttatctatgactaaagaaactaacaggatgactcagaggccaggggaaaacatgctctagggatttcttctctcagacccctaaaatgggaggaagattaatggctggcaaagtcacactgcaggttataattctcttccagcaggttataaaggtgtactgacaaactctgcaaggtggaggagatgaagaaaagcaaaggctatatggctgctttcaaagctgtttatcagaaaagaagatatctctcaacaaaatgacaccatgtctaaaaatgcttgcctggcatccctatctgttatatgctggagtgtgaattacatgtgccttcattgtaatcagaaaataaaatgtatgcccatgaaatatgtaaatgttagatatgaatatgtgcttaatacaacagactggctataaactttgaaatggatcaagactaaaattttatatatgagcttgcccttctgtttgatgaattgtatagactggtagctttgtggattctataggtatcccagctttctcataaaatgtggaatatttattatgtaatatcgacagcaggatattaatattattctaaaaactacatacaaatgctccttgacttatgatggggttgtttcccagtaaatccatcataaattgaaaagatcataagtcaaaaatgcatttaatatgcctaatttactgagcaccatagattagcctagcctaccttaaatgtgctcagaacacttacattagcttacagttgggcaaaagccatctaacacaaagcctatttcatcataaaatgttgactatctcatgtaatttattgaacactgtactaaaattgaaaaacagaatgattgtgtggatatttgaagtacagtttttactgcatgggtatcgcttttgcaccatgccacctctttctttctcctcatatatataaatatatatatatatatatgatgggaggaggaaagagagagagggagagagaggggggagggagagagaggggggagggagagagaggggggagggagggggggagggggagagagagagagagagagagagagagagagagagagagagaaagagcgagttgtcccccctggaatagttcttggttatcaaagataaatttgttaggtgagatataccctttagcagaacaggataaaataaatcagttcagctactgactgagatgtcatgaccaatcacaaaccagatatgaactttaagttcccgtggtacagattaagaaacagatcaaaccccagcaacactgagttttgagtgtggtcttaaatgaactaggaaagtattgttttctttccctttagaaactccataaagtagaagtaaattttatttctggggcaataaaggatcaggtgttcatggttaattagtgctgttgaaaagtacgacagtagaatagaaaagaagtcagaaaataacgtgtattgtggacataggatgtgagtgtaggtcagaacttattcttgagtttcctattatgaagttcatagagtaataatctgcaatccaatgtgaagagtaaaaagtaattttggggttggtaatcaagatttgctttttaaaatatttttctctacttaaagctaaccataaagatcaagacacttaggcagatatgccttggctccaaggctgagaacacatttttattttctaacttggccaaaacattcagatgtttcttaaattgtggaatagataccaaatcacagattagaaggaacatatccaaaccttctccagccagcacccccgcccccatcaattttacatttaaaagcctgtaaaatatttaaaaagaagatcacgattttctaaattcaattaagtagtaataggaaaggttgaagctttcagttttgagataaaaaatgacagagggtaaagccttcttcctcggttcgcctctaagcatagacaatgctaaataagaggcttttcattcaacctggtaatgggagacatccatcacctctgtctctgaagccggccttaaacccttcctcaagtggagaatattattaaatgtttaaagaaaactgaagtcacagaaggacatttccccaacctatgatagtgtagattaatcaaggaagacaatttgctccttatcttcgaaatgtgaatataaaatggttttaaatattccaaatcctcagagcctacttaagaacagatactgatagcacttctccaaactgtttataagaatgcctctgtttgcagcagtactcaatatgaaagttatctcacgtgtccattactgagcaattgcataataaacgtttgttatacaaatgaatgttaaataacataaaaacagtcataactactgtgttattttggcagcattaaagacaacattcgaccaactccagagtagtctgttctattgtatttgtaatgtatccaacatatataatcacacatatttaatgttatattataaatatttatattaatgtaatttaataaaaattcaatatttgtaattgtatatatccatttaatttgaggctttattaaatgccctgaatgtccctgtataacattctgtacattgtagagaatcaattatgccccaagaatgaatgttctgagggctcaggagtaattatagggatttctttatggactaaaaaggaaaaaattctagtactcgtatttttatatattgtaaaatatcttcatcctcccaggcctctgcatcctgttccctcatttccacctctttgccctttaaaatgttcacatttgtcttactccaaactcctaagttgagggagagaggacatgctgtctctttttgcttattaatgtgaaaatgtgctatatactttttgatagagagggttgtgtgagccagcaaatgcactggcaggtggactagtttttgctgccaaatgagtcagctgagataggaacagtaatttattcgaatggacatgggttgacaatgccataaagaggtactggtatagcttaatggaagaaactgtcaagaaaatgtaggttgagcatggtgtgattcggcaagcatcagagtgtctccatgtccacaagtgtctgcccttcctaatccaggccactgtcttctggattcctcggcaaaaatgcaaatacccctagaggagtgacacatcaaatgattatcaggtgttaatattatgttgaaatcactaatattaattttttttttgagacggagtctcaacctgttgctcaggttggagtgcaatggcacgatctcggctcactacagcctccacactgggttcaagcaattcccctgcctcagcctcccgagtatctgggattacaggtgcctgccaccacgcccagctaatttttgtgtatttttagtagagacagggtttcactgtgttggccaggctggtctcgaactcctgacctcgtgatcctcccacctcagccttccaaagtgctgggattacaggcttgagccaccatgcccagccaagattgcttttttaacaaaagcagaggacatggcgtctttgagacagaaaaagacctggaatatgaactgttgcagagagtcagccatgttatgttatcaggacctgataacaatgccctcattctagacacgatgagtctgttattgctgtcaagatcacattcgctgttctggtggccattttatattcacacaaagcttatattgcactcatgtaaggctcattctagactgaaatcctcaagacttttcatataggttgactctaacctatattttctatgacctgatcttgaaaattattttttagcattcacatgtgagggcctaatggtccatttctgtaaaaattcagttgcatgtgggttaaatgagttgtgctaatcaccatggctgacatatgctaagtgctcagaatttaccattctggaaggtctttctgttctcaaatgtgcttactcttttttcctagcttcttgtcaatggtaaatgatgtaaacatactttctataacttcatccaagtcgatgatacttaaatttttggtcagaacagggccccagatgctgccctgttacacgacaccaaaaatctcttttgagtgacattaatccattaaacagcatcctttcccagtgaatattccatgtaatttttcctacaatgcccacatttcatcatcttgttcttaagaatatcattataaaccttaccaaatagtttgcttaagtgcaggtaaaccatacctgctgatttccttcacttaccagtctaggaaacttatcaaagaaggaactgtgttagtataacatgacttgtttaaaaggagttctgagggtaggaacttttcctttcacatctggcacagacgctcaaaacacatttgcagaattccaaactctgtactgctaaatccccaacgctttatacatagtagattcttgataaatgtttgtggaattaataacccattctggttttttatgaccacaacttcctttctatacaactttttttattttgagacagagtttcactctcatccgccaggctggagtgcaatggtgcgatcttggctcactgaaacctctgcctccctggttccagcaattctcctgcctcagcctcccaagtagttgggattacaggcacccaccaccacacctggctaatttttgtatttttagtagagacagggcttcaccatgctggccaggcttgtcttgaactcctgacatcgtgatctgccagcctccgcctcccaaagtgctgggattacaggcatgagccactaggcccagcctatacaactatcttataaggaacttatgttagaattttgcccacatttattgcttgtggttcactgaatctggcttcaattccttttgaaaattgaaatatgtacccaatttgtgtcttctgaaattactccagaggtaattcttcactttgctctaagatctttggcagtgggtatagcaggctttgaaggatttggaggaggcaggggttccagtgccagcttctttactgtgcagtaaagggttaaggccatgtgttggttaatattaagtgtcaacttgattggatggatggatgcaaagtatcatttctgggagtatctgggtgtttctgggtgtggccagaaaagattaacatttgagtcagtggaccgggagaagactcaccctcagaaagacccacccacactgtgggtgggcaccatgcaaccggctgccagcatggctagaaaaagcaggcagaagaaggtggaaggagccaactttctgagtctcccagccttcatctttctcctgtgctggctatttcctgccctcaaacatcagactctatgttctttggcttttggactcttggacttacaccagttgttgccaggggctcttgggccactggccacagactgaaggctgcactgtcagcttccctacttttgacatttggggactcaaactgagccactactggcttccttgctcctcagcttgggcctatagagggagtttactttgtgactgtgtgagtcacttctccttaataaactcccctttatatatacatctatcctattagttctgtccctctagagaaccctgactaatacagacagtaagcttggggtactcaagttctgcacatttcaaagaaatgactgaccctttactggctcctgggagacaacctctgagcccgtggagtatcctgtctgataaaaacgttttcgtgtacctaaggccctgagctactgctgtatcagtttgatctctaggggactagagactgagtacctaaggtcagtcatggaggcactgtgtctacatgactgatccccaataaaaactctggatgtcaaggctcaggtgagcttccctaattggcagcacttcatacacctttgtcacacttcagtgctgggagaattaagcactgtgcatgtgtcagttgagagaggataactggccttcatcccatgtgctttgccttttgctgattttaatttgtatccgttcactataagaagctataaccatgagtatcacagcttttctgaatccttgagtttttctagtgcagccagcctgagattggtcttgggaactcctgacatatccacttactctatgctagcaatgtgtccttggtcatattatctaatcttatttagtttcagtttcttcacctataatatggggataataataataacatctcccttgtagtgaagttccagcacccagcctacactttattttctccacaagtataacttgagaattgctatagaaattataagaaagtgctatgtcagcacatagtggatgcttagcaaaagtctgtttccctaagcaatcccttttgtaagttctcatatttcccctctcccccaaccctaagatataattgttgagaccaggagatgtcatctcagctagtccaaggagatgtcctcttccaatcttttcacccttatggacaccattctctttttatcaattgtttgctttttccatttccatccaaaaattgttctctctgatgaagaagacaggaaaagtcagagctttgtttggcatttgtcttccatcacctttatcttattggccttaagcagtaaatctatctctttttccatcttttttaaaagttcagttttgttttattctactctctctgggatgttttcctattcccagatcaattggatgacagcttttctggccttactcctacacgtttgtgatggttcctggtattagttttttttttttaatctacccttcctttttcaaaaaaataaaaacatattctttacttaattttaagatttattttgttgctattacttttcctaattacaaaaggaatgtatggtcaaaatcaaaacattacagatatttgtactttagaaagtaaaattttctagaagcctacctctaaagatatcatatttcctttagactcttcagttcatagcgagttcttgtgcaaccagccactggtttctttaattaccttaccattttcttccctgttaggagaattttcaattgcataacagaagttatttttaaaagcgttccagctctctcaaatttcattatggaaatcatgaaaagatggatcatgttcatccttttctctggactttaaaactatgtctttctcaagtctacacacaggtttgagcatactcagctttctctccctggttttcaggaataccttttcgtgcttctttttttaaatgaaggacttggactatgcggtctaaaagcactcatcatttgctattttctctgattctaccatccacagaaagctgcacaggtgaacaacatttgaacaagcctttgtgaagaacagctttcccaggcatacatgcctgtgacagggatcagagaagtgccgcaggaatgcagccatgggggagctagtgacaaatttggagtagctaatttttgaatcttattaattaacgaccctttgaggtacatgggtggttgaaggcagcatggaagctggtctagaaaggtagaatcttattatatggctttaggtgatactattctctttgcctcagttccatatatgtaaaatgagataatggaaattgaagcccggtgtggtaagctacactggtgactcacatctattatttgatgtgttcagcactccacttttctgggaacaggcactaactcgctgttttagtcagggttctttcaagggacagaactaatagggtagatgtatatgaaggggagtgtattaaggagtattaactcacaggatcacaagctgaagtcccacaataggctgtctgcttggctgagacgcaaggaagccagtccgagtcccaaaacttcaaaagccgacagtggagccttcagtctgtggccagagatctgagaacacctggaaaaccaccggtgtaagcccaagagcccaaaagccaaagaacatagagtctgatatttgagggcaggaggcatccagcacaggagaaagatgaagtctggaagactcagcaagtctgctcttccatcttctcctgcctgctttattctagctgtgctggcagctgattagatggggcccacccggatggaggtgggtcagcttctcccagcccactgactcaaatattaatctcctttggcaacagcctcacagacacacccaggagccatagtttgaatccttcaatccaagcaagttgacactcagtattaaccatcatagccgcctttatagaaatttcattcattcatttattcaacaatatttattggctgggcgctgtggctcatgtctgtaatcccagtactttgggaggctgaggcaggcagatcacctgaggtcaggagttcaagaccagcctggccaacatggtgaaaccccatctgtctctactaaaaataccaaaaaattagccaagtgtggtggcaggcacctgtaattccagctacttgggaggctgaggcaggataattgcttgaactcgggaggtggaggttgcagtgagcagagactgtgccattgcactccagcctgggcaacaagaacaaaactccgtctcaaaaaaacaaaacaaaacaaaacaaaacaacccagtacttattgagtgctatgtctgacactattctaggccctggagatatagcaatgaataaaacattcctgtctgcatgaagctgatattctgatagaaggcatcagacattaaacaaaattagtaaaatatgtggtacgtattagtccatctatgttactataaaagaatatctgagactgggtaatttataaagaaaagaagcttaattggctcacagttctgcaggttgtagaggaagcatggtgtgggcatctaattctggtgaggccctcaggaagcttccaatcatagcaggtgaatgggaagcaggcacgtcatgtggctgagagtaggagcaagagagcaagggcagggaggtcccagactcttaaacaaccagctctcacatgaactaactgagtgagaactcatttgtcaccaaggggttggtgctaaaccattcacgaggggtccactcctgtgacccaatcacctaccaccaggcccaacctccaacactgggagctaaaccattcacgaggggtccactcctgtgacccaatcacctaccaccaggcccaacctccaacactgggagctaaaccattcacgaggggtccactcctgtgacccaatcacctaccaccaggcccaacctccaacactgggagctaaaccattcacgaggggtccactcctgtgacccaatcacctaccaccaggcccaacctccaacactgggagctaaaccattcacgaggggtccactcctgtgacccaatcacctaccaccaggcccaacctccaacactgggagctaaaccattcacgaggggtccactcctgtgatccaatcacctaccaccaggcccaacctccaacactgggagctaaaccattcacgaggggtccactcctgtgatccaatcacctaccaccaggcccaacctccaacactgggagctaaaccattcatgaggggtccactcctgtgatccaatcacctaccaccaggcccaacctccaacactgggagctaaaccattcatgaggggtccactcctgtgatccaatcacctaccaccaggcccaacctccaacactgggaatcacgtttcaacatgagatttggagggaaccaacatccgaatcattttcatggtatgtcaggtgagatgtgccatggaaaaaaataaagccagaaagttagctaggaaagtgccatggtagagggatagaaagagggaggtattatgttctgtaggtggtcaggagtgacttcatccagaagatttttggaattggatcaaaataggatggtttaaaacaaggatgtggaatgaagagttagaataaaaggcctgttagaaacaggaaagaggaataaagacacaagtgggccaggcgtgatggctcgtgcctgtaatcccagcactttgggaggccgaggcaggcggatcacctgaggttgggagttcatgaccagcctgaccaacatggagaaaccccgtccctactaaaaatacaaaattagctgggcatggtgccacatgcctgtaatcccacctactcaggagtctgaggcaggagaatcatttgaacccgggaggcggaggttgcagtgagctgagattgtgccactgcactccagcctgggcaacaagagtgaaactctgtctcaaaaaaaaaaaaaaaaaaaaaaaagacacaagtgagtagcataaaagaaggatgtgcagctagagacagagaactttctaggttctgaatagtgtgtcagtgtatttctgataaatcttctccccctgtgcccccaagctggtatgaatcagttttctgttgaccaaagagcccaaactcatacatgtattggagcaaaaaaaacctgtgaattcaaggcctgcccaatgtgggagatgttgattaccttagaaaaacaaagcttggtgcttctgatcccaagaatgccgatataatagcagagtagcattaattttgttgtgtcctagcatcccagaaatcaaacatgcaagaaatatacatttcttcattttctttaaatcagattaactctggtcctacactgggctgatggaaaattcaaatataagcatcatatgttacccctagttctgttctccctctgcatccctcacccccagagccacaagagaaatagggaggcttgctgatgtccggacaattgggaaaaggcctctaatctccaagtgccttggagtcatccaagtcatcattgatcaagccttgcaaccttccctgcaagtccctggctctctgcttccatggcacaagaatagagaactctttcctgaggctaatggacaccatgctcctttgggtgcagtcatcccttctgaagtcacaacatctttgtggaaaaattaacatcttgaagcagggccaggtgtccactaatcctgtgatatgccaatcttttcagttagcttaggcttttataatagaccacaagagtaagtgacttccttctaggagtttcagctttccaccctgaaaaaactccctcaaagatttttttttccttttaataaattgttctgccatgtgtctgttgcacgaatgggtgcaagttcaaatgggaccccataactggtgattgtgagcagctaaggggcatcactaaaatactagatattaaagtccaagagtatgatgaggacaaagagtggttgtaaagaaacctaaaaaacaatgagggcaaactttatctgtctcacaatagttatgatagcatttaatgtttctggtgcagaagtaatttttctccactctgccttgtgctggaatcaaaacaatattcctcaatcttgttagggagtgaataacttttagggagaaggtctcaaatgggaagtggtttaaagtttatgaattgcaagaataccttttgatatctaaacaaagtgtactaaggaattcaacccacagaagagctgatattcaaaatcagaattattaaaaattgtagtggggtcagtgggggtttggggagggtgaacaggagtgcatgaagagcatcaaaataagcacaagtgatttaccattggcttggtttcttcggggaatttgaagaattcatacttatttatacgttttcaaatatttatttaagtgcctacaacatgtgaggcatttgggaatgtctcagttaacgtggtacataagttccttgctctaatagagctcacatttggatgtcttctaattctgaacctgaatgtaagagcacaatacaatcaatgaagcagtgagcccaggaagccatggatcttcacaagcctcaggaaaagtcaacatttaaaattttctatttaaagtccaagggcacagcaagctcttggtctatatgggaaggccatggactacaattcccacaagtccgtgcgacctctccgttctgcgcagcttcgcggtatgaggaagagggtcctgtcaggcgcactcttgttgcatcatcagcgtgcacctccacgatgaaacaggtctgggctacaaaagtatggccgcttctgaggcggcggtggtgtcttcgccgtctttgaaaacagacacatcccctgtccttgaaactgcaggaacggtcgcagcaatggctgcgaccccgtcagcaagggctgcagccgcggtggttgcggccgcggccaggaccggatccgaagccagggtctccaaggccgctttggctaccaagctgctgtccttgagcggcgtgttcgccgtgcacaagcccaaagggcccacttcagccgagctgctgaatcggttgaaggagaagctgctggcaggtactgcagcccgggtggggaccaggctgaggcggtcgctgcgagaggggaagcacattaggctttttgcgacgctcgtgattcaagagacaaaaggaggggaaagggagactgaccattgaattagctctggacaggaatctcgggcatctcgggcttggacttgccctggcacgaactcttgtagcctacttggcagttgtagttctcaacgggaggaaaaaaatcccgtacttacacaataaaaccctgcccttgggcgtgcagacctgttttctgtaatctgatcgatccctcaggaggcttttgttgggttcatgtggatgaaccccaaaaggaagtactggttctgcacccctaaagttgcattcctcaaaatgtattggaaatgcagatatacttcgttaaccaagacttaatatagtcgttttcacattttaatgggcctaacaattacttagagtctcttgtacaaatacagattcctaatccctgccctgtccgagattgtgattcggagagttcggggtatttttaggaaactgcaattctaaatagttgctccaggtgattccagtgtaagtagtttatggaccacatttgaggaacactaaatataacttggccactaagctgagagtgttcattttattgattcgtttattcacgtacactgggaaaatagtagaaaagcctagagaatcaccccgttaatcagctcggatgatttcacacataaagcatccaggatccttaagttcattggacatatacaataagccaggtctgtgctagcctatagagacttgaagatgaaagataactctcttaccttaactgagctgatagcctagtaatttctgcaccttgtggtggtaaaactagttagttaggttattcaaggccctccagagtttggccgtattctgtctcgccattaaaccagtaacagggactttcttacattgtttagtgtcccatggaaaactttacactttaaaaaaatgcaaaaacaaattattctgatgggaattataactgacagtacagatttaagtgtttatgggcaaataggtacactcctgcagatgtttaattccagtatcacgactacttattcttttattaaagttttgctttgttgcctgaaagtatgggtcatacagaggacgtcaaagtgaggaattgcatcaaggatatgtattgtggtatcatcatagttttttagttttccttcatagaactgctgctttcctgatttgttagctaaactctgggtttcttttcttttttttttttttttatccttaaggtaatgattaccattctttcagacaagtttctgacaaagccatattctggccttctggctaatctgcctctaagaactgaagtttcttgttgaatcttggttaaaatgtttcaaggctcttgctaggctagaacctttagctagagacattctcattatcctcgatttctatattgcttgtgattggcctattttgtatttatgttagttaggctagggctttccaaatgtcattgtaattggctgtcagaattgcttgggaagtttttgtttttgtttttgtttttgagatggagtttcgctgttgttgcccaggctggagtgcaatggcaagatctcggctcactgcaaccttcccctcctgggttcaagtgattctcctgcctcagcctcccaagtagctgggattacaggcatgcaccaccatgcccagctaattttgtatttttggtagagacggggtttctccatgttggtcaggctgggctcgaactcccgacctcaggtgatctgcccgcctcagcctcccaaaatgctgggattacaggcatgagccaccactcccggccttgggaaggttcttaaagatacctacattctaatgccatgtttgacaaccatgatcagtggttgtgtcctctaataccattccttgtctttctttgcattgattcctattatgctacaatctctactgtttgtctgttgggatccttcaaagccctaagtgtaccagaattttatagctagaaaataataaaaatccacgaatacttagttcagtggggtgaaccaaattccccactttatatagtagaggcagtacgtctgcaagttagaaggaggtatatttgggcacaaagggaagatagtatatttatggggccttcttactccaaggggtgtcaagttgaaaatgtaaagagttccccaaaaggtttctgttaatttatgagtgagagatccatgatggattgcaagtgacagatcaagggtttgaaactgaggtctggccttagaagtttatgtcaaagcagacaaccatacccttctaagtatggtgatgtcataattagggaatgacgccagggtgttccagagaccatggttctgactcagtagagtggtaattttgttgggaggccgagccacccagcatatccttttggccatttaatctggcttctgcatttccactgttgctttgttttccctcctcccttctctgtccactcgtttcgttttctttgctttattttctttctgctcagtgtcagtgttgataaggaaggtttgatgggcttgggggcaggtatagatcaatgtagcagttcctgcttttctcttctttctcacttgaagtctaatagccaatactctctcagtatgttatatgccatcatcaaaaacaatttatatttatccagaaggaagcactggctctgtctccccaaagtactttcaagtaacattattttgcattatcttttttttttttttaaacaggacaggatctcactctgttgcccaggctggaatacagtggcacagtcttggcttactgcaacctctgcctcctgagctcaagcagtcctctcacctaagcctccccagtagcaaggactataggtgcacaccaccatgcccacctaatttttgtattttattttgggtagagacagggtttccctgtgttgcctagggtggtctcaaacttccaggttcaagtgatccacccatctcggcctcccaaagtgctgggattacaggcatgagccactgtgcccggctcactttatgtttacaacaggaatatgagataagccgggctggcatcctctttttaaaaatctaaatgcttaggaagttaaggtgcaacttaatcttagctgctttccacataacgttttgttgagattcgcttcctttgtttatttatttatttttttttgagacggagtcttgctctgtcgcccaggctagagtgcagtggcgtgatcttggctcactgcaaactccgcctcccaggttcacaccattctcctgcctcagcctcctgagtagctgggactacaggcacccgccaccacgtccggctaattttttgtatttttagtagagacggtgtttcaccgtgttagccaggatggtctcaatctcctgacctcgtgatccgcccgcttcggcctctcaaagtgctgggattacaggtgtgagccacagcacccggcctagattcgcttctttaatgaattgaaaattttggttaggagaaggagacagcgaatgcagggagtttgggaatttagtgtatttagaagtagccctgcatgagatgtactcgcaatgttaggtagctggagatagcagcaaagaccatggaagagattcagaaatggaaattgaggacttttaaaagtatctttctatataaaaattaacttcttttcatgattctctatctaacagcccaccactaccaagaatttactagatttttgcgggttagcttggatatttacccaccttttaaaaatgccgtttttctcttagagaatgaattctactgtcttgatagctgattttggaatactctttctttataatttagggaatgtccattttaaaatcttttctttgctagtaatgaggtcatagtctcttaacatgtaaagtttgtataatactttttgtttgttttgaaaatgccatccccttttcctcccaagtttatgaagatcctacttcatttgtcttggtgatcaccttttttcatccccatttctctcatagaagctggaatgccttctccagaatggaccaagaggaaaaagcagactttgaaaattgggcatggagggactctagacagcgcagcccgaggagttctgggtaagagatatgaaaggcagttaagtgtccactgtcacttaatatcagaaagaaacactggttgagaacagatagattgactaaagccttctatttttcagtcattttggaatgtttcagatctactggatatatatagtgccatcttttaaagaagcccttaaatggtacaaggcctacaaggctgttagaaatagctacttttatgtgtggatgggactttgaaaaaaggtttctctctgtgcagaaaagagttaacatagcaggcctgaaattactatctttagaaaggcttgcttggacagcttgcccttggttggtatctgggaacttggattttgggagtgttcccacccttctctgtctgataaggctggttggctgtgcctcagatgttctgagaacaccagctttccttctaggaatctggaattttgttccactgctaaggcagagggtgcctgagtgatcatcctgtcaaatccccaataaaagctttgggcactggggccgggtgcagtggctcatgcctgtaatcagcactttgggaggctgaggcgcgtggatcacaaggtcaggaattcgagacgagcctgaccaacatggtgaaaccctgtctcttctaaaaatacaaaaattggctgggtgtggtggcatgtgcctgtaatcccagctacttgggaggctgaggcagaagaatcacttgaacctgggaggcagagtgttcagtgagccgagatcgcaccactgcactccagcctgggcgacagagggagactgtctcaaaacaaaacaaaacaaaacaaaacacagctttgggcactgagtttctaatgagcttccctgagagaaacattgcacatgtgttaccgctttttttgttgttggagaaagcagcacgcttgagcatcccctcacaggagggagagaggataaggaagcttgtgcccagatttctctgtgtctttttctcttatggtccagctgtgtattcttactacatcactgtaaaattctgagctatatatcaatcttcgaatgtgggctggtcttggggattcctgacaaggtagaaggctctgtttgtctgcctatctctaatctaatctctgagatcaactctcttgagaaggggaagcttgagagtaagtcattttcggctggagatgtattagttgaccgttttattgcttgtgaaggaaaattggtagaattgatcgaagggaataaaaatattttatccttttttattccatcttttttttttttttttttttttgcacctggtagagattctgaagtccaacttaatggactgctaaagtgtgtatacacaggctagggtatattttactctgtaactgcatccttagtcacagaactacctacatacattgggatccctctcagtgcccccttcccgacatatgagaaacaaacttttatggaacaatacttatctttttacatgctctggtattttatattttattcagtttcatttagagcaaaaattaggtacaaagaaacaacagcaaaccttgatctaagctatccaaagtaaatgagcgcttatttaaaaggataaaatcggtgaagaaaatagtatgcttcaagaacattatatactgtatgattttgtattttctaaaattatagatttatgttggcaataatatttttacttgaggttaaaatagaaaaaatcagttcgagaccaatctggccaacatggtgagaccctgtctctactaaaaatacaaaaattagccgggcatggtggcatgtgcctgtaatgccagctactcgggaggctgaggcaggagaatcacttgaacccaggagacagaggttgcagtgatctgagatcgcgccactgcactccagcctgggtgacaagagtgaaactcttgtctcagtaaataaataaataaacaaacataaaatagaaaaaaatcaggctgggcacagtgactcatgcctataatcccagtactttgggaggccgaggtaggtggattgcttgagcccaagagtccaagaccagcttagacaatgtggcgaaaccccatctctataaaaaattaaaaaattagctgggtgtggtgacacatacctatagtcccagctacttgggaggctgaggtgggaggatcactggagcctgggaagttgaggctgcagtgatctgtgattgcaccactgcaccccaaaaaaacaagcacaacaaaacaaaaaccccagttaataataacaagcatttattgagcatttactgtatataaggtcttcagttttgggtattcataagttctatagtttaattctcattgtaacctataagagaggttattactatccccattttacagaagaagaaaggaagaccctgagagataaagtaacatgttcactgtcatagaattagtgagtgacaaagtcaggatttgagcccagatctgctcagttccaaatcatctgccctattgtggatggcagatacctggtgctcctgcttttgttcctcatgccctgtgctcttggcagaaattagggcttcatgattcttaccagcttagcacttcagtagcctataccagttgattagagttggcctttgagttgaagcctgtgtttctaacccttctgctttactgttttccaggcatggcaccacaaatacaaggaaagagaggatcagatcagttgcttgtttacgaatagatcaattctattaatttcgggtggcggttcttcattggcatgcagaaaatagtgatattcaaggcagtgaatgaaagtttagtttttaccctgaacctaaggctagcttgtccaacctttggcctgtgggctgcacgtggcctagggcagctttgaatgcagccctacacaaatctgtaaactttcttaaaacatcatgagtttttttgtgatttttattttttttaagctcatcagctatcgttagtgtattatgtgtgtggcccaagacaattcttctttcattgtgacccagggaagccaaaagattggacactcttggcctaagggatcttgttgaagcttccattttagtattgtgaaggggctgagatttgtatgcgtggaagaaattgtattggaaacagttttctggttggaggctcaatttatatttgatcacacagggaattttatgatgatataatatgttcatatgtcagatgtattaatttttcttttaatgcatgtgatttccgaggagagagaaagtttaaaaaattgtaggtgtttagtcacagagtaagggatgtttgttgtccaagttagcagttctggaaacttatgagaagtcgatttttgattgtgtgataaaataaacactgaactctaatcatacttcggtttgtacactggctactggctgctttagttactaactgtatacatcctaagaaaatctcgtaacttcactgaacgtgtcttcatctcttaaaagaagataacgtctaccaaaactaagtcaaaaggttttcaaaaatattttacaaaatacctatagtatatagatatatactttatcctgtgaagtgctgtatacaggtcttttttatttttatttatttatttttttgagatgagtcttgctcttgttgtccaggcttgagtgcggtggcgtgatctcagctcactgcaacctccacctcccaaattcaactgattctcctgcttcagcctcctgactagctgggattataggcgactgccaccatgccctgctaatttttgtatttttagtagagtcagggtttcatcatgttgaccagggtggtgttggactcctgatctcaagtgatctgcccacctctgcctcccaaagtgctgggattacaggtgtgagccaccatgcccggccaaaaggtcttttttgaaacaaacaaacaaacaaacaaaactaaaactggacctatgcaaaaaaaatatacttttactttcaacatttttttttgcaatattaatggtgcagattaagaatttagctgacaatttaagattataacctgaaattcaggtttataattctatagcataattgctagagggttcacaagtttctcaaaaatacgtggtaggcaaaataatggccctctaaaggtgtctgtgtcctaatttccataacctgtgaatatattaggttacatcacaaggaacattagggttgtagatggaattgatgttgctaatcagctgactttaagatagattatcctggaatttccaagtggacccaatgtaatcacaatattctttaaaagtggaagaggaggcagaagagagagtcagaggagatgtggcagtggaagcagaggttggagtaatgtggttgctggctttgaagagtgaaggggatcacaagccaaagaatgggggcagcctctaaaagctggaggaggcaaaaaaaaaaaggtcctctacggaggctctagtgaaggattctcccctagcacctccagagaagaacacggtcaagccaaccctttgattttaagcctagttaaacctgtttcaggcttctcacctccccaactatgtgataaaaagtttgtattgttttaagacagattggtaatttgttaacagtagcaataggaaaggaatacacctatttatcataaatcacttaaaatgtaaataaaatttctatataccatttcaaaaaaatttttttaactttagaggttatagaaacagtgagaaaatttagaaaatacaagaaagttgcaaataaaaaattatccattttccacctttcatcaatagtcagttaacatttttgccatatttccttgtagctttttgtctatgcagatttttaaagttgagatctacttcactgtgtatacttatatatccatttttttaaacttaacattgtaacataaacattgttcatgttgataagctctttgtaaactttatttttaatggctataaaatgttccatcatatggctaaaataccatttattaaccatttccctatttgaggtcactgaggttatcaccagagttttgtcagaactgattttgtgagagatgtctttatagatagaactttttgtttgttttgtttttagtttttacccacacatctgtatcagccagatgtttcagattcttaaaatagattcctacgattggaaagatacaggtcttgtaagatgatcctacagaaagctggaaatacatgtatagagtccatgcctgtcctaaagagactctcatcataaacaaattctatctttttgatttgagaatgggatactaggacattggataagtttggagatagttatttttgtttttgtttttttaacggaaaagacatttgagtgagcacagaacacttgggagatagagtaggagagtagtaattgtgcaacagtgcatggaaaaccccgttattcatctgctctctaaattctccacaccttttcaaatgtggtgcctttgctcatgtttttcttttataagctgctcatctctctcagcacctttggttgtagaagtcctactgacctttccaggttcagctgaaatgccatttcctacctttgaagcctgcctgctgctcttctatactgctaatgtaaaatttcattttgttcttttagtttttgttaatatctgtctccctattatattgttaaatcacagctgaagccaggtcttatttatttctgtacctacacaataagtactggatacaattttgaatgattgaagggaaaaaatgccgagtaaaaattctgtccgggaaactaacctgtgaatgaaaagctgctggttggctaggtcccaactccagataatttttctatatgccaccaccatattagtcttcctaaaattctgctttcactaatcacctcacttcaatggcatttggttattcttaggttaaaatgagaggattaagctgggtaactctaagatggcttcttttaaattttatccttctgggtcactaaactagctcagaaaccatcatgagttcagtatttcagccatgttaaagtcaaacatgtcagtctgcttctaagacaccctgtgttcagttgataaacctactgttctcatccttgtatctgagagtttgtgcaattattttcttttttagaacatgcttctcttctctctgttgtgttccctatacatccttcaaaggcctaatacaaactccgaaatgcttgaatgaagcattctccggcctctttagccgtttaggatgctcccacctttgccctgctttggcagcggttctctctctgttcatttgacacttaatcatatactatcatattgttatttagcattattcactcattaggcaacatttcttgagcactgtgatttttctgtattttattttcctgatgagattataagctgtttcagagttaggaaatgtgtcacaggtttctttgtttttccattggaagtattcctcttgggattatgtgcatagtagttgttcaagaaaaattgattggagatttatttgaatggaatcaagtcgcattgaatctttcctgtttgcctcatcagcagcagtatctacaagttctgtcatttgaagagtattatgctcttcagaggattactgaggacagactgtttttgatcttagaccttgaactatatgacttagaaggacaatacagatgagtgtcatagaggttttgaggaggttggaatagactttatgaatgagttggggcttgagctgggcttcaaaggattgactttgaatactttaataaggagttggtgctgtaggcactgggaccctactaaggattgtttggggggctttgtaatgtgaaaaatagggtttcagaaatggttatgaagtggtatgaattggaagaggaagggataggatgtagaaccgtcaggtttgcagggatgtaggctggttgcagtgaggagaaagcctaggtgagttaaggtggcagagggaatggaaaggaaggggggtctgttcttagaccatttggtttgaatcttaactctaccaggtactggttgtgagatgctggacaaagttcttagtctcttattcctgtttcctcatctatcaacaggggtaattatactatcttttaaagtttttttttttttttttttgagacagagttttgctcttgtcacccaggctggagtgcaatggtgtgatcttggctcaccgcaacctctgcctcttgggttcaagcgattctcctgccttagcctcccaagtagctgggattacaggcatgcgccaccatacctggctaattttgtatttttagtagagacggggtttctccatgttggtcaggtgggtcttgaactcgtgacctcaggtgatccgcccgcctcaacctcccaaaatgctgggattacaggcgtgagccaacacacctggccttttaaagttgttataaggattaaatgggataatgaaaggagagcatttagagtagaatctgatacatggtaaactcactgaatggtatttgctgtaaatattggagatattttttctagtttgccaatcagtagtccttgtttactcttataattctgaattgtggtgattgtattgtgttcttatgcacagttatatctgttgatgacaaatatttctatacttacaaaaatgtggcttcttaacaaaaagagaagtgactaaatcctctcaccctcaccaagtgaaatgtgttgacgtatgaataatgtttgaaatttaagagaaaggtaggccattgttgtactttgggctctgtaaatacattcttcagccttcattttaccttgtattctttgtgttagactgatttgttatgtttctcttttcttgattgtatatactgctgggtgctaatcatctttaaatggttcattagctgtgataatggcttttgctttgtttaataatgaattctgtcaaaagactttatcatacccacttgaacatggttaattgtgccgtgtgtttttcactggtgcccatataaaattccagtgcgtcctttgagattgttctaaggcttcattgtctaattggctgggttaaggtttctactgagtttaatactttgagaatggggagaaaggtcttctcttgtcccttctttagaatttcttagttgcatgacaagttcaactgtttggagtaataggagccctaacattttgctaaatatctgttctttcccacttcacattacctaagctgggaaattatgaccaaaaaatatagctattttaaaaacctagttttcagaacagagtgtcataatatttctttctttgatttgtagttgttggaattggaagcggaacaaaaatgttgaccagtatgttgtcagggtccaaggtaagaatactgaaatagttctatttttctttaatgttcttaatgatctacatgtattgggtttttatcaaataaaaaataaactgagtaaactgcatgaatgggtatcattcctgagtattaattatgtctataaacatatctgagattgaaaatatcgagactgaaaattggaaattcttaattgaaaaaccaattagacttaaagaaacaatgctacagtgctcatcatttaacaaaattatatttagacttttaaaacatcatatttcttagatgattgggacttagaggtcataaactctagtgacagacttttttaaaccttggaatttttatagaaacaataccattttgtaaactgtgccctttgagcaaaaatatgctttgttcaatggttataaatgtttattaaagaaaagagtagggcctctttaagatgataaagtatgttcatatatgagagtaaccttgaatagatccaaaagcacttttccaggcacttgatagaagagagaaggggttatttggaggcaggagaggctggaaagctgtgaactgctggtagaaggggtctcttccatctctcaaagagagagtaatatctgtatcctaatgagtaattaggtgctggttataagtgctgggactaagggtcaatgaaaatgcacgtggaaggaagcttagtatgccaagaggtagcgaaaaatttcattatgttcctggaataaactttgttttaaaactcttgctctaaatgtgatataaattgttgataaaatgatttttgtttctttaaaaaaatctgttgtcaaagaccatttaaaaaacaatttccagttcattgcagactgattgatgacttttgtaaaatataattaaaatacggcaatgtaaaattgctaaataagtttctacgcaatctcattttctgaacttattatagataactggcctgtggaaaacacttgacgtagtagtggtttaagtattaaaataaaagccctgaccgagcgtggtgtctcatgcctgtaatcctaatactttggaaggccgaggcgggcagatcacttgaggtcaggatttcgagaccagcctggccaacatggtgaaacccatctctgttaaaaataccaaaaaaagtatccaggcgtggtgctatacacctttaataccagctactcggtagactgaggcaggagaatcacttgaacccaggaggcggaggttgcagtgagccaagatcacgccattgcacgccagcgtgggtgacagagtgagatgactccatctcaataaataataagtaaggtaggtaggtaggtaggtagataggtagataggtaggtaggtaggtaggtagatagatacatagatacatagattgattgattgattgatcgattgattttaaaaagcctcggagaacatattgcatgtgatgtctcattttggttatcaactggcataaaaatctgtgccattcaattggaaggaatcttagtgcctctgataaatgaaaagcttcagtgtggcttgctctgtaatcttcaaaatattggtgttgaaaaattacagagtataaaaattgcattagaatgaaggtgtttgacagtttctcagtaaatttttatactgtgcttactgacacatagagtttagaatctgtttctgatactggtttttgccagttgtttaatatttgtttctgaactcccaaagatgaacaatgtttactttaatatgggattatggatgatttttttttcacattatttggtattttctaaaatctatacaataaacaagtcacttttatgttaataataaaaaagatatatttacgttaaggaatttgtttgggtttttttaccaagataaaatatgttgagttcattgagatattcgttgttcacccctcctcccccaaaccacaaacacagcacactatatattactgaaagattttacttgtaaatttcaggcatattttcagaaatattatgactgaaaatgtaaatacatcattgactctggtataaattttgtaacagccaatttgctgttcagctacgaaagctgaatgtcatacagtgaaatcactgatcctcaaaatgactgtaacataaatagaataccacaggcacgtcttgttacagaaacctagttcttaggtatttcaaaaataggcatcgttgtcttgttagctatttatatttcttatccttttaattttatgtacctgttaaaagaactaaatcattaagagtttaatgttgaagattattttttaataaaaagtagttaaaaactgttaataaatattttttctttttttaaaagcactagaaggaatcttagagatcatcttatctagtgactttcaaaatttttttgactaagacccatagtaagaaacatattttatgtaatgaccatatagatacatacatttatgaaaaggaaaaattttatcaaacaactttgtgttagtctgtttgtgttgctgtaaaggagtagtcgaggctgggtaatttataaagaaaagaggttcatttggctcatggttctgaagtctgtacaagaaacaaggtactggtatctgcttctggtgagggcctctggaagcttacacttgtggccatgtcgcatggtgagagagggagtgacagagagagaggcggaggtgccaggctcttttaaacagccagatctcgcgtgaactcattgcagggagggcaccaagcaattaatgcaggatccgccctcataacccagacaattcccaccatgccccacctccaacactggggattatatttcaacatgagatttggagggggcagacatccaaactttatccaactctaaccctatgtatgatgtattcttgatacttttccttctatttcattaaaaaaaaaaatgtggctgcagccccctaacttggcccagatctaatgtccactttttcttcacttcctattttgacagatgaatttttatttgcatcacagtgcaactagaaaaattagacttctggtatgtgtaggatggagttacgtcaagagtagaaatatttagttctaggatggcaaatattcagtgttcttgttacagccatattacagaacagccttctctccctagccagtcgtaattggagatattgctaattgaacatggcctaacatttcttcttgctgaatcaagaaacacccttagaatcttcttcaacatggtgccacttcatacaactactgtcacttactagatgaaattctggcttttaagtaaaatctttaggccatcacattattttgcttccatctgtgaagactagacactaatcagaccacccaaatcatttcttgcatttcctcccattcagatcagggtaaaagttaagaaaagagccactgctctgtgttcctcattgtcttcctctcctgccttggagtgagctttgttctgccagtgatcatatttctcaagtctttttttttttccctgtgcctgatcatttaggattatgtgtataatgtgtgtgaaaagcatgtgaactttttgtacagtgccttgtgtatggaaattgctcattaaatactgttattactattcccaagtattttacttatccccaagtctctctcttgaggtccaggcctgttggagctttctagccacatgttctgtagacacctgaaattaattttactcaggcaagttctgttggaactcttgaatacagttaatttcttttttttttttcatggctatctgtgattgctggtgatgtaggcaaaatattgcactcatcagaaagagaaagcatgccagttctttaagggagagacagactttccttggacattaaagccagaaagaagtttctgacaataagagatattaaatgacagatagatggtgattttcaaaaatagttttacaacagatgtagaaatggagctacataaaatacagtttaggtaaaattctgagaggttaggctgatgtgttcctttggcctaagttgatctaagtataaaacgttgcttacctagaggagggcaaatagcccctcttatatcttccctaaattacactttctttgagccagtcattcagcaaaagctggatagcagatgtcgtactttgaaggaacagacagaaggaacagaagaaaacagatgaggttttggagtgctgtctttattagttttctatattgttgatcaaagttggttactttataaatgctttagaaaccagatggaaaggttatgaaaacctgaataatctaactagcatgtccagatataaaggtacctccatatctctgtgcaggtaaaccatagtggcacctgcaggcaaagccagcatctcctcagaaggcaactttgtatccccctccagtagttaaacaagtgtcatcattggagtgaatgaagtttccccttcttggtgtggtcaaaggatagtaactttccccaagaacacagtaacatttttaggttaaccagttatgagaactctaaagtgtggcttgagtaatgctcctatgaaacttagccaactcttgaagatttcagcatttctaatcagttttctccagaggctagtccagtttgtaccttttctatatacgctattaattttcatatatttcataaatactgtattgaaaattttaaagggcttatacttatgaactataaaaaaggactgttccttcttaatgaagacattcaaagccacatgtttttggtttgataggttttttaaaaagtgttctttctcatcctcagtaatatccctattttgtttgtgaaggtttaaatcacaagctttcaaaatcacacctcagttgagatccaaggaaatgattgtgtgtatactttctgtagtagaaacatttttctttctcctaaacagaacagaagctgatttgctgctagagatgtctagctaatacctgctgtggggtttagggagcttgacgatgagtaaagtagagagtagaataataccagtgagaaactgtgagtcccagagagtacacaggtcaatggaatgttcttcaggacctctcttttgttgcagtagaattacattgtaatgaatacagtagtagaattcacggttcccaggtatacgtcttggagaattaacaactccaaagcacagactctacgtagaatttaagccagtgaaaagaaatattttagactccataagataaaatgttagggttgaatgtgtgtatctccatgtcttttttcttctatcccaatatctttttggtcgtgaggctttgtttcagctgaaggcttaactgtgtgggtgaatttttctaaatggtttgtggataattgaataaaattgaaggataattataactagatgccaggacaagggaaagctaggagacagctgatttcaatcatcggttcgcagggtgtggtctaaggactcctgagactctttcagggtgtctgttgaaattgaaactattttcatagttttgcctttttaacttgcaatcccacaaatacatggtagagtttttcagagattactagatgtgcaatgacatcattgctctgatggctaatggaagttttaaacatttttcagctttaatttctaatacaataaatctaggcagatataacatgtttttaaaaaatgtgtgccagggtttctcaataagttttaagtgtgtataggagttctgaaagcaaaatgtttgagaacattttgatttgatttgatttgagaatgttgatttagatattgtctcccctaaaaagaatccagcacgtagctacatacaatataattgcagaccctggagtgggttgagacttagcagatgaaatctagatattcaaaactatggtgaaatgtgaagaattgcacacataggcacttctctagcatgtgtatcattctgtcagcaactttttattaagctgctactgtgtttctatttaggaaagaacacaatagatgagcaatgggaaactctagctgagagttcatacttgcagaaagtaaggatcaataaagtatacttggaaaacagtgaatatctctgtaggtcatcatgtgctaagatgtgtgatatgtgtgatatgagagctcagtgagataaaccagacatgtctgttgttgccattatatccagtcctctctgcagtagttgtgtttattgaagttttcctgttacactgtaacctcttagagggagagcaatctatcttatgtatctgtgtatccttccctagcacttaggagaatactttggacattcatagtccttaagaaacatgatcgaatttgtggatttgatatatgccttccttctttctatgtatggaatttgtatcgagcacctactcttagtcatgctgtggaggtgggtaaatggaagttgggatggattaaggggtggctttgaaagctgaataaggtttgatccttagagaagagtgggagttcaaggccagggaagtggcatatgtgccccaggtgcacaaaacaccaagagtccagagactagaatgggcattgcatacttgggaaacatgttaaggttcctagttcaaactcgttgcagagcagaatactgcagatacattcaaggcatagtctgcaagattgcaccatggttttcttatgcaactaaacagactctaaagacaaaaaaatcataaagcattttgatgctttgctttccttatgggagctgactgtaaccagatgagtcaactctagccactgttaactgcgaatcattctgtattttctttcttagaaaataaagatgatgatggtattattatctgttatttaccagggctagatattgttactctaaactctttgcttcttctcatgaggcattattgttttccacattttaagataaggaaattaagctccagccggaaagactaacttggtctacaaattgtggtacagtcagaattcaaatccagccagttgaccctgagcctgtgctgttaccattgttgtacttctctcatacttccccctgtggtatgcttagtcgaggttgattgtcccaaaatatagaagcaggaatgggtgtctcaggtgatgagactgtgtttagttacaaaaaactaatttttgtcaatacctatgaaactttaaaaaaattaattgaaatgcgttggaatattcccttctgtattatatttatttttaaaaaatctgagctagataatattaaggtgatttcatcgaagggccttaagctgttataaaatgtctgcatacttacaaggttttgaagttttaatatttttctcatttttgtcttgggtcccttcactagcctcataaatttgtcatgaataagcttatatttctgcaaagtactttgagttttcttttataaaattgctcacataaatacagattattttcagtgggaaataaagttcttgcacttttttcactacttcatgtgatgccccaaataaaatttgcgtttgaccaaagtgaaaagagtacgtactacaagtgtgtcctaagatgagaaataagacaatcctcacgtaactaagaatgatctaattcttcacttgtgaataaagatcagttcttagaaacgattcttgttcctgagatcttaagtagtaatttatctttattaagaaaacacatggccgggcgtggtggctcacgcctgtaatcctagcactttggctttgggaggccgaggtgggtggatcacctgaggtcagaagttcgagaccagcctgacaacatggtgaaaccccatctctactaaaaatacaaaaaattagccgggcgtggtggcgggtgcctgtaatcccagctactccacagggtgaggcaggagaatcgcttgaacccgggggacggaggttgcagtgagccgagatcgcaccactgcactgcagcctgggcagcgagcaaaactccatctcaaacaaacaaacaaacaaaaaacacatttaatagttaagtcactaattctgtgactatactggttttgctctttttctacagatttagcttttgtttaatacatgacctagttactaagaattgtcttagtatttcatgtaagaagtactaagttggcttatttaaaattaattttaattgtatatgtgggaagattattgaatcttatgatgaccatggagtcaaggctattgtaccattctctctactcatggatagacttgaacattttccttaaacaaacttctcagtataaaggtggtttgagaaatttgcttacaataataatggtcataattattaagccataattatcaataaaatcaggtttatctttctcatattggctagtgtgagacgtttgttaatgttcttcagtttacacaattgctttccacatattaaaaacaaaacaattgcagtctgttgttttagcctgtattttgtatcaggttggtagtagtagtgaaattctgtgtaaacttcaagacatgcataacagtttttgtttgcctcacggcccattttctctcttgtttcccttcctctagagatatactgccattggagaactggggaaagctactgatacactagattctacggggagggtaacagaagaaaaaccttacggtatgaagctcatctaatgtaggcctcttttctaacatttaggaaaagtttctgtgcaggtagcattttaaaacaaatctctgatattatcagccattttaattctcagtgtgtttctttgggctaagaagattggaaattgtttatcgcattgttgcttacttgataggagtttttgaataaagatttattgtgattgcctctttttctatagtgatgttttaagtgttcagaattattcttccaaataacctccttgcaaaagcatgtatggctaggatttaggttattttccctagtaaacgagaaacaaagcagagatactctgttagatttcatctgtcttgccattaaaaaaaaatatattacctgtcagctgttgaaataaatgtaccaggtttagtactttaaaacttgtcatgtttttgtgctttcggactatgtaaaaagaggacagagggcaagctatttctctggaagtaaaccagaactcactggggcccaccttaagtttcctactatcccttctttcactaccgtaaggaagaatagataaattaaatggtctcctagcaactctcacagtgcttatgctgtttataatgcagcaattgcagttttctaagtcagttcacctgcatcattatgtcaccaatttgtggactgtttttttgtttagtgttatctcttagtcataggcaagccagcatttggcccccttatatttttgtgttgattatccttattacgtactgcatattgccccagtagtgaggccaacctttttattgttcataatagcttcattttttctgttaacatttatatgtagcttagtatcttgctcaattaatcaagcaacataatgaaaagaaaaattactgattgatttcaaggcttttcaaaaacagatgttgaaatattcttggaattattattattaataaataatagcagaccctcacttaactgaaagccagctataaccttcaaccagaagactttaagattaaggaggcatagggcaataggaggacgtcagagacttccagaggatactaaagtatttataagtacttatgtaattaagtctcctgtatctctgactccatttaccaaaccataataaggagaatgattattattcagaacagtagtcctggggtaatataattaaggctggggggtgtgggtaccacgtggtgaaaaatataaggcgcactagagtagacaaatctgggtttaatttctagctctgcccttatctagctgcgcaaatttgaaattttcttagtctctttatgttgtagtttttccatctccaaaatgacaataatgatagcaacctcatagtgtgattatgaggattgattggaggagaatgaatttggaggtctcatagacaagtcatgaggctcttatagtagtccaagcagagatgatggtaagttggaccagggtgccagtggtagagacagagttttcctattagaaaaatttcccatgattaggaagtaaaattagcaagacttgatttttagttgattggacaggatagcgaggaagttgtcaaccatgacctaggttttggggttttaaaattggttacatgatagtgtaattcattgaggatgctggaaggggcccagggtgacaaaaatacttaaacatatcctttcttcctattcttaagcattttagtattttaaaaagctctatgctgtattaggtaatttgtaaccttatttacttaccttaaagaaagctcagtttgttaaatcatctcattgtaatgatgcagtaaatcatagagaaactaagaacgtttttcaggctgtgaagagaagagcttcctacagtttattgaatagtatttatagtcccggaaaatgagagctcagagaattttgctgattggcatgatttttctgtgtgctttcagtaaatcaacaaatattttttatttgttgaagctgctatagcaggtaccaagggaaagatagataaatgtaagacctagcttgtgtccttaaggaacttactgtctaatggagaactctgaccaatattctcagccttctgagacctaatacagagacctatgaccaatatcttataatgccttctttactatcctgaaataaaattcagagatacttgaatttacttatacattgagaaaaatcaatatgatgtagtaaatggaatataagtaagaaataaaagtaatttataataaagtaggtgcattcatatgtaagcacacagatattagcagactaaaagtcttttggctggggtgcagtggtgcactcttggctcactgtaacctctgcttcctgggttcaagtgattcttctgcctcagcctcctgagtagctgggactacaggcatgcaccaccatgcctgactattttttgcatttttagtagaggcagggtttcactttgttggccaggctggtcttgaactcctgatcagcactcaaacatacagcataattgtaaatagtgaaaaatgctatttaggaataatagagtgttatgatagagaacaaagggaaaggccctgttacatgctttgatgtttgagtctaagccagagactcattttcttattcctctgagctagctttcagctgtctgaaataacagttaaaaatagtatttgtctagataggacaaaatgacttaagaacattaatttgccattgactgcatactgagttactttagccaacatcagttgttcttgacaggtcaattaaaaactgtgtttctagttgttacaatgactgggtggggtggtgacaccagctgccttcagtgggtggagaccagggatgacagatgtcctgtaacacagaggatcgtagaacacaatgaagaattgtcctgtgtactgtcagacttcaggatgtctgccagatagtcatgcaggtgtatttcagccatgaggctgaaaccatgtctcttttggtcctcagtagtgtatttttggtgtggtatacggcatacagaatgacatatatgacatatagagtttgaatcaaaaaagataggcagcagaggcattctcagaaaagatgactgcagataagccgggaaaggcaaagcatcttcctgccttctgctgctgtcttctcatccacatctaggtattaagtgtctgctactattgccagtgtctctgaggacacacagcttcagtgtgctcatctgttctccgctgagctaaggacactaagaccatagcttcccaggctagatgtggaccaagcatccgggaaggcctaactgtccctgtactgggagtagttttttctgtccctcccatgagtcaacaaaggtagaaagaaaagtggaatctcatgctaatcttttattctaaacaccaccaccccttagtcctgagatcagatgttaccaaggtcttctcaaatggacgtagctgatgttgtatctaatggtactgtctcctcttggactgtatatggtttggctgctgagacttatcctggagtaagctcaagagttgaatttagtttcaaattgtgatatgaaccaatagggtatatgctataattggactagtgtgtagctgggtataaaaattcttacaaagctgtttgcatttaaacttttcattataaaatgtacaagtaaagaaaactgaacaaaaaataaaggtacagctctatcaatttgcacaagacaaatatctgtagctagctatcacccttagtcaagaaatagaagattgctagaaaccacacttgtgccctatctgtcattaccctgtcctccttttgcaaagataactactgttctaacatccaatgctatggagatggttttaaaactaaggcatagttttgcctgtttttgaatttagtataaatggaattaaacactatgtgtcctttggtgtctaaattcttccacttattatatttttgagatccatgttggtacatgtatgagtattttggacttttttgttgctatgtagtatgccactgtgtgaatatactacacacatactctcccagtttggggctttgtgaataaagtgctgtgtatattttatacctgccttttggtagacacatttctaccgtcatttcttttgggtatatacccaagtggaatataggtcgtgtgtgtgtgtgtgtgtgtgtgtgcgtgtgcacgtgtgtgcctgcatgtgttcctgggttatagagtgggtgtatatttaactgtactggaaattgtcaaacagttgtccaaagtgattgtacttggaaaactttgcatttccactaggagtgcataagcattccacttgccccacatacttagctattaatagtgtttttaattttggctgttctggtgagtgtgtagtgataattccattgtggttttaatttgattattgatgagatttggcaccttattaagtgtttttggcttattagccatcttcttttttgtattgtctgttcaggtctcttacccattttttgttttttctttcccttttgagttgcctttttcttatacatttgtatgagtttttgttttttattaagcaccttccattcgaggatgcataggttctttatatagtctggatatgttctcttcttttgcctatgtgtgttgcagatattttctcttactttgtggcttgcctttttcctctcttgtcttttgaaaaacacaagttcttagttttaatttagtccagcttatcaggccttctcctttatggttggtccttttggtgtcctgtttaagaaaacttttttgactctaaaagtgtgaagatattttcctatgttctagaagctgttattgctttgcctttcatgttccctctgcaatccaccttttcttcctgcatggatgtccagttgcttcagcactttcccagtactcttgtgttctcttctttattacacatcaagcacccacttaggctattgtttaaaaaaaaatctatttttttacattgatcagtttgtttatacttgtatatacaccagactatattaattgctgtagttttagactatctggatatctggaagaacaagtccttcctgctttatttcttatagatttttttctataggttttttttttttttttttgagacggagtcttgctctgtcgccaggctggagtgcagtagcacaatcttggcttactgcaagctccgcctcccgggttcatgccattctcctgcctcagcctcccaagtagctgggactacaggtgccagccaccacgcctggctaattttttgtatttttagtagagatgaggtttcaccgtgttagccaggatggtctcaatctcctgaccttgtgatctgcctgcctcagcctcccaaagtgctgagattacaggcttgagccaccgtgcccagccttacaggtttttttttaatagctttcttatcaaagtaaagaagttgccttttattcctaatttgctgagttctggttttttaaaatcatgagcagatattaaattgtatcaaattttttttctgtatctattgatttttctccttattcacatattaaagtaactttacatttctggaataaacccaacttagttgtaatgtgttatcctttatataaattgttgcatttgttttgctaatatttagtttaggatttttgcatctgtgtttgagtgagattgccctgtatttttctttcctcttaatgtcctggactggctttgatatcaaagttatgatgacctcatacaatagtttgggtgctgttctcattttttctattctcaggaagaatttctatcagattggtatttttttctaatgtttggaagaatttacaggtagacatctgttcttgagttttctttgttaggaaggttttaaactatgggttggatttttttctactagctattggatatactattttttattgcttatatcaatgtagataattttttctcctaggaatttgtcatctcatctaaaatttcaaaaatattggtataaagctgtttataatagtcccttatgaccttcgttttattttgaaataatatcaaacttacagcaaataacttttgctaaattacccaagagcaagctcagccatgatgtcccaccaccccaaattcattactgcaattcagtttgaagaccctatttattttttaaaaacagctttctgaagtataattggcatacagaaatactgtatttaaaatatataattttaaaaattaatatacattcacctataaaatcatagctataatgaaaacagtgaacatatttatcatcataaaagtgtctttatgcccctctctccattgtgagttaatttttgaatatgatttcagatatggattcaaggtcattttttgcatatgtacatcgttttgtaaccattttttaaaagactatcctttctgtggttgccttgaacctgtgtcaaaaaacagttgtccatatctgcatacttttattttgagacttttaattctattccattgatgtatttatttttaaaccagtaccacactgtcttgattattgtagctttgtaagtctttaaattaagaagtgttagccctccaacttgttctttttcaaagttgcttttgccattcttggtcctttgcatttccatatgaatttttgaatcagcttgtcaatttttatgcacacacacactcaaaatctactggcagtttgagattgttttgaagctatagatcaattttggaagaattgacatctaaacaatatcaagccttctgacccatgaaataagatatctctcttcatttatttaggtcttttatagccatatttttgtagttttcagtatcagatctttacatcctttgtttatgaaatctctgagtacctcaaattctgaagtttcaatttctaatagttcattggtggtatatagaaatggagttgatttttgtatattgatcttgtgtttttcaaccttgctaaactcacttatttgttctagttgtgttttgcatagattttatattaggatggctctaaaatagactttttttccaggtctagattagctctgcttctaaagcatgacttttctggggtgtctatcaaatgacttgtgcattcaacaaagtttcttcattctggatggttgaaattaaaacatcccccagccttgtaagagctttggtagtatttctttagttaattttgtagagaccctgtatgtatgtatgtacagcttagaatttagtcagagtatcaagggtgccttcatagacatttctttgtctgtgtattttcctcaaattccagctgccactacttcctcagattctgatctctgttcagtgagatcactgtgctttgacgttcccctctctgtcccacagttaagaaagcacctccagacaaaaacaagtgatcatgagacttgctttgtttgtttctttttcctcagggtttacagtgcttgctgcctgttgtctgtctaaaaactgttgcttaataattttgtccagtttaacagctgtttatggtggcaagatttgtctagtcacagttactctttcgtagtcaaatatgatttttaactcaatcatattgtttttagctctgtagtccagttaaatctcaactatgatgttgtgagttcactggaagagtaaaattttaagcaaataatgatgtataacatgatcttgtatatattcattttatgaaaatgattttaaaaaattaatttcaaatgaatgctgtcacattgatggcttattaatttactaaacaaaaaataattacccaagtcctatgacacttgtacctcttttaccaaatatgtttattctgcctagttattggatatatttactgtggacattttattctgtttctttttaaatactttggaagtacagtctttatacttatgtcataagaacgattattattaatttgattgaacttatatcatgttttagatatagccagtttgtactacatactcatgtaccacaagcttagattttattataagataacttgctgtgtaggctgcctagtaattcaaacatcagatggatgattggcctaggtgacttttaaatgcccttcagccttgagattctattattcttcagcaaattaaattcagcagatgtcttgagtgccattttaatagtgtatgttatatacgaaaaattgtctttgagaagcttagaatttcattggtgggataatacgtacgtgtgtgtatgtgtgtgtgtgtagaaatcaaatatgtagaaagaagagagaatatagaaagaatagttaaaaaatgtgtatgattaattacagagtgaacagcacaaaccacgaatgcttgacatgttcagtcagagaaagagacaatatggcagaagtagaatgagaaagaacacatcttgtcatcttgtgtgtgatgatatcagcaaaagagggccaccaaagcagcataaaggagaacacagttgcaggagcgtcagtagagagaccagcgtagcagaagtagaaagttgtttggccttgtttttaaaaatatgtggctaagttgttaactattgcaattttatcaacagtgacatttccttcagcaagtgccagcatggtgacagcattggctgtctagatctggaaatcttacatttgtatgactaaggtgccgctagtaataatgtcttaatgttgctgtagactaaaattttttcatagaaaaatcctcatctgtatcatgagatacatctgtttgagaaacagtatgaacagatcagccatctgaggtctgccttgttggagctgctaggtgctagagaaattcttttgagtgttatagctcttctgtctgtttgagtctagtagattctagtcttttgtttgtgtttagcttttaagggtcaaggtcatactgaggttaaaactgtcttgttgggttgatattaaaatctggacatagtattccatgctgacttttaattctggtattggaagaataattcaaagcatacttgtttttatttaatattgttcaaataaattcaaatttaatacacatataccagaataaaaagtttagataaattttctacaaaatggtaaaaccactgaaatttcttaccattggctgtgaactaaacagattatagaatatttctgtgatttagtttattactaaataggaaatatgtatgaagacatctttgagtatgaaaattctaaatttcagtatatcatagattttagtttttaaaattatagaactgtattttttgtctttttttttttttttaaatatggaacacggtcaggtacagtggctcacacctgtaatcccagcactttgggaggctgaggcaggaggatcacctgaggtcaggagtttgagaccagcctgaccaacatggtgaaacccagcctctactaaaaaatacaaaaagtaggcatgtgtggttgtgcacgcctgtaatcccagctgcttgggaggctgagacactagaatcgcttgaacccaggaggcagaggttgcagtgagccaagatcacaccactgcactccagcctgggcaacagattgagacctgtctcaaaaaaaaaaaaaatagataaataaaaataaaatatggaacacttcactaatttgcatgtcaccctcgctcaggggccatgctagaactctactttaatattgcatcattttgtttgaagcaataccaaacaaaagctgaaaacatgattaacagatagtaaaagctttatgtatatgtcttcattcatattttctaaaatcattgtttaaaaaatgcttgtttagtaagcatgctaaaatccttgcttatgtgtgttttttttttttttgcactggcttatttttgaggccggctgggagtgttcatgtaaaacaagagagaaattccaacaacagagaagggggaggctggggcggggggacagataaatgcaattttacttgacaacagagttgaatgtgagtgtgtaaaatttctgccataacataaaacagatttgaaatcttaccaggtaaaatttaaaatgtggataatacttgttaagtgccacattaagttatttacaatatttgatccctagagaaacttagaaaagaacttacggggattattttgctgcttgtattctgatcacttcattattaattactgcaggatcatttctatagctaatgtgggattttcctcagatcttcttaaggccatagtcagaaccaactgaatatatatataagatgattgcattatttttattggagaaaaattgaagcaaatgaaattgttttaataaagaatataagactttctccctcttttatcttgttaatgtatattttattctttttaacaaggtagaattttggctataaaacatatactgtaatatatgcttttggaaaaagttttaaatgaattttcagggctgttggtgctgtgaaaatagtacatgtacttctgtggttgttttagtgtcttttttgttgatttttggcagataaaataacacaagaagatattgaaggcattctacagaaatttactggaaatataatgcaagtgccccccctgtaagttcaattagtaaatttggaaaaatgtttacttttcttttccaatggttaacatcactctagttaaaatacacgagtttcctcttagcatatggcaaggcaggttttaaatctgatgtgccaaatgttaaagtgaaggtgagacaggatgtggagcttttgacactctaagaggcagtggaatgtggtcttctttgtttctgagtgtggccccagcctggcatctgtgctattacagtgtttattggcttttctgattctatcaacagacataagggcagttaaggagcccagagatgtctcttttcctagaactgttgtgaagggaccagtcccgtctgggagggaagtcagagctgtgagtcagagtcctaatgtgcactgcatgtcaggtgctgggaccattcctattgggcacaatcttttgcttcactattctctgcagccagcgaaaccgatgagagttacaacttattaaaaatacaagtatattgctttactgcttgtcttagtttgggctgcagtaacaaaataacataaactgggtagcttataaacaacagaaatttatttctcaccattctggaggctgggaagtcaggatcacagtgcagtgggctcagcgtcgggtgaaggcctgctttttcacagatggcaccttcttaccgtatcctcctagtagaaggggcaaggcagctctctggagcctcctttataagcgtactaatttctttcatgagggctgcgccctacgacctaattacctcccagaagaccctacctcctaatatcaacaccttgggggttaggatttcagcatataaatttggaggtttggcattcagatcataataccatgtagccatattttcgtgcacattaccatttcaagcaaattgcctcttttgaaaaaaatggctgaattggttataggatatgtcagggtaagtttctgactttttttttagaatttagtatttattttgtatttaaaatcttgagtttttttcaggaacattgaaatatctctgaggagacgctttttaatgattttgcctcaaatgtaaaaatttaaaaattttagcaagatctgcataaacgttattttggatcattgttaaatttatttatatttatgtataagaattgttttaatattttctgtgattattgcaaggattttgttttctagtaaaattttatcacgaaaagctaagatacgctaagtaggttatttgcttattagcttcttagaaatgttttggtaacttatataaaaatgaatattatagtagagattgtttcaaggaaatatagctgagagtattatgaccagagtctactaaattccttgtgccttttaacacagaatgaggactagtaaggacaagacatgaatacattgtctctagaaagatgattaaagaataaaattggtaacactgcatattgtgtgccagaatgaggttatatcagccttagaaatatttagaaactctatccatgacagcattatggagtagattagaattaaaaattcattcattttttagaaggattttcattgtgaagcactgccagtcatccttcctttccatgctaaatctgaaattatcatctcccaatccttccaaatccctctcaattcttgctctcctttccttccatttctccttctctcatctcacaagctattctgcattaaagaaagatggacaaagactttcgactttgatgaagagaggtgaagtcgtagaagcaaaacctgccaggccagtgactgtatacagtatctcccttcaaaaattccagccaccatttttcacattaggtaagatggagaaatttgaaatcatttgtatttacgtgtatttttaatttgtatttggctacttttgtgtcattttaatagatccgtaggatgttggagattttttaaaatttgaatttaaggaaagttaggatttctttataccttttttggtaacacatttaatgagatacctgtagctatatggaggttcagaaatgcgtttctaactgggctgactttttcatatattgtactatgttatcttactagaaagttgaaagtaacatactttagatctctatagagaagagtaggtaaggagtgtatatactttttaaattttaggtttttattatcttttggatgcttttcctcccattttggctagtacctaatacattccgttttagaactgacattaattttccaatgaaaacaaagcatttttagtttttggacaagaaacccctcactcccttcttcaccacctatcacttactattaaagatcctgcaaatatggaaaaacatgggtaaggcagaaatgtattcctgaatacatggtcacatttttaattcaagttatgaattttaatttctaatatatatttgaaatgtaaagactaaaaagttcatttctgttgtttggaaattttatgatctggctgcagaaagttgtaaacatgtaagatctgtgaagaatccaaagccgtggttcttaatcctcagactcctttaaattgagcctacccttagtttcacagtgcactgaataggattccgtttagaaataatgtccccaaatcttttaatctaaactctattgcttttttattggcattattgttttatctgtgttgtgtttctgcaggatatggttttgtaccattagaaaaaaaaagtcactttgtttcttcatgttcctgcttctaaaatatttgacagataatgaaaaaaacacacttaggaaggttgtgctccattccatggaaatgaagcagctggtttgacacagtagatattctctatgaaagcaagaaaaaactcagatttttcagattgcatttaagtcagaaatattttattgactagggagagtgtaacgggccaaaagagctgtcttttcactcaagtcaaatatcacgcaagagtgctagcgcgcctgcatttcatcccagtgcccactttcaatttcagcagtggcccccaaccatgagctgactaaagaaagcagggggtgattaaaatccccaggtggtgagttttgattaattcccccaaatggctttatttgtaccagtaagactcgaagcagctagaatatagtccttttgtgtggaaatgtggcagctcttttcaggaagtcttgctgatggataaaaataatggagagctctgttcttaaccaataaacttgtgttagattgtgttaagaagatatttagatttacattcagttctgggacattgtgcaattttaagttgttttatgatttcttcaggagtatttccaagagaacatttaaataaactgagttcttcatgtgtagtacggtaccctaaacataattcttgtcactgtgaaaaggggtttttggttggttggttggttggttgtattttttttgaatgtacaagtcagaaaatattttaaaaatctaccgctcatgatggcaaagctgccatttctaaccatttacaacctattaaatgaacaaggcatataaatctgaaaatattttttaaaatctcaagctcatgatagcaaagctgagatttctaactatttaaaacctattaaatgaacaaggctgaagtattaaagtggtatgccttgccagttaatttaaaatgtgttcatgagtttgtgctgtttgctttctccacactctgacttttcagtctcacaaacacatatgctactggatgaataatttatgttttagtgcataaatattttatcactcaattgtttgcatagtgcatttttacatttgtttagggacatcatttctatgtaaagtggatttcataggaggttagcaatttactatgtcactgttaacattccagatgttgaatgtggaggaggtttttatatcagaagcttggtcagtgacattggaaaaggtaagcataaaaatgaattatgaattatcatttagagaataatactccttttcaattggaagagggaattttccgtttttcttatttctgagtactggccttaggaactgaactcttgctgccttcagctttaaaagcattgtaggtttctggcttgcaattatcagcctcagcagctgcagtgaaatgtttgtaatgggaaagaagagaaagagagaacagaaaacgaagacaggaataatgaacgtagggccaacatcttttcaagtacaaaagattttaactcaaactagggatcaaaaaaaaaaaaagatttaaccttctaaaagttattttcaaatttttttaaactggaagccgtagtcttataaacagccagaaggtttcggttctggctgtgccatttactggcagttgtcgcactggacaggtcatatgatctcatctgtaaagtgcggctaatctttactccatggggttggctgcatgagttaaataacaaaaatgtgtgcaagttctttgttgattttaaagcagcttataaggtggattattaagtattattttgctacttaatcatttctttatctgaggcctcttggttcttatattggattattatacttttgggtggttttgagagatttcaattgagtacggtcatttgaacaattacagactatgaaatactgaatcgtttatcttctggattttttttctaccttttgttgccatagaactatcttcctgtgccaatgtgctagagctgacccgaaccaaacagggaccatttacgctagaagaacatgcccttcctgaagacaaatggacaattgatgacattgcacagtctcttgagcattgctcatctcttttcccagcagagttggcacttaaaaaatcaaaacctgagtctaatgaacaggttttgagctgtgaatatataactctaaatgagccaaagagagaagatgatgtaattaagacgtgttgagattggcctgggaatatcatcattttctagttgacatttgaatcctgtgtgcagatgcagaatgacaagctgcattcaaaagacaaacaatatgtcttttttttttttgcatgaagaaaaatgtctatcatttacagtttcaatagcacataatttattttctatgcattataaatggccttgcagttggctcagttgtttgttgtgttgtgaaatgttttaggattttttgtattgtgaaaatatgaatatgattggattcagaaaaattaactttctgaatttgatctgtcttcagtcttgtgaaaaagttgaacaaatttcctaatcaaagaaaaaagtatgagctccatgtttctttagtttcacaaaaatgaccataatttagtgttatttttactttatttaggcttcctggtggcttcattttattgaaattctttaaattgtttaaagtggccattattgatctctttcttctgttttggagagtttattattaaaaacatttctttgataaaatggccatcatctagtaatacctgtgtttgtttagatcttggaaatgaataagctttgataatatttgtaaatgaaccaaattattactgctaccactaacaggttgtaaatagaagactaatacttaattaaagtcaccttcctaccattagagcagaagacagctcctatagttttgtattttggcagctatgagatattttcatggtaatgtcaacatggtcaagcactttgtaccaagttattaagtaacataatttttaaaatttaaagaatgtgtcttcaactaaaaactttattctttagcatttatttatatttctctgtagggtgttccctgtgacattgtctctttagtttgctctttcaagagatacttacagatgttgagatggctgccctgcatttccagctaatctcttctgctctaaatatttaaaaacagttcttctcaaacattttcattcagatagctttctgaaagttccctatccctctttaccataattttttaaatgtagccacattgtaatagtaaacttcatatataatgagtgcttcatatttttgttatgggaaagcaatatattatgcagccagtctgtagaaacattcagatccctcttcctttactcaaatacagtttcaaaaggaagactcatgagaaatttcataaaatacaagtttttagatgtttatgctttgcctttctttttaaaggtgttttcctgctttgtagtctctaactctgaaatttaaaatatgtaaactaaagtggttttatttgtgcttaacccaatttaaactcaatgtaaaatgttatatatgcatcagtacagcattttcaacatattggcaacatattttaaatgaaaacactaaaacaattcttagtatgagacaaaactgtaaggaaaaagagtgttaataccatgatgcattaacataaaatatcaaacacacaaagtcataaaatgaaaatttacagttttacctgttcatatctagtgccccacagtgtgtgtcaaccaaaggtggcagtggctacatctgcctgttggactggtacaggttacaatatgtcctcttccattgcaaattaaagtccaaatagagaaatacttaggttttagaacacatcagaggtatttctgctgtatttttcaccttaaaaattgacacagagtttactaatagaggagtagagattgttgaccatttttaaaaaacgatagccactctttttcttttatgtttaaaactgaagttttgccaaatgggaaaattactgttacctctaccatcttaatgtagtaactttagaatttaaatttttatattactattttcctttttgttgttcacatagtcttaaggcacctatacttttaaattgactttttcatttgatattatctatatgtatgtagttgtgataatgattattttaattatattactttatactcttaatttatttagagtatttctctattgctgaatacttaagtagttttaaattttattatgataaattcctgggagggggattatttagtgaaataatatgaagaactttatgacttatgtttgccttattgcattcccaaagagttgtaacattttacagtgttaccatttgagtaggggttttatatgttgttgctaatttagtaaacataggagagaaatcaaagtttttctgatttgcttttatgtgatttatctgtatactttgttcatttatataaataaatgtcttaatggtttctatacatatttgcatgagttatttgtgttgtaaatacctgatagaaggatttttcacggtctgttgtccttttagttttaattttcatttttgctaactaaatttgctaattctaataactcttccccttttatcattgtcagattaataagtatgaaaaattttaaatttattgagactttaaaatcttactaactctcataagcagttgaaactgagatactctgaaaagttcaagactcattcataaaacaaattagttttccctgatagtctggtatttaaataccaactcagtttttttttcatttttatcaaaatattcaagaaatttctgtgtcttatatttttctaggtctaaaccttcatgacatgataaagttgttttacttgtaagaaaacgataaaagatttaaaaaatcctgaaaatgtttcaacctggaacataccaaatcacttcattttgacactttaagttttttatatttgaaaaataatgtcttaaaagttgttaaaagtcatagaattattttatttatagtcttaaaatccaggacctttatgtaatagaaatttgctctttgcaaattcaaagttttgaaatgtgaataaaggctaaacacagtttcctctacctgtactgactagatatttttttcttaaatacttgaattaaaacaagccattgactcatcatcagaaatgagttactgtattaaataagagtgctttgtatcagatcttcagtacattttatgtcccctgaccagtttgaaatttgtatcagatttacaatgaacattttgaggttcaattagatggtgaattgttctgtttcaaagaaagtaagtaatttaccttatatcatgatgtatacaatagaaagagatgtgattcaaaagcactgtaaaatgccaaaacatttaaatagaggaaacgataatagatatgaggtttatgcactgaaatgagtataatggccttgtagttaaatttaaagagagggattgtcttgaaaccatttctttctctaaggtatgtatgggcagagctctagattgtcctaattcttcattaaatactatttattaagcacatttattaaggtgttgaatcagtagtaccttcatttgttaatgtgtgagctaaattctctttatgaataggaatatcttcagattgctgctataaatactgataccggccggaaagttgaagttcgggaattattttgctcttcttatccttaacccttaaaatgcagcatattaactttatttctgtctttaccgttagtcaactttttgatcctaggtgaatcacttaatctctttaggtctcaagtttccttatccttacaacaaaggagacagactagtccatcttgaagaatctctccaatgctaaaatattaggcttccaagtgtagataatttgtgattattttgcttaggaactcattcctcatgaacttgaacttttatatttatcagttctggggaattcccatccttcatttctttggatatttcatctcttccagctagtaatcctatttaagtctttttgttttattctgtgtctaattactctttcatattttccatctctttatcccactgtgctgcatactggggaatttcctccaatcttttttccagataatgaatgcctttttctatttttatttactgtttaacaatcatatatttattccaatcactcttgtgttttatttttatttatttatttattttgacacagagtctcactctgttgtccaggctggagtgcagtggcgcaatcttggctcactgcaacctccgcctcccaggttcaagtgattctcctgcctcagcctcctgagtagctgggattacagacgtgcatcaccatggccagctaatttttttattttttatttttagtagagacgaggtttcaccatgttggccaggctggtcttaaactcctgacctcaggtgatcctctctcctcggcctcccaaagtgttaggattacagacatgagtcactgtgccccggccttttgtttttatttctacaccaggtttttttcctccaaaatctgcctcttcttttttcatgtgttgtcttagtctttcattaaggttttagtaaaaaaaatattttttttactttggtatttaatatacagaaagtcacacataactgtatagcttagtgaattttcacaaaccaaacatgtctataatcagcaaccaagtcaagaaacagaacatcactaagccctccagaagcccctactgctccatcaagattatagattagtatttcatgtaacaatatagattagtaattttgtctgtttttgtgcttcatataaatagaagtatgtgatatgttttcttttatgtctggcttcttttgcacaaagctacaatcatgaggttcttccatattgtggctgtcttagcttgggctgctatgacaaaatgtcatagactgggtgactttaacatacttgtttctcacagtactggaggctggaagtctgagatcagggtgtcagtgtggttgggttgttgtgagggctgtctcactggcttggagagggctaccttctcattgtgtcctcacgtggctgagagaggaggcttttgtctttcttcctcctcttatagggacgttaaccccatcatagtggctccaatctcatgaccttgtctaaatttaattacctcccaaaggccccacttactgttcattgtcattgtttactattattcagttattaccactgttgatctattttactgaatgatggacacttggttagctttcaattttgactattttgaataatgcctctatgagcaatgtaatacttgtctcctggtaaacatgcacacatttctgttggaatttttttttttttttttttttttttttttttgagacggagtctcgctttgtcacccaggctggagtgcagtggtgccatctcggctcactgcaacctctgcctcccaggttcaagcaattatcatgcctcagtctcctgagtagctggaaatagaggcacacaccactatacccagctaatttttttgtatttttagtagagacagggtttcaccatattggccaggctggtctcaaactcctgacctcaagtgatttgcctgcctcagcctcccgaaatgctgggataacaggcgtgagctactgcgactggcctctgatggatatttctaagactggaatctaggttgtaaagtatacacgttaagctttagtagatagtgcaaggagtttttctaagttgctgtaccagcagcatatgggaattctgatggttccacatccttatcaccacaaagtattttacgttttcttcttaaccatttaggcacatgtttactttatcacaatatggttttaatgaacttttctctgatttcttagggtttttagttatgtgtattttttagtctaattttctatgtagtctactagtctatttagtcttattgtctagtctaacagtctctgttaactcagttatctgaaattcttatggagtatgctctaatattgcttgttgaatctcccaattctcagccaaggtagattgtgtcctaccttgtgttctttgtgttgtaaacttggattatgaggtaattcagtgagactttatgggagtgtgtgtgcttgggttgagagtgtccttccagagagattttgggattgtttctgctaggcacaccagagatatcgctgttccaaaatcctcatcgtaaatgatcattgcagagatgttttattattgttgtgttgtgttttgtttaatttaaagcctaagtcaaagaaaagcttccttgttttcgccctgtgtttatggtaaattgcattgtagtctaccattttattaaatgtatagtcctttaagggtaccagttttatgcctatgtttgtgggtgtcacagttccaaaacctgcctctcaagatccacacttggtttccatccccacttaaaaggcaaacactttggttacagagaggagtaaatcttgcctccctcccccactacctggattgctgtagcatcaagaagtatgtttaccactctgggtttcagatcgttctttgttttggaccctggtgaatttccttagtataagttcaattattttttaaaggaatttttaaaaagtcacatttatatgcaacaaaattcaccattttaagtgtatagttcattgagccagcttgaggtttaacttgctctttttctagttttaaagtagaggcttaggtcacttctttttaaacttaagcattaaatcttatcagtttttctttgagcactgctttagcggcatctcatgagttattataagctgtgattcaatttaaaataatttccattgtgatatttcactttacctattacttagaagtatatcatttactttctggatattagaggattttctatataaaattctctagttgatgtcttgtttaatttcattgtggtgagagaatataaaatacatgaacataaaatgtgtgatttccattcttacaaatttattaagacttgtttagtgactcagaaatggtctaccttggaatttgttccatgtacattggttaagaatgtgctttcatggttgttgggtggatcattctgtaaatatcaattaggtcaagcttgttgcttgtgttattcaggtcttccatagccttaatggggtttgttttgctttgttttgttttctgtttttggtctactttgcctatcagttacagtgagaggagacctgcaatctccaattataatgttggacttgtctgtttcttctttcagttctttttttttttttttttttttttttttttcacaagagggaggctcactgtgttccccagactggaatgtagtggtgtgatctcggctgactgcaacctccacctcctgggttcaaggaattctcctgcctcagcctcccaagtagctgaggttacaggtgccagccaccacgtccagctaatttttgtattttagtagagacggggtttcaccgtgtttgccaggctggtatcaaactcctgacctcaagtgatctgcctgcctcagcctcccaaaatgctaggattacaggtgtgagtcaccgcacccagcccttctttcagttctatcacctctttttgctatatttgtatgagagctttattattaggggcacatacatttaaaattgttatgtcttattgatagattgatctgtcattatgaatgtctgtattcattcctgatagtatttctttttctaaatatttttctgaatgtgtctgctattaacatagccactctggctttttaaaattagtatttttatggtatatatttttccttttttttttttttaagttttagatgttatgtttccttatacttaaagtgggtgtcttataggcagcatatatctgggtcttgatgtattatttaatctgataatctcaacctttttgttggagtgtttaggccatttacatttagtgtaattatagacatggtttgatttgctataccatcttttcatttgttttatatgtgagccatcttttcattgttcttttttcatctttgaccattttctttagtactgaatactttttttgtatttcattatatctattggctttttagttatacctcttaaaatttttttttctgttttatgtaggatttataatatacatctttaacttatcacagattaccttcaaatagtattttaccagctcaagtgtaatgtagaaaccttacaagagtatattttcatttctgtctcctaatttttatgctattgtctataatacattaggtttgttgttgtttgtttttaccttattgctgttggctggggtcagcaaacattttctgtaaagggctagatagtacaggcataccttggagatactgtgggtttggttccataccaccacaataatacaaatatgcaagaagtggatatcacaataaagtgagtcacacaagtcttttggcttcccagtgcatataaaagttttgcttatactacactgtagtctgttaagtgtgcaatagtgttatgtctaaaaaaacacataccttaattttaaaatgctttattactaaaaaatgctaacaatcatttgagcattcagtgagttgtaatctttttgctggtggaaggtcttttcttattgatgactgatcgggggtcaggtgctgaagcttagggtggctgtggcagtttcttaaaacaacagtgaagattgcaatatcagttgactcttcctttcatgaaagatttctctctagtgtgtgatgctttttgatagcattttatgcacagtagaacttctttgaaaattggagtcaatcctctcaaaccctgctctgctttaacaacctaagttaatataatattctgaatccattgttgtcatttcaacaattttcacagtgtcttcaccaggagtagattccatctcatttcctgagatggaatctttgctcatccataagaagaaattcctcatctgttcaagttttatcatgagattgcagcaatacagtcatgtcttcaggcctcacttcacttttaattccagttctcttgctgtttctaccacatctgtggttccttcctccattgaagtcttgaacctctccaagtcatccatgagggttggaatcgacttcttccaaattcctgttaatatttatattttgacctcccatgaatcatgaatgttcttaatggcacctggaatggtgaatcctttccaaaaggttttcaatttacttagtccagatccatccatccagaggatccactttcaatgccagttatagccttatggaatgtatttcttcaataataaggcttgaaagttgaaattactccttgatccattttctgcaaaatagatgttgtgttagcaggcatgaaagcaacattaatctttttgtacatgtccatcagagctcttgggtgaccaggtatattgccagtgagcagtaatactttgaaaggaattatttttcttagcagtaggtctcaacaatgggcttaaaatatttggtccaccattctgtaaactgatgtgctgtcatctaaactttgtagtttcatttatagagcacaggcagagtagatgtagcataattcttaagggacttaggattttcagaatggtaaatgaacattggcatcaatttaaatcactagctgtattagcccccaacaagagagtcagcctattttttgaagctttgaagccaagcgtcgacttctcctccctggttacaaaagtcctagatggcatcttcttccaatataaggctgttttatctacattgaaaatctgttgtttagtgtagccaccttcatcaatgatactatctagatctcttggataacttgtgcagcttctacatcagcatttgctacttcaccttgtactcttatgtaatggagtggcatctttcctcgtacctcatgaaccaacctctgctagcttccaacttttcttctgtagtttcctcgcctctctcagccttcatagacttgaggatagttagagacttgctttggattagattttggcttcaggaaatgttgtggctggtttgatcttctatccagaccactaaaactttatccatatcagcaataaggctgttttgctttcttattatttgtgtgttcactggagtagcacttttaatttgcttcaagatatatttctttgcattcacaacttggctgactggtgcaagaggcctagctttcagactatcttggcttttgacatgccttcctcactaagcttaatcatttctagcttttgatttaaaatgagagatgtaggccaggcacagtggcaggcacagtggcatatgcctgtaattccaacacattaagaggccaaggtgggaggattgcttgaacccaggaggtggaggttgtagagatcacaccactgcattccgtcctggatgacagagcaagaccctttctcaaaataaaatgagaggtgtgcttcttctttttgtttgagcccatagaagccatagtatgatttttaattggcctaatttcaatactgttgtgtctcagagaatagggaggtctgaagagagggagagaggtgggggaatggctggtcagtggagcagtcagaacacacataacactaataaattgtttgctgtcttatatggatgtggtttgtgatgcccccaaacaattacaatagttacagcaaatatcactgatcacagatcaccataacagatataagaatcatggaaaagtttgaaatattttgagaattagcaaagtgtgacacagagaaacaaagtgagcacatgctgttggaaaaaattggtgttgatagacttgctccatgtaagtttgccatacgccttcaatttataaaaaacacaatatctaggaagttcaataaagtgaagtgcaataagatgaagtatgcctgtaaatatttcaggctttccagaccatagggtttctgttgcaactgctcacctctgccattatagcatgaaagcagctatagaaaatatacataaatgaggcctgtaatcccaacactttgggagcccaaggtggatggatcacttgaggtcaggaattcgagaccagcttggccaacatggcaaaaccccgtctctactaaaaatacaaaaatgagccaggactacgcatgcctgtagtcccagctacttgggaggctgaggcaggagaatctcttgaacccgggaaggggaggttacagtgagccaagattgtgccactgcactccagcctgggcaacagagtgagactgtctcacaaaaaaaaaaaaaggaaaagaaaatacacataaatgaatgtatgtggctgtgtaccagtatatcctcatgctctagcttgccaacccttgctttacactgtcagttaccttctaaagagattaaaaatcataacaatatctattacgtttattcacatcctagtgtcatttcttccttatgtagaatcaaatttcattctggtatcatatttcttctttctaaataatttcctttaatattttttatagcacaggtctaatagcaatgcattatgcaattcattgctattagacctgtgctataaaatagcaatgaattatgtcagtttttatttgtctgaaaaagttttttgtttttgaaatatacttttgctgggtatataaatccatgttgcataacttctcttttcttcagcactttaatgaagtcactcagttatcttctggcttgtatagtttctctggctgccttcaagattttttcattgtctttaatttttagcagtttgatgtgtctaggagtgattttctttgtatttatccttttgggggcctcttaatttctttgatcctttttttcttttttttttttttttaatcagttttggtctgtctcctcaagtgggctgaaaaaaaaagaaaaataaaatcatagtttaaaaaactaattttggaaaattttcagctatcatttcttcaaatatttatcctactctatgctcccctcctcccctttccttctgtgactcaaattacaggtatatttaaccattttatttgttcacggcacttggatgctctgctttcttattttttgtctttcattttggataatttctactgacctatcttcaagttcactgattcttttctcagtcatgtctagtgtgctcaacgcctgttgaagaaatcctttgtctttaatatcatgttttttatttctagcattttcatgtaactctttgttctggtttccatctctctactcactttttttttttttttttttttttttgagacagagtctcgctctgtcacccaggctggagtgtagtggcgcgatctcggctcactgcaacttccgtcccctgggttcaagtgattctcctgcctcatcctcccgagtagttggaattacaggtgcccaccaccgtggctggctaatttttgtatttttttagtggaaacagggtttcaccatgttggccaggctggtcttgaattcctgacctcaggtgatccacctgcctcagcctccccaattgctgagattactggcatgaggcactgcacccagctctgctgacattttttatcttttgctgcattttgtctaccttttccatgaaatcctttaacatagtagtcatagttactttcaattccttgtctgacagttctgacattcaagtctaggtctgttaatagctttgtgagtctgttaacagctttttttcattcttgtctgtgtgttttgtatttcttgattgtatgccaaatattgcctgtaaaataaacttagataagtcatacttctatccagaaataggcacattttttgtgtccagtcattagtgtggagggaggttggggcagtctagtcagtggctgaactaggtttggatttgttgatgctatacttagaatgcaccagacttccattcactgcaagagtgggctgctgcgctttgtgattcatgtgaggcctgaattgtggaagggtttttccttagtgtgtccctccatgctcagatttcagcaagtcttcatatctgtgccacagaaggaatctgacccatgctctttttgacctccccaagtgatcaactgttgcttgttatagcttgtcatggagtaagagggtgtttttttagttttcatcctccagccttggtcttgggccctgagctcctagactccaggagtggatggaatccagtgatttctcagtaattcagccccttctccagtagtggcagatctctgctttgtatcagtgcaagatcctgggctgagctcattttctgcccttcctcgagtggcagacagctcttgctttcacccttctaccaaaggcagtgcatcttttcttgggcctctccccattgaacttatgactttcacataagagaagggctcatgtatcagagaattctgtgactttgtgccacatacagagtctctcagttctcttgccctgccccagtcttttttgtgagcacctagtagagacccttggagaagagcaaggaagcgagtatggacttcttttgtgtctgtcgattgctttgtttctcaactgctactcttggactttaagaattcattaaaatttcagctgttttctttttttctttttgtttttctttttttttttttttttttttagatggagtcttgctctgttgcccaggctggagtgcagtggtgtgatcttggcttgctgcaacctccgcctcccgggttcaagcgattctcctgcctcagcctcccaagtagttgggattacaggtgcccaccaccacacctggctaatttttgtatttttagtagacacagggtttcaccattttggtcaggcttgtctcaaactcctgacctcatgatctgcccgcctcagcctcccaaagtgctgggattacaggcatgagccaccgcgccaggcctcagctgttctctttttacctgctgggatggctagttttctgtgtcaacttgactgggccatgggatgtccagatatgtaattaaacagtatttctgggtgtttctgtgagggtgtcttcagaagagatttgcatttgaattggtgaactaagtaaagcagagggccctgtctagtaggggtaggcatcatccagtctgttgaggacttgaatagaacaaaaggcaggggaaggttggaattgccccctctctgcttgagctgagacatctatcctgcccttggcactcctggttctcaggggttcagacctggattcctgggtctccaccttgcccatggcagactgtgggacttctcagcctcctatctaattaataaatctcttcatacacacacacacacacacacacacacacacacacacacacacacacaccctatgtatccttctgtttctctgcagaaccatatctaatacacctgcttttatgacgattacctatcgattctgtattctgccaaaactgaaaacagttcatttttccatctcttctcagagaggcttgtcagccattagttctctgatgggctcaagaagttatgcagttttttttttctcactgttaggatggaattgatattctgttgaaactttctatacctaagtggaaacttgttttgaggttattttctctacttacttttgctggaaatggaacactctgtatctagttaagacacataaactgacttgtgataccataatgttgtgttgaattttatattcttagaaaatcatctgtcaaggtgttaactaatggcaaagcatttaataaatcagcattcatgtattcaggtgctctgaattatctgacttttaaattcttactttataaatgagaaaattggggcatggaaaagttaactctcctaaccccgaattattacattattaaggacaggacttagaggccagatatcttaagtcattaatattctttggctcacagaattggcagtataacctaaaggtaataactaggtgattttcttttatatcaattaaatatgtcagttttcaaatattcataagtacctactgtgcagggaaagaacatgccatacaaaagatgtagtccaggcctttaagaaactttcatttaatgggaactcaagaagtgtacatataaggagggaagtagcagtatggtacaagataatacatacatatcagtgaatgatattgccaaaaagtgctattgatagagcaataattcatttctgcaaacagctgctgatctcctactgaaaacagaggagggagaacaggacgcctcgtggtcaggatagaagagaaagaccttgagttgagccttgaacagtatttaatattcaaaaggttaagagaggagagcaattgaggaggggagaatagttccagcacaaatgatggtgtacaagatgaacacagtcagtaaagagcagactggtctggatggagaggaggatttgcatcatttgggattacgtcatttagacccttgaaagccaggattgagtaaagccacagtgaagcgactggctcgtatggaagctttattttaagaagattaatctggtagtgacatgtgccaaaaactgaataggtagaaatgagatgcagagagcccagttagaactaagtctggtgcagtaatgcaggattgaggcaataaacaccaaactacagtatcaccagataatggatgtttgaacggacggtttaaaggaaaattgatggtatttggtaatttattagataatccagggccatggaatgagaggggaaaatgactaaccatagtcatcaaatggtttttcttaatgaatctgaattttggtgtaagagcaacattttcttaggccttgcctagttggtacagctgactatgataatgactgctaccatgcttgttcctcttttagcagctgtgagtcccccaccagccaaacaatgagcctcttgaaaaggacgatgccttttcacttctctccaagtgcttggcaaataggaggccttttgaagttactttatagttaggggttcccagtgagtatttgaaatattaagtcatgcccgtggttgacagcatggccctactgctcatcatcagctattaaccttaggcaagttaatgaacttttctaagccccagtctactcatttataaagtgggattattaataatgtctacttcataaaattatgaagcctgagttaggtcattcagatagtgtttagtctgattcttcgaacctagtaaacagtcagtaaacagaagcaaatgccacatgcctgatttatatccaaggggagaaaggtaaaagtgaaattttcatgatttatggattcaaattatacatttcaaagatgctttataagctattgttttggtaagaagaattgagctgaaacagaattttctgacagcagtgattattaaatggtgaaataggctattgatgtctttagaggatatagatgttcaccttttgcatataagtgcacaaaaattcactaagtagatatgtctgtctacacagagagagagagcgtgagagcattaaagttagtaaacatccccctcgcttttttttttttgagacagggtcttactctgttgcctaggctggagtgcagtggtgcaatcgtggctcactgcagtctcaacatcctgggctcaagcgatcctctcgctcagcctcctgagtagctgaggtgtgcaccaccacacccggctaatttttaaatttttttattgtaaaggtgaggtttcaccatgttgcccaggtctcaaactcctgagctcaagcaatctgctcacttcagcctccaaaaatgctgggattacaggcgtgagccaccacgcctggccagtaaaccccattcatttacatcatcttacttgtccctccaaaatcctgcaaagtaggtaggttctgtctttatttgttatttaggtgaagaacttgaagtggtgttgaggaataggtgttttgccaagagtcacgcagctggagtggcagagctgtatactcttctgattccaccaacgctgtttacatcacatctggagaaaagtgctctgaggcacagatgtttagtgggagggatgagacacaggctgcaatgcctaaagataatcgggaataaaagcagaaaacaagacgtttgtttctgttaaaatgagacagaaaataaggcgtttgttgtttgggattgagcacttggagaagtggggagcgatttgatttgggtgagactgctcctggaatgctgcatctggttctggactactcattactaggcttatagaaactagctggaggaggttcaaagaaaagctccaaaatgattagcgggctgacgggattgatttataagaaatattaaaagaattaaatgtgtatagctcagctaagcaaagatgaaagagaccagctaaatgtatacaaatatctgaaacgtgcaaactttaaaaagagagattaattatttaacatgatacacgggggcacaatatgcagtcacaggatgaaaatttcagctgagtatctagaagaattccccgatagtgaatctgttaaggctgtctgtagtgtggcctttccctggagaggcaatagaaatttcaagtcttacgattttaaaagtttcttgggaactaggtattagatgatgttagagaattattattaatttggtcaggtatgataatggtattgtagttctataagaaaaattgtattttttagagttacataccctgaaatataagcatagaatatgatgtaggagatttgctttaaaataccacagtaaggaaagaaaggaaggaggaagaaaagaaaggaaggggaagaaagggaaaaagaggcaaagaaggaagagaaggtaagagaaagaaaaagaatgaaggaagaaggctgggcactgtggctcatgcctataatcccagcatttaggaggccaagttgggaggatcacttaattaagcccaggagttcaaggctgcagtgagctgtgattgcgccactgcactccagcctgggtggcagagtgaagccctgtctctaaaaaaaaaaaataagttaaaaagaaagaaaaggatagatgaagtatggcaagatgttggtaatgttgaacctgaaggaagttaatatgtgagttcactttcctcttcagtcttctttatgtatgtttgccaactttcataataaacaatttaaattatattttcctgatcaaaacttagtagcagtattaatccctgggcttcctgactagaacagcctcattaccacatgggcagagttctggccgaccagggaccacgtagtggttcaccatcttgctctggtaatgtggtctgggctgaagggccctttctaaggttgtagatagaaatccaggaaacttgttagaactgcagacctatcagggtacctgcaggaggtgagtctactaaggtgaaaaagcagagggcagaggtcgtgattagcagctgaccgccccctgcttttctgtccctcattcgtggaaaattgagtggagctcaattttgagtggagctctaagtagctccacttgtagacattgagtggagctctaagtgtcttcagaatagcaaaacactagttttctttttcttttctttttttttttttttggagacagagtcttggtctgtcgcccaggctggagtgcaatggcacgatctccgctcactgaactctgcctcccgggttcaagcgactctcctgcctcagcctcccgagtagctgggattacaggtgcccaccaccacgcccagctaattttcctatttttagtagagatgaggtttcaccgtgttggccaggctggtctcaaactcctggcctcaagtgatccgcctgccttggcctcccaaagtcctgggattacaggtgtgagccaccacacccagctgcaaaaccctatttttcttgaatggagaaacactttccccttatttattgagtttgggaagcaagaagaggggtaattcattaagtgaaaatttccaaaatccagaaaacatcgataaagcagcagcttaatttttttaaggaagaattttttaaactatcttcttttgagcctctttaggaagacctcacgtccttgccttgaatgttgagagtgggaaatccagggaggttttggaatgcatgccttatgtctgcttttttgtttgttagagaaatataaatattttatctaggttttgctgatggcagtcaagcatgaacacaacccactgtttgagaagctgtaatttctgaatttctgcagagtgcacatctaggccagcaaatggcagtaagagtgaggtggatttagctcagtgtaaggatgaactccagaaccatcggctctgactgaaagtgaagcggcagccgcgttgtgggaaagctggctggagtctctctcataagcaggcattctttttctccagcccgtcactgtgttggtttgggcccacggtaagcctcctggcctctaggctgtaacccccaccatcctcctctgcctcgcctccagagtgattgttctgaagcacaactggatgtcattccccttcctgaactcctagcacctacagggactccatcccttgtgccccacatacctcacacgtagacattcctaatgaagatttgattgaattattgtaaactcagtgcctcccactcttctagttgcctctctgcctgcctttgtacatttatttatttatttatttatttatttatttatgagacagagtcttactgtatcacccaggctggagtttagtggcaccatctcagctcactgcaacctctacctcccagactcaagcaatcctcccacctcagcctcccgaggagctgggaccataggcacgtgccactatgcccggttaatttattgtaatttttgtagagatggggtttcatcgtgttgcccaggctagtcttgaactcctggactcaggcgattcgcccgtctcagtctcccaaagtgctgggattataggcgtgagccaccatgcccagccgctagcactcatcttaatcgtatatttacttatctggctttcccaccagactgcgggctcttcaagagtaaatgccatgttttcacctttatttccccagtttgtggcacattctaggcactcgccatcatgaaataaacctctggagctgtgatattacaaacgtgaaaagatgacgagcactcagcaactttcagtgagtaaacaaaggctttcattcagcatgtatttattgactgccctgactctgggctgccttcctgtctgtggttcaaggagagcatagtctacagaaccagagacctggctactctggaagttagacttaagcccaccccggtccttgaatggggaaatatttcccttcattcctgtgttttagggacagaaagatgagtaatgcagtgatacatgctggaaatgtttattccactacccgaagctgcctctcaacttaacaatccatgaaagaaacaagatggtatataactttttctaatttgtgatgcctttgtttatttgtttccggttaaaagaggaggtggcattgaattgtttgtttggtttggtttcttcttcaataagaagcatcttaatataactagactggacatctgtcccattttcaaaaattacaagtttcgatcattgctaaattgtacagatcccaatctgtctgctctgcatacatttgcatttataaaagcagaagcagactagcagtctttctaatgcaatcccccaaatgcatgaagtattagattgcttctccctattggttcatgcattgctaaaggcttaaaaggatcattgattttaattatttaatgtgtacagcaggctgagcttcctttcttttttaagggaagaaccttcaggggcattgctttagttttttaatgttaaatctcatttttctttgaaaataagaagttaaagctgtattcacacaagctctcaaagtgccagattttcattgtgtttttaaaccatctaggaaatgtttgattctaatgaaacattactgctgaaaattgggctgaaattgctgggctgaaaatattgttataacttcacatgattccagtgttgtattattattttttctttttctttttttgacccgatatagatgaagcgaagagacaaggagcaatccaatgtgtaataaaaaaaggcagcctgaattgttgttgctgtttttgaaatttaagctggttttcaattaaattcagtaaatggtccaggactataaatgttgaacattttttaccgtgtaatttaaattttagtcttattgttttttttttggttttttttttttttgatggtttacattttccccatggaaagcagctatgtcatgtcggcatgattcatcatggtaacatctcgggttattttggtttgtgttatgttcagaaagcggaatgccaaaaataaagagtggtttgtgatgtctagtgtgtcttcctttaacaaatcaaaggcttttatttaatccacttaatgggacactgcagaaatttaaaaaatggaagtcccatccacagaaggcaggtactatgatgtaaaaagtttaggtgggggattaatagagtgatcatataatttatgagctaaaccggaggcacttttttttttgagatcgagtctcactgttgcctaggctggagtgcagtgacgtgatcacagctcactgcaacctccgcctcccgggttcaagcgattctcatgcctcagcctcctgagtagctgggactataggcgcccaccaccatgcccagctaatttttgtgttttttgtagagatggggtttcaccatgttggccaggcttgtctcaaactcctgacctcaggtgatccgcccacctcgacctcctaaactgctgggattacaggcgtaagccaccatgcctggcccagagacacttttgagagtgaagaggaagctgagaataattcactgatctacaactgggaccatccagggcaagccagatgccattaccactagctagaaagcttgccaaggtctcatttaccttggtatatagcaaattcttctttgaattctggaaattctggtaagtcattgaggtagctctgtgccaaggagcaatatggtagaattctaatatttcaggcagtacaacactttcctgcatttgtagcaggtaaagggaggtcagggcagaagacaaaaccactgggactcgacaaagggcataaacgtctaatgcacctgatgtagctgatggtaaattgttatcagctaaagatctttcataataaataaacttatcatttgtaggagggcacagaaatcgtggaaagctgggattcaggttgcctgtggctttaattctggaatcagaaatattagtcaaggatatcagtctatgaagtaagttttcaatgttatatgccacaagatgcagctgtcctattttcacttccagtaattccttctgaattaatacaccttaaaaatagctgcagcttctcaaatctgtgagaatcgtatgtgctgcttgctacactttcctttttcctgaaggcctctttgaggtctttcaagaactcaattcaattcagcaacaattagggggtctaaggtatacagacgctgtgcaagatgctcctgagacacaaagaggaggtcaagcccctgccttcaggcacctctctataatataggaggagaaagagaagaaacactaatacacataggtaggtgccattaaaagggtgcatacattaaagccaggtggtaggtgtaagaagatttgtaacatgagaattttctgcatgtttgaaatatcttataatttttaaaaattaaaatgggagatacatatatatgtatttatgtatgtatatatgtatgtacatatacacacatatatacataaatatatacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtatatagacataaatatgtatatatgtgtgtatataataatgtgtgtacatatacacacatatatacatacataaacattctgcattataccattcactttgtaacccatcttccctaaaaactgtctcataaagagtcttcttttccctgtacctatgcaatggtaagtagcaaaacacacattcttttgggtccccataacattccctgtagtttgcccttaacagtctttgatgtgaaatttactgtttctgtcttaaccttgcctgtctcgcgtacatggagttttggctcctggctcctagtctgcatcttcaccccatcccttgcccaaagaatctggttatgtgaccactgctcatcttttctgctgccacaactccagtccaagccacaaacctctctctcctggactcctgcggggagttcctttctctccctgcatgagtctattctccgcacaactggcagaggtaagtgagactgcggaagaggcaagtttgcaagtccagaggaaatgaagactctgcttgtgcacatgctgggtttgacgggtgctggatatccgatggatggcccttaaggtgagctcaaggcttaagggagagataggggctgatgatctgagattcatcagtgtgtggctgatgtttaaacccaggggacaggataagaaggttattccagggagagcgtagataaagaagctaaatggcttctgggtccttagtcattcaaaatcggacctctgaggcaggaggaaagcccagaaagagtagattcctgggactcacgggataaagactttcaaaaagtgggggctggccagtgctgctgaaggaagtagcaggaccggaacagaagggtaatcgttggacctggagaacttgaatttgaattttaaggttggtaaccttaaaaaagagcaattttagataccttttgaaattatttgcaagatttgtttggtatatgtgttattccaggcaaagggaccagaaaagtaaaaaatacttactgaacagttactgcatgcctggcactgtaacaccctgtttaattctcacggcaaccctatagagtaggtgtcatcatccccatcttacagatgaggatatgaggtgcagctagattaagcagtttgcctcaggttacaccaactggttaacgtagagctaggatttgaacccggatgggctgatcccagagctcatgctttaaatcgctagactggtgctcacagaagactgggaccgaaaaaaattaataaaaaaaataaggagccccctgggctagcaaattaggagttgttcagacagatgtgaaaaggaaagcaaggcagagggaaagtcactgtacagaagagagagacccatgacagcagagacagtgagctggtaaagtggctggcgatctagcccctgaaaatacctccagagaggcaggctcacgcctgtaatcccagcactttgggaggccgaggtgggcagatcacctgaggtcaggagtttgagaccagcctggccaatggcgaaatcccgtctctactaaaaatacaaaaattagccgagcatggtgacaggcacctgtaatcccagctgttcagttggctgagtcaggagaatagcctggatccgggaagtggaggttgtagtaagccaagattgcgccactgcatgccagcctgggcgacagagcaagacttttcttaaaacaaacaaacaaaaaagaaaaaagaaaaggaaagaagaaagagacaaagaaagaaagagagaaggaaagaaaggaaggaaggaagagaaggaaggaaggaaagaaagaaaaggaaagaaagaaaaagaaagaagaaagaaaggaaagaaaagaaagaaaaagaaagaaagaaaatacctccagagagccaggtctcttaggccttctgagaaactcacatcccttttgatgaacacaaatgcttcacactctcaatgttattggtaatccaagttatcaatatacctaaatcacttagtactgaatctggcatatagtaatcacctaatgaagagataagagtcatggagtattctgaagcaattagaatcaatagactcaatatacacatggcaacaaagttggatcttaaaaaccgacctgagtgaaaaaggaaagggaaagatacataacacggtaccattatgtaaattgataatatatgcttacacaatttgtaagaacacatacaaatagatacatgtatattaaacatactcgaacggttaccctatggggtggtggctggagtgggggtaagtccgtaagctgtaatggaacctaaacaaatacatgaaacgagtaggaatcagaaggagtaacaataaaaatgtgccatgaactgaggagtgtaaattaatcaactcactgcatctgaggttaaaaatagaaagatgataattgttattcttattactcctaggtcttccacttgcactcagctttacaatgttggactatccttcagatggcaccctccttgcacttgctcaggcaggagagctttttcctccagctttctaggtgatttaatatatcagggaataagtataaaaaaaggcacggtgctccctgggtagcctttctggacttcagagctaaattgcaaagtcagttttacacatgtgatttcatctatgaaattagggcaaggtagaaaactggcacagaaaaaatgtgatttattatggtgttactatcccttacaagcggagtgtcagctgcctctttttgtccactgatttaaggcaagatgaactgaaagtggctatgatcacgtcttcaaaagcacactctggcccctcggctgcaggcgccctgcacattccccagctgcgtgtccggtggtgacacagtgcataattgtggcgccttcctggtgcaaactgtctcacttagctccgtcttgctggcacagcagaaaggaagaaatcgaaaatgtttggatttcaaaggtaacaagaagctggaaaacaactactggccgagtctgagagtttcagcggagactggtgcagccttgtgtttttccactgacagctgaaaatgagcccagcttcagtgaagcttgtttccttccctcctcaaggttacccacaattctcagttctctcaggaaagccaaaaaatgaatttgagggtttaggattgtggttcttttatctattacaggattgataatatgttcctccaccagatgttctgcttgtaacaatactcacttcctgacactactgcatatgcaggagtgttactaccaaggtaaacacagaattggctgcccaattccaaatccctgaactgagtgagagaaatcagaattataataggggattcaacagagctggctacggatgtgccagtggtcagatactttgctcatcatacgcaggtgctgctgctctagcaactgctcactgcttcatttcctgccttggtctttaaatactgcttttctcagctcaattggctttcttccctctggcagtcacgtttctttgggtcaaacagcaaatgattctttagaatcacctggtactcaaaggagctacaagacattgggcatccacttccactctcttggaaaaacaattttatggaagccaaggttgccatagtgcctcttgaggttgtttgctcagccaaggcccaagctttgtgcttcaaacatgaaattagagagcttcagaacaagatccacattttcaatggcctcacccaactggataaaagaacaattgccatatctcaatgaccaccttttctcaggtgggatggtagatgctggaatgggtcacagcattgcccaaccaaactttgcaaaaaaggctggaagctctgactggggaccctaaatatgcaaaagttaataggctcttcatgcagaatatgaaccccgtgtatggatatagctaaagggttggcctttatgtttctattccttcacaaacctggtagaatagatatgcttgtttccctttaaaaaatgtcaacaattgcatttatgatgctgtgtatagtaactcacagatcatgctccatgaaaatgcttcagaacccaatataaggagattttttagccatgtgtgacaaaagagaggccatttcagtgttgaaattcttcagagaagtatttgattatgttttctcagatctttttatttttattttttttgaaacagagtctcactttgtcacccaggctggagtacagtggctgtggtctcggctcactgcaacctctgcctcccaggttcaagcgattctcctgtcagcttcccgaatagctgggattacaggcgcatgcaccaccatgcctaatttttgtatttttagtagagacagagtttcgccatgttgaccaggcttgccttgaactcctgacttcaggtgatccacccacctcagcctcccaaagcactgggattacaggcatgagccaccgtgcccagcctgttttctcagatcctgtattttgtttctgaagccttcatttctatcttcttattcattttggaagtagtacacctaagtaaggtttttaacaatcaaatatctttggaaaattccctggttcctttcttattcctacaaaaatatgttcagtatagctgatgttatgtttctttcaaattattcatttctctatctcagaatttatctcatgcctaattgttattgaatagtcttcacttcttgtcatccagtttctggtctcttatttcactctaagtctaattggctattagaataaagagcttgtaacagattctttctccaatatgtcttatcttttgactgcatgccagtgacaaactgttaactgttttgattcttcataacattccacagaacatgctgactcctctcttcctgaaagcaatgcccaagcacagcattgttagatagtatgtacgcaacagggacatgggtgcatagcaaaaactagaaggaaggaggaccttccttagcaatgggtgatatggtccctggacttagactccaaagggtcgtgaggtgaaacacacatcgtccatacccaggaagcacacaggtgggatggaagagctgtgcctaatgaaacttcatccacgtggaggtggaggaggctgcagctgcaagaactcagagctgccttacccagaccagggaccagggagggctttctggaggaaacagcctctgaactgccagctgatagaggagctctacctcaactcttctggttccccagggctgcttttccacgtccatttattggcactgaagtttgaataccttcaggggcccgaaagcctgccaggtcctcttctctgcagagcaatcacaccaacctgcaaagggctaggaaagggctgtcatcatctcctactcagaaactggttcactggaaggactcaggggccactgaatacatcctggcagctttcacaagaagggcttctgactcaaggatgtttccatctttgccaggtcgccttttctccttctcttagagtttggaggacgcaaatgtgctgagaagtcaacctttcctgcaaggtgagacacaagggcctttcccagcagaaagaagagagcaaatggaaggtccttcttcctccagtagaggatggactctgtctggcagccacccaacaggaaaagcacaatgcatgcctgcctgcttccctccctccctccgtttctccctccctccctccttcctcccttccattctcttcccttcccctcccttcccttcccctcccttcccttcccctcccctccccttcccttctccctctccttcccttcctcttcccttccttcctcttcccttcctttcccctccccttcctttcccttcctccctcccttcctcccttctttccttcccttctttccttcctcatttcctcccttccttccttccttccttcctttcttcctactttcctacctttagggctctgtgtctttggagtccattctgattatgctgtaatgtctgccccttcctcttctctgtcaaaaaatgaaagacatggaagccacttgccttttactgaattaaaaattagtaaaagagctaaaaattaatggttaaaaatgtacgcataaattatgcagtatactaaccaatgaaaagatacacttctcttaattaaaagctgacagggagggaaacaagaaaagagaaacacaaaacaataatctaaatgacctattagttggaagaacaacatcagagaaaatagatactgtgtatagtcatgtgtatgtctatggaataacatttgtagagaaatctggactgatcctttctgagtaaagagagctgtgggtacaattaaggggagattgaaaggaatccaaaagcatagcagatgctgtgcctcactggaatggttgccgatctcctccaaactatgaagtgtttgaggctcaactttaatataattaagatacaaagacagaatgagagaaagagagaagggagctcactggaagaacactcaagattccttactactcattctctaaaattacaattgttctagatggaaaagaaaaaaagcttctctgttaaaaaaggagcttgtgctataggaggtttaaaatatacttctgacccatctccaacattctaaatccttcccagaaaagtatgccaatcccaagaaatattcaatcaaattgctggaaagaaaaatacaaaatattaaaatgtattaggaagcgacagtaattaaatcagaactggagcaggaatagaccagcagatcaatgagacagacatcaagtcccggaatgtggacttgcaaatgcattaagtaatatgatatgcaataaaggtggcacagtgaaccaatgggaaaaaaattaatcttataataattgatattgcaataattgtctagtaattgggggaagaaataagcttattccttatctcatttctttttttctttttgagacagagtctcactctggtagcccaggctggagtgcagcgatgcgatctctgcccactgcaaccttgctctcccgggctcaggcgattctcccacctcagcctcccgagcagctgaactacaggcgtgtgccaccactcccggcaatttttttttccatttttagtagaaatggggtttcaccatgttgcctgggctggtcttgaactcctgggctcaggcaatccacccgccttggcctcccaaagtgctagcattacaggcatgagccaccgcgcctggcagctcatttcttagactaaataaattggagatggctaaaagatttctatgtaggccaactatgtttttaaaaagtttttttttttaaggatatctgctggaaccaatcatgccaccaaccaaagatgcaagactataaaacatacccagtttttcaaagcatttaaaaattattctaaaaatattttttctccagaaattttgcattgattccctgaagaagcattaatatgggacctgacttataaaatgatgaactcaatctccccactcaaggtaggagtctctcagatttaaaaaataagcatcctagtcctcttgtccctgtaaaagttaacccttacacctgaaacaccaggagactggcggttgtttgcataggggttacaattaaagttgagctacctctgacatctattaacaccaaaattagtaaactatgcatgtatggagacttttatgattgaacttgtttattgagtcaagagatatagtttacaatgaaaatttggggcatatcaaaatgaccttggcttagcttagcatttgctgatgttaactattttcttcattgggctgattttagttgcttaggaaaaatacaaacacacacactttaaaattatattaaaatcccgtcctaaacctcagagtccagaaccgcatcctaacactggtcatgcataatatgtttaaatttttgtgctttaaaaactacaaataaggaatgtattaatagttccacaatcaatggtcagttagccgagggaagattagcatagttaaagacttaaaatggcttaacaacatatatcaaaaggacaaaataaggggaacagagtctagaaatgaggaaactgggacacaggcaaaaaaaaaaaatgagaactgggacatgaataacgcaagggataagactaatacacaaaacaccccaaataaatagccagcatttgctgagctcttactgtgagcctgttctaagcactttacatatattaactcatttcatcctcaaggaaccatctgaggcaggcactgttatcatctccattttacagataaggaatagacccagagaggctgagcaactgggcctattccacagctactatggtggagatgagatttaaatctaatcattggctccagagcccatgcacccaatggctgcactaagtgaatgcatgcgctatcaacgttgccaaaagtgggccacagctcggatctgcgttttccagtagccaaagcagagagtgtgatcagacctcactttaataagcaagtctcaagccagagagaggtggtatcaggcagcaaacaggctgctagtcgaaatcccacttcttctctgagtggtccatacagttttactctacttgcttacagaatgaaaatagctggagttcaggtgcgctttcaatgccctgttgtcaggattgggcttttcaagtttattttttgttgttgtttttaatagactgtactttttagaaaatttttagatttacagaaagattgagaggatagtacagagagttcccgtatacctcacacccagtttctgcaattattaacctcttacattcatgcggtacatttgttacaattaatgagccagggccggccgggcacagtggttcaggcccctaatcccagcactttgggaggcagaggcaagcgaatcacttgaggtcaggagttcgagactagcctgaccaacatggtaaaccctttctgtactaaaaatacaaaaaattagccaggcatggtgctggttgcctgtattcccagctactcaggaggctgaggcacaagaattgcttgaaccagggaggcggaggttgcagtaagccgagatcgtgccactgcactccagcctgggcaacagagcgagactccatcaaaaaaaaaaaaaaaaaaaaaagaaggaaggaaggaaggaaaattaatgagccaatattgagacattattattactaaagtccatgctttatgcagattttcttagtttttacctgctgtcatttttcagttccaggaatgcattcaggatgccataccacatttagttctcatatctgcttaggctcctcttggctagactgagttttaatctactttctgcagagcctgagaactttagcataatttccttgaaattacagctcaatattttcaagcacttatacaaacagcctaatgttacgttggcccataacagtgtttcaaggtaataaacttctttgttttctgtgccgattgaaagaactgctgcttagcctcctgccagatgatgaactgggtacacacgagcatttttccaggtaaagcatatttcgtgcgacttcttaagctgcagccttatatgcaataattgtccatttacaagacttatgttcgaatttcaggcactctgttttcactaaccatatcttcaactttgataagtactgctttaatcactcagaaaatttaacttgactaattttttttcaccatcagttttttttctgttgactctttctcctttttctgtttgcccagaaacatgctcaggattctctcaggctttaaaaaatgaaaaaatgtttcctgcaatctagttactccttgattctcttgttctgtttatcgctggaattcttgaaagcttggtgtattagtcttttttcatgctgctgataaagatatacctgagactggataatttataaagaaaaagaggtttaatggactcacagttccacgtggctgaggaagcctcacaatcatggtggaaggcaaaaggcatgtcttacatggcagcagacaagagagaatgagaaccaagggatttccccttataaaaccatcagatcttgtgagacttattcactaccacaagaacaatatggggtaaaccgcccccatgattcaattatctcccaccggggccctcccacaacacgtgggaattatgggagctacaattcaagatgacatttgggtggggacatggccaaaccatatcacctggcctatagcattatttccatttcttccccatccttttattcctcaaaccggtacaaccagacctctttttttttttttctacctgaaactgctcttttgagggtagctgataagtccaaaatactgtcaccttttctcaattccgttccttcttatgcctttggagcaattgactgtgttggttgccccctcctttaaagtgtctctcacttggtttttatgactaatgatcatgattttctttttcctctctaaacattccgctatctttttagcttcccttccccctcccatcccctaaatgtccttgtttcccagaatctgcctcacctctttgacttctctatgccctgtcattcactcatgggtctttattacattattgcatctgtgtcaataactctggtctttctcttaagttccagtctcccattttcaaatgtccccagacatttccaattgagtatctctccaatgtatttaacctgctaaatatctaacacataatctttcccatcaaatcgtttcctcttaagcttttcttatttcctattagtactcctgcacttctcccaggagcccagacttaaaaccttgaatttctcaccataacctctcttttgtctcccataatcaattagtagcaagtgttatcaatgattacttgacaatatctttttctatttccctccctgctatgatcattcatctagcaagaagagttggccctttgtatctgtggtttctgcatccctggattcaaccaactgtagatggaaaatatttgaagaaaaaagcgtctatactgagtatgaaaaaattttatttcttgtcattattccctaaacaatacagtataacaactacagcatttacactgtagcgtatagatcttataatctagaaatgatttcaagtacaccattatatataagggacttgagcatctgtgaagtttggtatttgtggggcatactgggaccaattcccccatggatacagagggacaactatatttactcagtgcttactaaataccagttggccaatgtgtttttctttttctgttttcctgtctttagtttgccccttgccaattaattcaatagtgctgccaatgccaggtgtaccttcagaatattctattctaattttgtcatctccaagcttaaaaatatttaatgggccaggcgcagtggctcacacttgtaatcccagcattttgggaggccaagggggggtgtatcacttgaggtcaggagttccagaccagcctggccaacatggcgaaaccctgtctctacaaaaaagtataaaagttaaccaggtgctggagcatttgcctgtggtcccagctactcaggaggctgaggcaggagaatcactttaatctgggaggtggagtttgcagtgagccaagatctctccactgcactccagcctgggtgacacagcaagactctatctcaaaacaacaataacaacaacaacgaaaaacatttaatggctgcaccttgcctgtgaaaaatgcatttcttggccagatgtggtggctcaaacctgtaatcccaacactttgggaagctaaggccaggagttcgagacgagctgggatatataggaagacacaatctctacaaaaaaaaatccacaaaattagtcaggcttagtgttcatgcctgtagtcccaggtactcaggaggctgaggcaggattcctcaagcccaggagttcaaggcttccgtgagctatgatggcacaactgcactccatcttgggtgacagagcaaggtcctatctctggagaaaaaaaaaaaaaagaaggcatttcttaggagagttcttctctgtagagtcctaagggttccatggaactccttaaaagcatcagagtatgtgagtgcaatgggaggaagcatttagccagagcagttgtgctcccattgcatattaatttttaaaaaacaaagctataaaaaaaagttgaaaactactacgttagcatcagcctgacatttaatggcctcttaaatcaaaccttaattgactttttagccagttatgctactagccaactacagacaacacactttttaaccaaattagactaatagttgtcatcagtggaaatcaagtttgccattcttccatgcctttgctcacaccattaccttttctggaatgtcctgtactcatcttcctgtgttgaactctatacccaactttaaaaacctagctcaaagttcaacacttccattccatttcaaaaagagctttcctcttccttaaagtttaagaactcattttcatgaatctttttggcatttattgcacacatgcttgctttgtgttatttgtgttcatgcctcatatgcccccaaggtgttttagactccttaacggcaaaaatgatgctctaaacacctttctatctttcatagtgtcttagtctgtttgtgttgctataaaggaatacctgaggctggggaatttatttaaaaaagaggtttatttggctcacagttctgcaggctatataagaagcatagtgtcagcatctgcttcaggtgagggcttcaggaagtttccacccatggtagaaggcaaaggggagcaggcatcacatatcaagagaggaggaaaaaaaggaaggaagaaaggagggtgccattctctttcaacaatcagttcttgtgggaactaatgggacaagaggctgggcacggtggctcatgcctgtaatcccagccctttgggagaccaaggtgggtggatcacctgaagtcagaagcctgagaccagcctggccaatgtggtgaaactccgtctctactaaaaatacaaaaattagctgggcctggtggcgtgtacctgtagtcccagatactcaggaggctgaggtaggataatcacttgaacccggaagacagaggttgcagtgagctgagattgtgccactgcactccagccggggcaacagagtgagacggtctcaaaaaattttaaaaactttaaaaataatagagcaagaaagcaccaagttattcaggagggatccacccccaatgactcaaatacctcccaccaggcctcacttccaacactggggatcaatttccgtatgagatttggaggagacaaatatccaaactatatcacatagtaatgaacatagtaccttatctatagaaagcaatggctagacaactgttgaatggctaaccaaatctgctttcctatggtctcgctctagagggggtcagtatgagtttctgtcaaaaggagaaaaaaaaatgtatagtcagttttgtgtgtgtgtgtgttcatgtaaaagagatcaagagaaaagaacaagagaaatcatgaaaaggagggggaatataagaataatacatagaaaaaagcaaattatcttgtttatcagtaatacccaagggggtagaaatggtaagtaataatccttcttcactttgtctgtagttcacttttttgcacctttattttgatgaattcacatcgaagacattaactcattaaggcttccaatatttttggagataagaagggctgctatgctctttatagatggaaaacttgggtcattaataactcaaacaaggacataacaaagaaatggagcataaactgccaggtcctgactgtagatttggattcccagttggtgtcttgtcaccctttgttactcttcctaaagttatgatcttttcttgtgcataggaaattcatagtgatttcccatcacccttgggattatcatagctcctttaaggtcccctctatgcactcaataacatcaacagtaagtgttcttcgagcacttactgagtgtatatcattgtgttctcacgcagcacccacagatctcaccaagaacctagctgaagcctgtagaatgaataggtaagtactgccatgccaatctggagtactcaagcgatgcaaatgattcctttaattgtacttttgcaggcttgtcagttttgctcatggagaagtggctactgcatccatgttatatctatgtaatgttggactgcgaagcatcacttgactttttccaagcagaaattacagctgatgacaagctgctgctgagaaaatggatatttttctgaattcagttctacgtggaaacagctgactagtttccattgctgtaagatggctcttttgctcttggttgattttgagtaatggctttacttctgtagaaaggagatttcatttgaagtccactcagggatttggttcaacaaactggagtacaggtttcagaaaatatctctttaatcctccaataataaattttctcatctataattcctggaacacttcatcctttgcagccgagcatatagatagatttgttgctcactgtgttctgattgccactttgacctgctttttcaacttaggttacaaatagaacagaatctctctgatttttctcattaattgtttgaattcccacttttcctcattagcaagaagtccagtatcttcctgagaacttccttttctcaatctaggaacttacttggtccataaggtaacagtcttatttctgactatcaaggagagaaataacaggagccattatcatcttcatggtgtcacttttgaaaactggtcctctgtagatcttcagattcttgcgttagtccattcagctgctataacaaaattgcatagacagcatggcttataaataacagaaatgtatttctgacagttctgaaggctagaaagtcaaagattaagacactggctgatttggtgtctggcgaaggcccatttgctcatagatggacgatgacctttcactctgtctgcacatggcagaagggcaagagagctctctgggtcttttttataagggcactaatctcatttttgaggaccctgcccccatgacttaatcacctcccaaaggcactgtctcccaataccatcaccttgagggttaggatttcaacatatgattttggggggacagaaacacgcagtccatctcgcttgtccactccatggtggtattcttgctggatcagtttcctccttggggtgcatttgtgttccatgtctaacttgcaagttatagcaggcccgatagcaaagtattccaatgttggtatgcagaggcattgaataatcagaatgaacccacgccataaacaactggtagagctgcagagagtaccagctgattatgagccctgggtaacagtggtttttagttcctatgtccgtcagcccttttctcccatagtagccccactgtgttgaagtggctgaatcgacagaagcttccagcttgggccacatgctcatggaaccaattctccttatgagccgtacaagagctgggttgccattctggataccctctttcttcaagagattttatttcaaggatattttttcttttatcaactacagggattatttagaatcttagggcagtggtgcccaacctttttggccccagggacaggttttgtgggagacagtttttccatggaccagtgtcagggggctgggaggcatggttttgggatgagtcaagtacattacgtttgttgtatactttatttctattattattatattgtaatatataatgaaataattacacaactcaccataatgtagaatcagtgggagccctaagtttgttttcctgcaactagacagtcccatctgggggcaatgggagatagtgacagatcatcaagcattagattctcataaggagtgctcagcctagatccccggcatgtgcagttcacaataggatttgctcacctatgagaatctaatgccactgctgatctgacaggaggtggagctcgggcagtaatgcgagggttggggagcagctgtcaatatagatgaagctttgctcgctcgcctgccactcacctcctgctgtgtggtccacttcctaacaggtcacagactggtactggtccatggccagggagttggggaccctgtcttagggagtaggggtggagttcccttcacttctagaaggccctggattagtatcccagagctgtcattacagagtatcacaaaccaggtggctaaaaacagacatgaattctctcttatttttgatggcttggaagtccaaagtcaaggtgctgccagggccatgctccctctgaaatgtgtaggggagaatccttccttcctctttctagcttctggtggtttgctggcaatcactggcatcgcttggcttgcagcacttcaacatctgcctttactgtctcatagtgttctcccctcatgtctccaggtctctctgtctctcttctttgtataaggaaactagtcatattggattaagggccaaccctactctagtatgacctcatcttaaggtcacatgcaatgactattccagataaggtcacattctgaagaactgggagttaggacttcatatcttttgaaggaacacagttcaaccaataacagcccctgtactgttttacaaataggtattcctctccttcccaaagttcttcatagcagagacaacttgtaccaaaaggcaaaataccttattatgtaaccttaacctaggatcatagatccctacttgtctggtgcttttataagccacagaaccacccgggaaactcattattaagacaaggaaaggccaagtgcagtggctcatgcctgtaatcccagcactttgggaaattgaggcgagtggatcacctgaagtcaagagtttgagaccaaactgaccagcatgacagaaccccatctctactaaaaatacaaaaattagttgggcatggtggcatgtgcctgtaatcccagctactcaaaagactgaggcaggaaaatcacttgaaccgaggatgccaagatagcagtgagccaatatcgtgccactgcactccagtctggatgatagagcaagatcctgtctcaaaaaattaataaataaataaaaagacaaggaaagccttttccaaggagacccttctgctttgctagttcagagaacttctctttggagaaaacaaacacccagtccattagcagcaacgtcagggattgaattcttagggcagcaggctgggcacagtggctcatgcctgtaatcccagtactttgggaggctgagatgggtggatcacttgacatcaggtgttcgagaccagcctggccaacatggtgaaaactcatctctacaaaaaatatgaaaaaaaaaaaaaaaaaaaaagctgggtgtgttggcttatgcctgtagtctcagctacctgggaggctgaagcaggagaatcacttgaacccgggagttggaggttgcagtgagctgagattgccctactgtactccaacctgggtgacagagagagactccatctcaaaaaaataaagaattcttcgggcagcagtctttcctccacctcatagaccatggaggtgagccagctctgacaaaccatgagaacaatggcagagacatacctgtaacgtaactgactggggcaaagacaaaggtgaggaaaatgacaagtttgaggaactatgagaccaggcagtggggaacaccactagcagaaatgatggaagttctcaagaataacaacagagaaatagaccatggccagagtctagaaccctccagggaaaggagatgggctccagaggcagaagaggacgttgaagggaatggggagtgggtgaaatatatagacgatggggaccacccaagagcagtcgctattgcaaaactgaggagaaggagagtctggagggggtggtgggaagctgggtctcctaaggaggttttgacaaaagcagtcatggagcgggcttagaaatcacagttggggacagggtagagttcctcgggatatagaggatgagattagaagaggttccaactagggtagtgtggagaaaagcactattgacccaaaaaggaaggagaatgtgggtggaagtggcagagaagaggggtttgagcagagagtggtgatttttctaatgcagagttgtgggaggtggagtgcagggagccaggctgggtggctgtgctgatgtgattaagcacttactgactgccaggcaatgggctaagtacctgagatgctttgtctgttatccctcccgaaacccctctgaggcaggtgcagttattattctcacttcacagataaggaaattgaggcacagagaagttgagtaacttacccaaggtgacatagctcatatatggtaaagcaggctttgaactcagtctagctcccgaacctaagcttgtaactactatgcttttcccaaaaaaagggggctggcacaaaaagagctgaggggggctgggcatggtggctcatgcctgtaatcccagcacttcgggagactgaggcaggtggttcaccagaggtcaggagttcgagaccagcctggtcaacatggtgaagccctgtctctactaaaaatacaaaaattagctgggtgtggtggtgtgcacctgtagtcccagctactttgggaggctgaggcaggagaatcgcttgaaccccagaggcggatgttgtagtgagccaagatcatgccactggactccagcctgggtgacagagtgagactccatccaaaaaaaagaagagctgaggtgatggccaccatcagcatcagcctggaagttatagcaggatgctaagtttctctaaagctgtctttcttaggacttgaaaaagataacttgggtttgtatcccatctctgccattagtagtttactggctttggataaattacttagccttactgaaccaactttggatttttatagagatactgtaatgaaaggaataaggtatcagtcttagcagagcatccagagtgttcctattaaaacctaaatcatatcctgtcattgctctgccccaaaccattcaatggcttcccaactcaaagttaaaaactcatctttccagtggcctgcaagagcctatgctatccggtgtctgacctcatctgttgttcctttctccctccctttcttggctccagacgcactctggtctccttgctgttccttgaatacaccaggcacactctcttcgcctgaaacactttaccccagatatcttagcttactctctgcctccctcaattcattgatgaaatgtctcagtgaagtcttctctctctcctctgtaaaagtatactctctgttccccttctttactgttctagctactattgctgtgtaacaaatcactccccaaatttaatgagtgaaaacatcagccatcatcttatttctcacggtttctgagggtcaggaattctggaagggctcagctgggaggttctggctctataatctcttatgcagtgagagtcagatgctggctaaaactgaaacaaagcagggttctagtagctgagggctggctgggtctctcagatatagttcagatctcctccagggggtctctccacgtgggctagtctgaacttcctcacagcatggtggcctcagggcagtggactctgcatagtggctgaaggcttcgcagctgagtattccagcaagcaaagtgggagctgtattgcctcatatgacccaaccttggaatccacacagcatcacttccgtgtattctacgggttgaaaagtcacaaaaaccaaccagtttcaaggagaaggaacagagatcacatttctcaattggagaagggtcaaagtcacattgtaatcagagcctatgggatacgaagtattgcggtcaggtatgaaaaatttgatttgctgcatctgctttactttctccacagcgttcatgatctgcttctcacatgatattgacttacgtcatttctgcatttcctgtcttccacactaaaatgtcagcctgttttgttcactgctgtatccccagagcctagcacggagcccagcatgtagtggtatccaataaatacttgttgcatgaatgaattctgtcttttaatcctagctataggtttctaagttaaatattactataatcatcttacagacgagggaaatgaggctcaagaagatttggtaacttatgcgggatcactcagccacataatggaagagacagcattgaagtacacatgcttgctctgtctgctcttccaagctgctcatcacacagctgcacctctgaggacttccctccccagtccacctccacccttacccagagacacacatggccacaatccactagcagaccaaaattcaatttttccccagttggttgcactcaagctgagagcaaagcaattgcactttaaatccccttacagcagatatttcagagcatgttcggaagaacccatcacacttggcttttagatcttatttctggtttgttacaaaaacacaattaaatgaaaggttaggtagcttttgaatggccagctcaaagttttggcttatttttgccttgctgtctttataggcattttaccaatatttatcactatttcccttagggaacccttagatctgtgatatttgaaataataaagcctctccattggccctttaaaaggtttgtggtaaaaccacaccattaacattcacagttccttatttatgaggcctgattgcacttatttccatatttctcactgtttctccgatgaggatttcacataatagtgtttgaaggctaaagacttcaaagcagattctttactatttttatcttgaaaaatattcaatatttgtgtaattaaagtgaagtcttcctagagaaaatgacaactcaaataatcttaaatgtacctccaagaaaaaagctgtcaaagtgacatttagtagtagagtcacattctctaaggcctttgcttctccttctgagttcttatcatctttgaaggttatgtcatggctgacttcaaatcacttttaaaattattatggccttctttaaatgtgagttctgaaggtgaggggctttatctttcttttgctccagattttttctaccgcgtcattaccaagcatcttaaaacaaaacctaaaaacaaaaatcttccttgacctggtttttcccactagctaacatcctatttttatctttccctttgcactaaaggtttttaaacggatctttataccctctgtctccattttctcatctgctaacttatatggcaaagattaccactgcctttcaacataattggccaatctacagaaagttttcaagttctctttttaattgaccacctcctgcctacctccccacctttgacatcttgcttctcacttggcaccttacccagtgttcaagattccctcctttaggatgtcttcagagcagctacacagttggtactataatttatacatccttgtacacagggcttgctgggatattgatggagagaaggaggaaactggaagtagttcaggccagagctagggaaattgacccatctccaggtctcaggtctgcaaggggagctcacagcttaacacatggagtctagaaacttgtgctggaccttgaccaacaccagcccatggagtccaatacagtgctcaatagggatttccaggaaattgctatatttattcaaagagaacttaccaagtgtcagctacgtgttgggcattgtgctaggcacagggaccacaaagataagacattgtagctttccttaagttgctcactgagtaaatagagagacagaaaggtaaacaggtaagtgcaaaaatacatacaattcagcaatagtgttcatagtggctatggagagaacgctcactaactttgtttaaacagttgttctttcaaggatttgacatggatttgattggaaaagcatgataccattttttgcaattaaacacaggaatacataaataaaatgcatcagtattttttacaaatagctactaagagctactagaaaacctgggaattcttaaaaccttaccatgctacttgctctaaaatattttattttatgttattttgtacatttctttacctacacaaacaccactgttttcttcatttcttagtctatttaaacctcacaccctttcagcatctcttaattatttactaccatctgttagttctcctgtcctgaatgaaacaaaaatggcagaatgtaaaacgagggcgaacagatttttgacaggaagtattcagaggtagaaggaaatagtcaagacacatatgataaacgaaaacaataataactttatacataacaacttatagacacatttaaaaagtttaagatctcaagagctatgtctgaatagatagaagtaaaaactctattaagtaattaggaaaataacaagaacagtgaatttcttaatgaatggcatgtaatcaaaactgtacttatcgtctaattcataatcttgaatgtttttattttatttatttatttttttattttttgagacagagtcttgctctgtcacccaggctagagtacagtggcgtgatctcagctcactgcaacctccacctcccaggttcaagcgattctgctgcctcagcctcctgagtagctgggattacagaggcctgccactgcacccggctaatttctgtatttttagtagagatggggtttcaccatcttggccaggctggtcttgaactcctgacctcatgatccaccagccttggcctcccaaagtgctgggattacaggcgtgagccaccacgcctggtcgaatgtttttattatttgaagagacaacatgggccttaaatctgtcttctatttgacagactttgatggagtcaaatcccaatgctgccacttactgaacggccttaaatgacttagtctctctcagctgtctttctgcatatgtaaggtggaataatgatggcttcaaggaggaataaacctatgaaaagtgttgaggatagtgtctgatatgaaataaggattcaacaagtagtagctgctattgaagatttaagagttatttattacaactatttaataaaattttaaaaactaatacacttaaattattaaagagctttgaaatgggccaggcgcagtagctcctgcctgtaatcccaacactttgggaggccaaggtgggcggatcacctgaggtcaggagtttaagaccagcctggccaacatggtgaaaccctgtctctactaaaaacgcaaaaattagccaggtgtggtggcatgcacctgtagtcccaactactcaggaggttgagggaggagaattgcttgaacctaggaggtggaggttgcagtgacccgagatgtcactgcactccagcctggcaacagagcaagactccataaagacaacaaaagctttgaaattgtgtaaatgagttgtacctatcttcatttaagaaattcatctttgttcatttatttttacttgacatgagagcttccagcaatttttaattaagccctcacagattttatgtcactggctatgtgataaacaaattatttgctaaaataatattcttgcttcttttttaaggaattgtctccctagaaacggtttgtaccaaacaatacactgactttacacaaaatcagatctgattggcaacagttgcagatgttttcaaaagattttcatttgagaaggggcccatttgggttatttagattctaagaactgaaactgctttgttctgtttttctggcttctgggagaggaggagacatgaattcagttagcaccttggtattttctttatccttcatttcaatacagaagatgcttcatatgcacagtggtgtcaggtcacatcaaaagaaagagaaacagtttcttggtttttaattttcaaccggaaaggaaaggcacccattttgttccgctctaattagccagtgcatgacttagagagcaggcagatgctttgaaggcgtggtaacacaggtcttcattaatctccacgcaggacttgcacttctactatgcctaggctgaagaaaatggctcaggaagatgaacaatctcacagagccctaactaactgaagccaggtgttataaagcacaagtcaagagggtgagaaactaacgttcttgaaatctcccacttctttctacgtcagaagagccaagctgattattttagttggaatttagaaatttttaaaaattattctaaagtcatgaacaagcctaattataaagatagttgctgtgaaggtgctgagataactcgattttaccaaccccctcttctggaggaagccagaatggaatcctgtagaatgttcactctaccaacgaactcttgtttttctaatgaggaaacagaggcccacagtagtaaactatcttaaccaagacaaaatgactagtgctctggtccttttattaagcactaaaattttgatccaataataaatctgtccagtagaaggagtttccctaatgtactggttctaacttgttcccttcaaggggccagtgtcccgtacacatagctaaatgggacttctcttcaactaccattacccagagggcagaacctaaaatgctgtgaatgacattctgctgttcacatctcagcagcagtgttgcatttgagcttctgcagggccacccaggacctatatctgctcagatgtttaactcatctaattcagtgaacacttcattctagttaactgaacatctactttgtacaaggcactacagcggttcagagatgaataaaatcatgagattccactgtctcctataaaccatcactttgggaaattttagaaatgtgggtaagctccagggcttcctgcagcgtagaagtcacaaactcaaatgcctgcagaggcccagctgacaacataagtaaatgattctggctgggcggaaaacaattacgggtgggtgggtttccagctggggagtgcacgcctgtgttaaaggacagctgctactcatttccagccaactgtgttcccatgtagaactgcggcccagtgtagccagtaccgaagatttctcagaaaaagccggagatctcaatgttagtgtaaaatctctcaaatttccaagaggattatatggggcaaaggttctcagatcagtttgcagtctcttacttagcccatgtgcagagcagtcgtagagggtagcatgcagtgtcctacataataattcttttttattttattttatgccttcctccttcctgtctctctttaacctttcttcttccctcaggctggcttcttccctcagcctcgtccgaccccagcctgggttcaatgaacattcggtaaaggaacacggaatgtcaagcgcattagagacaaccttgagacacattcctcttgcggtaagcacttcactgtagatttttaattttaaacaagacaatgtttacgacttgcttctttcagggaagagcgatatcaattttagtgaacacttcaaggctgagatacgctaggagagtcgtgtggtgttgcacagcaaagaattccactttgaagcgagtgggaaaaaaagcatcaaatgccacatgtaactcaccgcctgaagggttacattggtatgaaacctgggtttaaaaagggaccgaatagactagccattaaaagacctgcgtacaacctctctctctctctttgagagataatgtatctggacaataaacatgaacagagtggagtctatcctgtttaaaacattgcctactgtacaggcaccaggagctgaagggtcagaatattagcagtgggagcttgattagaagttgatgagagatgggtagtaggaggaaagagtgagatagaggaagaggacatgggggttacccgtaagtggagagtagaaaagtagaatcagctggccatcaaagggcgtgggactgaggaacagtatggcatgtattaaatatactaagcgctgacattggaggagaactaggaaggtaaatgaaatcaataggggatgatggagaatagttaggtgtgcagggattagggttatgatagaaatacatgtgaatacatgcagtattgtcctggaaaatggttaacagttggttctcctggggggtgaggggaagccctgatttgtaatatttgcctatttctgtggtgcaaatactcccaccatgaccagtttcaagctatgaatgtgaagtcacagaaagcagggttgggaggagatgcgcacatttgttccccggcaaggtggaaggtaaggaaggtgaaatcaacaaggtcaaagaaaactcaagatttcgaggtgcctcaggtctgaggggcaatgaagtctagggaatggctgtgctgaggtagctgaaatagaagtgactgcagaggtcatgaagctgaagaggtgaaaacagaaattagaaaggcaaacccccaccgcccaacccccacccctgcagccagtttctgagggtgacaatagaggaaagggtggagatggagttcaggtccagaagccatagaagcgagtgtgacattgtgctcaaggtcagcacatgtcagtgtggggtgtcacatgctgttgtgaaccatcatttatcaccaattatggaagacctcctatgggcatcttgccatatgcattataaagatgtgtaagaagacatttccctccacttggtgaggagaattagggctgtacacagatactgtagagtgccatgtgcctggtacagataaggtgtgttagaggttaaaagatgaggctcttaatattaatgatagatcccacttacctgagtctgacttacaatgtgcctagcattaagtgttttacctgcattccctttgaccttcagaacaacccattttacagatagggaaattgggtcagaaagtttcagtaacttatccaaggtcacacaattggcaagtgccagagctgagccaggaactgaggtccttctaacaccaaacagcttgtctccccaatcactgtgctattttccctcccccagaagataatactctgatggaaatgaaggatagtgtaataggagattcggtgttcctttttttaaaaaaaattcagcttgcatattcctaaagagtcaattcatgtttaaaaaaaatttcccttgtgcttgcatgtgacatgtatttttaggatctgctgttagcaagtgtatttttgtgtgattgagtgggagagtgggaaaagttttgcagagctgttgaagccagaatgcaggggggctgcgcagcagagactgtaaaatctctgccatctcaggtcttggaacaagcacaaagagatgtgttctcgatttattattctatgtacatccccagatgaatgactagttaaaggtattgttaaagcattttaaatgacccacttccagcagcgaacaaaatcacttgctgtgccaagccaactggcatttctgagatgataaaaccacaaagtgaggaaaacgttaaaactgctaaagcaaaaatgatacacaataatggagaaggagaaaaattgagctttattgtctgcctaggcagatggctgaccactaggtgggcctcggcgtcacgtccagggtaattggttgctggggtgtttctggcgaggaagattcacgcttcagctcggtccacaagatcctggctcattctttcctagattccattttctgcgtcctctccatgactgggtctgatggttgatccaaacgggcaattgaaatcagaaggttacctttaccttaaaatgcttttctggaaataaaaggacatgaaaagtaactaaggaccggatttcctagccgtctttctctcctgcatgcgcaatttatccccagatataaaattgcctgctttgataattataccctctaaatgaggggcaagtggctaattatgcccacatgtggccgattgcactccccattagccaattatgtgctcaattatttgtgcacatgaataattgcactcatggaaaatagcggccctcctttcaaatcctcctgcttggagtggctgatggagtaattgtcacactggaaatgcacttggtggggagggaaagagtatcagataccaggaaacgcataagtgaccagagctcgcagatgttcactgccacaaatggccttaggagccagagagagcgggaaggaccacaggatggaacgggccagcctgtgagttaggaagcctgcttctgaagttgcctgggcagctcatgtgcggtgaccttgggcaagtcattaactttccttcaggtctaactggttctgcatacacaatgaggatggtaataacgcccaattcccatcactatcgtgggatggatcagactatttaaaaggatttacaatctgcttgggtaaaagctttacataaatatgaggcattatcatgtcgcttggtacatctccaattatgaaggaagggtaatgaccctccacagcaatgcaggactcctggtttggagggagggaaagtttgagaaggacaggaagcttgttgccccagcactgatgtttctactgaggtaccagaaaatgtcatgtggtcatacagaattcatttattcattcaacaaacatctgtcaattgttacactgtcctgagaatttggaaaaatgatgaaagactcagtcctgccttaggaggtcactggcacattggcccgggcccctgttttgggccttttactctgacctgtgctgatttgcaaatagtgggaaattttatctcaagtctaggaaatctggcatgcattttcacggtttgattgccaggtacattcgatggcaatgagtcttataatgtttggttaccttcatttacctaagaactgtggttgttgctgtggttgttgtttttgttgtttttgagacggagtcttgctctgtcatccaggctggagtgcagtggcatgatctccggtcactgcaaactccacctcccaggttcaagcgattctcatgcctcagccccctcagtagctggattacaggcgcgcaccaccatgcccggctaatttttgtatttttagtggagacagagtttcaccatgttggccaggctggtctcgaactcctgatctctggtgatccgcctgcctcggcctcccaaagtgctgggattacaggcgtgagccactgtgcccagccggaactgtggttttaatgacaatgctaaaaagtggtatatgtcacagtgtcgggtggggctaagaggcacattgctgcagtgatccatcattcatttcccaccattctcgcctggattagcgcagcagctcccagagaggcacctcactttgaccttcttcctcaaagacattctctgtgacctgcctggcccttattacctctctagctttgccacttccctatgtctccatctcccctctcacacgtagtagaaagagactctacctcatggagtaaggagaggcttcacagaggcaggattgctattagtcttcaaagatgaggtatttgctaaatgaatgagacaaagggattggggccacattacaggaaattgaggtatgtaatagcctggtgcaggttaagagtgtggactctgaaaccagactcagcctggaattgaatcctggctgtgtgatgttgggccagtgacttaacctctctgtgcttttattcactcttctataaaatggggattataataaacctaccttataaggttattataagagtcagtaaatataaaaatagaagtttttggatgatgactagcacagagtaaacacttgtttgccattatttttattacttgactaaaaatataccaaaaagaccatccaagaaaagcctttaagctgctagtgcagaaagattccccttgtgtttgtgtgctggggggtcagtggtgcctgtggcccactggagaggagacagctatggctggagtgattctcaaacttcagaatgtctaaaatcatcacatggacaacttattaaggaaagcaaatgcctgggctccatcctcagagagtctcattcactgggtcaggatagagcccaggaatctttaccttaaagaaccatcccacctcccacctcatatgatccttatgcaggtgatctggggcccacactttgagaaatagactcaggtcaaagtggctctaactgcatctcatttctcacctggcatatctaatagtagagaagaagacaatgctaagatttttgttggagatcttttgctgggattgctgcttcattcattcactcatttatttatttatttatttattttgaaacagagtctcactttgtcacccaggctggagggcagtggcacaatctgagctcactgcagcctcaggctcctgggttcaatcgattctcttgcctcagcctcccgagtagctgggattacagtcatgcaccaccacgcccaactaattcttgtatttttagtagtgacagcgtttcaccatgttagctagactggtctcgaactcctgacatcaggtaatctgcctgcctcggcctctcaaaattagtagctgcaattacacgtgtgagctgccgtgcctggcctgctgtttcttttagttgggcctcttctgtaatagagtgtgagaattctgacttgctgcaacagtctgctttgaagcagggctgtgtttacactggtcagatgtggaattgtggggcacacttagcagcttccttctctaatttttctgtattttcaggagaacaattttaaaaaatttaataaaaatgccttaaaaattaacattattataagatgaatcccatttttctaatcttgtaaattaaaaacaatcataagcatatgagcacctgcacttagggaatcaaggtggcaaagctaaacacttccagctctaggtgattcgcggcaatacaaatggagctggactttggccacagtgcaaaaatattgatctgttgttagatgctctgaagtttccagaaagaattggttctgcctgctgtgcttcagtgcttaagggaagtggttcctcaaaatgttagtttttaagcccagctttcttaaataggaagattctaatagtagcaaaaatataaactgcttctaggtttaaaaaggacccagcacacaatggttatcacacacctttctcctcaggtgatgagtggatgagtggcctggtgtatttcataacatctcccagggtccaaatgctaaagcaattgctgaaaagataccatgtgtaccggaaccttgcagaggtattttgttggcataaaaagaaatattgatcatctatagtaaaaatggttctactttaatactactgagaaaagattttcttttcccagatctacatcctgaatcttcatgaagacaagatcccctaaacttccactaacaccataatgtgtgctgtcctttgtaatgtagtccacagatctcataaactgtcagaaatagcagagattgtaaggtcatccacttcccctgtaaggcctgcgtccctcacttacatccctaataacgtcctctaacctctgctggagggcagatttagctgccagctgggaagagctctgccctagtcaacatttttatctgtggctttcagatgagaacactggatgcttatctgaaaaaagctcctcaggctggagggagggattggctctaacaagatgcaatgtgataagaataaaagcgaagccaaactctaggcccaaaggctctagcaacacacttttgagaaccttggagacgagttttggctgatgcgagcttctccgcctgctaaagtagcccattccatttggacggctctagaggctggcatgttcttctccacgttgtgttaatgtactccagtttcttcctgccatgaactggcatgccctggctcctcctaccttccccactttaagtcttccctccctccttctgaccttcccattccagccacactggccttttgtctggtcctaacaaaccatgcctttcctgcctccaagccctacacctgctatccatccctctgtctgagagacactcccaccccttcacaaagcctgtttctcatccttccagttcagatgtcttctcagcttgcctcaactgacctctttcagctattctcactctttgtactctgttcatttccttcctggcagtcaccataatttatctttatttgaatcaatttcttagttgtattatttagttatttgcacactctgtctctctgtgcctttcttattcactgcaggctttcttatgtaagtaatttatttacttaaatttttaaaaataatttcaacttttggccgggcacagtggctcacgcctgtaatcccagcactttgggaggccgaggtgggtagatcagctgaggtcaggagttcgagaccagcctggccaacatggtgaaatcccatctctatttaaaatacaaaaactagccgggcgtggtggtatgcacctgtaatcccagctactcgggaggttgagggaggagaatcacttgaaccggggaggtggaggttgcagtgagctgagatcacgccattgcactccagcctggggcacgagagtgagacttcatctcaaaaaaacaaaaaacaaaaaacccctgcttttcagaggggctgaactaatttacattctcaccaatagtgtataagcattcccctttctctacagcctcactagcatttacttttttaaaaaactttttaataatagccattctgactggtatgagatggtatctccttgtggttttcacttgcaattctctgatgattagtgatattgagcattgttttatgtttgttggctgttcgtatgtcttcttttgagaagtgtcttttcatatattctgcccattttttgaatggagttgttttgtgcttgttgaattaagttccttatagattctagatattagacttttgttggatgcatagtttgtgaatattttctcccatcctatagttctgtttactctgttgatagttcctgttttgttatgttttgtttttttgctgtacagaagctgtttaatctaattggtcccacttgtcaatttttgtttttgttgcaatggcttttgaattttaataataaattctttcctaaggctgatgcccagaacagcattttctaggttttcttctaggattcttatagttcaaagtcttatatttaagcttttaatccacctcaagttaatttttatatatagtgaaatgcaggggtcctgtttcattcttttgcatgtggccagccagcaatcccagaaccatttattgaataaggaatcttttcctcattgcttattttgtcaactttgtcaaagatcggatgactgtaggagtgtggctttttctgggttatctactctgttacattggtctatgtgtctgtttttgtatcagtatcatgctgtttttgttactatggtctcataacatagtttaaagttggataatgttatgcctctgctttgctgtttttgcttaagattgctttggctattgaggctcttttttcacttcatatgaattttagaatagttttttctaattctttgaaaaatgaccttggcagtttgataggaatagcattgaatctatagattgctttgggcagtatgctattttaatgatattgattcttcctatccatgagcatggaatatttttccatttgtttgtgtcatctactatttcctttagcaatgttttttagttttccttgtagagatcctcctaggtatttcattttttatgtgactattttaaatgggattgcattcttcatgtggctctcagcttgaatgttattggtgtatagaaatgctacagagttttgtacactgattctgtatcctgaaaccttactgaagtcatttatcagttctaggagcctttggcaaagtctgtagtgttttctaggtatagaatcatcattagcaaagaaagatagtttgacttcttcttttcctatttgaatgccttttatttctttcccttgtctgattgctcttccagtactacgttgaataggagtgctgagagtgagcatccttgtcttgttccacctctcaagggaaatggttccagcttttgcccattcaatatgatgttggccatgggtttgtcacagatggctcttattattttgaggtgtattcctttgatgcctagtttgtcaaaggcctttatcatgaagggatgttggattttattgaaagctttttctgggtcttatttggtgaattgcatttattgaattgtgcatgttgagccaaacttccatcccagggattaaacctacttaatcatggtgttaactttttgatgtgctgctggatttggtttgctaatttttttttttttttaagatggagtctcgctctgtcgcgcaggctggagtgcagtggtgtgatcttggctcactgcaagctccacctcccgagttcatgccattctcctgcctcagcctcccgagtagctgggactacaggcacccgctaccatacccagctaatttttgtattttttagtagagacaggatttcaccatgttagccaggatggtcttgatctcctgacctcgtgatctgcctgcctcagcctcccaaagtggctagtatttttttaattactattttttctcacccttgctgccatcttatgattttctagtattttgttgaagatttttgcatctattttcatcagggatattggcctgtaattttcttttttcatttcatctttaccacatttttgtatcaggttcatactggcttcatagaatgagttcaggaatggtccctcctcctcgaattttctctgtagaattagtaccagctctttgtgtgtctgggagaagttgtatgccaataatttaaatgcagttaatatttactggacaatttcctccagataattgtatatgatttttggtccaccctgagttgatacatgtattttaattgtatcatggtatgaaaagagcaagagtatttggtcacctagtcttgcctatagatgtgcctaatgattcaaagtagatattttgggagcctaacaggtgccgtgactaggcagttttgttttttttttttttttttgagacagagtctcgttatgctgcccaggctggagtgcagtggcatgatctcggctcactgcaacatccgcctcctgggttcaagcaattctactgcctcagcctccccagtagctgggactacaggcttacgccaccacgcctggctaatttttgtatttttagtagagatggggtttcaccatattggccaggctggtgttgaactcctggcctcatgatccacccgcctcggcctcccaatgtgctgggcttacaggcgtgagccaccgcacccggagattaggcaattttatattcccaaatatccaactcttctgacccgctttctcagcctgggtgtatcaggcacaaggcctgttcagattatgtggtctctgaagatatggctctccagggttgacaatgtggataaggattcacctggtttaggatttacacattcgccttgaatgtctgttgcaccaagtagacagtccatcccaacttggccatttggtcagagctgtaaggagacaaggaggtgggcagccgctgctgtgaactgcttggacaaagactgccaaatagctatcagacagtgttaacaacagctgatttaggtttgaagggggcagtctcttgggccacttactatgctgcatcatcctctttggaaaatgctcttcaggtaactgcctaacagactgagaaaataaaatgctcacagagaaaaaagacccggaaagtctgacttctcagagctcagtgtttaggtgcagaactggattgtgaaaggatttttaaattttttatattcattgcagggaacattcatttattccatccttctccactcccacctgtctgtcgttgtctttgtctctgtctccccacctctctctctagacacacacacacacacacacacacacacacacacacacacacacacacacacacacacacacacacacacacccctattcattgccaacagtaatagagttgcttctttacttcttggagagaaaagcctcaatctgaggaagctgtgctgactagccttgctcttaatcatggagacaatgctttatgcctttatctttgcacagctgaaagccatggcagaagcagtcctctaaacgaaataaaatagaaaggttcctgctaagccctggcaaatgcagccttctatccctcccccaacactcacagcttctgagcaagatgtagctgccttccaggaggctgggtgatgggcaataatgagcagagccacgtgaaggaaagatgggtgaagaaatgtgtgtggaggtcatgctggctgcactgaccatgaaacaaaggatctacccctctagtaactgccctactcctttggtaactgttctgaaattataacttgccagaagttcagaaggacctagtgcaggtattagaggaaattcgtaagattgagccatttattcctgcacagatacataataatggacacgggccatggtggccagcattcttgctcttgacaatggtgaagggaagggttgtaggtcatggctatgctctcagaattataatggaaagaaacagctcctgagtgtttactatgagccaagggctgtgctaaacactttaccatatgatgacatctttttctcacaggtatcaaaaaacaataggacataccggatagctacaatctttgggcccctgcaaacacaataatgtgtattctcttcttcaaatcctacatattgctacaaactgtatccctgaggcatattcattgtaaaataaaaacatataaagtactacttttgttttttgagatggagtctcgctctgtcacccagactggagtgcaatagcatgatcgtggctcactgcaaccccctgctcctgggctcaagtgattctcctgactcagcctctcaagtagctgggattacaggcgcacgcccccatgcctggctaatttttgtacttttaatagagaccaggtttcaccatgttggccaggctggtctcaaactcctgacctcaagtgatccacctgcctcggccttccaaagtgctggcattacagctgtgagccactgcacccggcccatataaagtactactaatgtaacagggtgctagtccagacagtgaccacacgtggtgttcattgaaggctggactaacaactccagcctctccgccatcacagagtgatgactgccttccctgaagcaaagcttctggttcaaggaaaggccagtaagtgactgctctttgttgtatacatgttagatgatcaggcctcaagaaaagtataaagagatctttgtgctctctgggactcaaaaagctgcactctttgggggaaggatagccaggtaaaagtggcccaggtaaagagggcctggtacacctggttctgcaagatggtagacacaaaaatgagagccacatttggagcttatgtgcccctaactctgtacataacctgcaagatctaattactaacaactggaatcttggaaacacctgtagtacatccttggctaaggttagccccaacagagagggctctcctcttacagagaaccattacatttgtgccttcatcctagagtagaaaaggcatgatcagactactaaaaagacatcaggaaagggcctgtgacatctgagggaagtggttgccctctctgggatgttggttcgggaagaggggcatggaggagtgcctgctttagatggtcattcaggaacccaggctgatagtgagaggtgaagccagctgggcttctgggctaggggggacttggagaacttttgtgtctagctaaaggattgtaaatgcaccaatcagcactctgtaaaatggaccaatcagcactctgtaaaatggaccaatcagcaggatgtgggcagggccaaataagggaataaaagctggccaccagagccagcagtggcaaactgctcaggtccccttccacgctgtggaagctttgttcttttgctcttcacaataaatcttgctgctgctcactctttgggtctgcactatctttatgagctgtaacactcaccgtgagggtctgtggcttcattcctgaagtcagtgagaccacaaacccactgggaggaacaaacaactctggacacgccaactttaagagctgtaacattcactgcgaaggtctgcggcttcacctctgaagtcagcgagactatgaacccactggaaggaagaaactccagacacatctgaacatctgaaggaagaaactccagacacaccatctttaagagctgtaacactcactgcaagggtctgcggcttcattcttgaagtcagcaagaccaagaacccactggaaggaaacaattccggacacattttggtgacccagatgggactatcaccaagtggtgagtaccatcaacccctttcacttgttattctgtcctatttttccttagaattcgggggctaaatattgggcacctgtcagccagttaaaagcgactagcatggctgccagatttaagagactaaagacacgggtgtcagactttctgggaaagggctctctaataacccccaactctttggagttgggagcgttggtttgcctggaaccagcttccacatttcctgtacttctgggctgagacgagggtcaacagagaggaaagccattcagctctggggtcccgacagcaagttggttgaccctgtggccatgagcagaactctcgaagtcatgttgcccaagcgagactcacccatctatcctatctatcctgactcttgcttcctgggtcctaatgcctggaagacaaaacttcctcttgtctctgttctccaaggctagtcccacttctaaaaaccactccctgtctctggtgcttttctagtttctcctataagaatgatttctagtataaactccaggactctattctcttctttaggcacccgggctcaccaatcagaaagccataatttttgcccaaagccccatcttaggggggactatctggaattttaggatccctcctcagacaagcaggcctaacaaaagctattcctgaagctaggatatggggagcctcagaaatgatatccttcctattcaagtgaggacaaaaggcatcactcttccaattctggagatcccttccctccctcagggtatggccctccacttcacttttggggcataacgtctttataggacacgggtaaagtcccaatactaacaggagaatgtttaggactctaacaggttttcaagaatgtgtcggtaagggccactaaatccgatttttctcggtcctctttgtggtctaggaggacaggtaagggtgcaggttttcaagaatgtgttggtaagggccactaaatctgacattccttggtcctccttgtggtctaggaggaaaactagtgtttctgctgctgcatcagtgagcgcaactattccaatcaacagggtccagggaccattgtgggttcttgggcaagaggtgtttctgctgctgcattggtgggctcaactattccaatcagcagggtccagtgacctttgcgggttcttgggtcggggggtggggggaacaaacagaccaaaactgggggcagttttgtctttcagatgggaaacactcaggcaccaacaggctcacccttgaaatgtatcctaagccattgggactaatttgacccgcaaaccctgaaaaagaggtggctcattttattctgcactatggcctggtcccaatattctctctctgatggggaaaaatggccacctgaaggaagtataaattacaatactatcctgcagcttgaccttttctgtaagagggaaggcaaatggagtgaaataccttatgtccaaactttcttttcattaaaggaaaatccacaactatgcaaaacttacaattcacatcccacaagaggacctctcagcttacccccatatcctagcctccctatagctccccttcctattaatgataagcctcctctaatctcccccacccagaaggaaacaagcaaagaaatctccaaaggaccacaaaaacccctgggctatcggttatgtccccttcaagctgtagcgggggaggggaatttggcccaacccaggtacatgtccccttctccctctctgatttaaagcagatcaaggcagaccaggggaagctttcagatgatcctgataggtatacagatgtcctacagggtctagggcaaaccttcaatctcacttggagagatgtcatgctattgttagatcaaaccctggcctttaatttaaagaatgtggctttagccacagcccgagagtttggagatacctggtatcttagtcaagtaaatgatagaatgacagctggggaaagggacaaagtctctcccggtcagcaagccatccctagtgtggatccccactgggacctagactcagatcattgggactggagtcgcaaacatctgttgacctgtgttctagaaagactaaggagaattaggaaagagcctatgaattattcaatgatgtccaccataactcaggaaaaggaagaaagtcttgccttccttgagtggctacaggaggccttaagaaaatatactcccctgtcacccaactcactcaagggttaattgattctaaaagatatgtttattactcaatcagctgcagatatcaggagaaagctccaaaagcaagcccttggccctgaacaaaatctggaggcattattaaacctggcaaccttggtgttctataataggggccaagaggagcaggccaaaatggaaaagcgagataagagaaaggccacagccttagtcatggccctcagacaaacaaaccttggtggttcagagaggacagaaaatggagcaggccaatcacccagtagggcttgttgtcagtgtggtttgcaaggacagtttaaaaaagattgtcctatgagaaacaagctgccccctcacccatgtccactatgctgaagcaatcactggaagccacactgccccaaaggacaaagattatctgggccagaagcccccaagcagatgatccaaccacaggactgagggtgctcagggttagcgccagctcatgtcatcaccctcactgagccctgggtacatttaaccattgagggccaggaaattgacttcctactggacactggtgcggctttctcagtgttaacctcctgtcctggacagctgtcctcaaggtctgttaccatccgaggaatcctgggacagcctatatccaggtatttctcccacctcctcagttgtaactgggagactttgctacagatagtaagtatgcttacctaatcctacatgcccatgctgcgatatggaaagaaagggaattcctaacttctgggtgaacccccattaaatatcacaaggaaactatggagttattgcacacagtgcaaaaacccaaggaggtggcggtcttacattgccgaagccatcaaaaggggaaggagaggggagaactgcagcataagtggctggcagaggcagggaaagacaagcagaaaggaaagagagaaagagcagaaagtgagagagaaagagagataggaagtgatagcaaagagggagtcagaaagaaaagagaggagagagagagggggaaagacagagagagacagaggaagagacagagagacagaaagagagaagcaaagagaggaagagacaaagaaggagtcaaagagagggaaagagaagtagtaaagaaaaaacagtgtaccctattcctttaaaagccaggttaaatttaaaacctataattgataattgaaggccttttctgtaaccctataatactccaataccaccttgttgtcagtgtaaacaagggtatagcccaaaagcactgaggccactgacaacccgtagccttcttatcaaaaatccttaacacagcaggtttcctaacagggaatctaaatcttaaggtcggaccagacataggaggaactgccttcaggacaggatgatagatggttcctcccaggtgattaaggaaaaagacacaatgggtattcagtaagtgataaggaaactcttatagaagcagagttaggaaaattgcctaataagtggtctgctcaaacgttgaagctgtttgctgtttgcactcagctaaaccttaaagtacttacagaatcaggaaggagccatctataccaattctaagttaatatggactgaacgaggttttattaatagcaaagaaaattaaaatctcaaacttacaaggttttcaactaaagtaaagtttgctaaaagttaacagcgtaacatgtattatcctactaccacacactctctcaaaggatttctcagacagtttgcaaaaaagagacgaaatctgtccttactctacaatcccaaatagactctttggcagcagtgactctccaaaaccgctgaggcctagacctcctcactgctgagaaaggaagactctgcaccttcttaggggtagagtgttgtttttatactaaccagtcagggatagtatgagataccacccagtgtttacaggaaaaggcttctgaaatcagacaatgcctttcaaactcttataccaacctctggagttgggcgacatggcttctcccctttctaggtcctgtgacagccatcttgctaatagtcgcatttgggccctgtatttttaacctcttggtcaaatttgtttcctctaggatcgaggccatcaagctacagatgatcttacaaatgtaaccccaaatgagctcaactaacaacttctgctgaggacccctggaccgacccgctggccctttcaatggcctaaagagctcccctctggaggacactaccactgcagggccccttcttcacccctatccagcaggaagtagctacagcggtcatcgccaaatcccaacagcagctggggtgtcctgtttggaggggggattgagaggtgaagccagctgggcttctgggtcaggtggggacttggagaacttttgtgtctagctaaaggattgtaaatgcaccaatcagcactctgtgtctagctaaaggattgtaaatgcaccaatcagcactctgtaaaatggaccaatcagcaggatgtgggcggggtcaaataagggagtaaaaactggccacccgagccagcagtggcaacccactcgggtccccttccacactgtggaagctttgttcttttgctcttcacaataaatcttgctgctgctcattctttgtgtccacactacctttatgagctgtaacactcactgcgagggtctgtggcttcattcctgaagtcaacagaccacgaacccactggaaggaacaaagaactcccgatgtgctgcctttaagagctgtaacactcactgcgaagctctgcagcttcactcctgaagtcagtgagaccacaaacccaccagaaggaagaaactctggacacacctgaatatctgaaggaacaaactccagacacaccatctttcagagctgtaacactcaccgcaagggtctgtggcttcattcttgaagtcagcaagaccaagaacccaccggaaggaacaaattccagacacagtaggaaatctgtatttttgatctgtggctttcagggttactccagtcattgaagtctccattgcagccttaaggaaacagagaatggtttggaggagcacatgtgggaattgttatggaccaggcttgagatgcacatagggcatttctgatcaaacctagctggaagcagggccaggaaatataatctaaggaagacagtttttgtagacagtagtagtctttgcatctgagacatgtagattatcaagcaattaattagaaaaaatatagccaggtgcgatggctcatgcctgtaatcccagcactttgggaggccaaggggtgtggatcacgaggtcaggcgttcgagaccagcctggccaacatggtgaaaccccgtctctactaaaaatacaaaaattagcctggtgtggtggcacgcatctgtaatcccagtactcaggaggctgaggcaggggaatctcttgaacttgggaggcagaggttgcagtgagccaagatcacaccacagcactccatcctgggtgacagagcgagactctgtctcaaaaaaaaaaaaaaaaaaaggaaaggaaaatataatcaagaatattgacaggtaacatttattcaacacttactatgcaccaggcaatacactaagtgttttacatggattaactcatttaatcttaacaatagccctatgaagtcagtgctgttattatctccactttatagataaggaaactgaagtacagaaaggtcaagtagagaaatggccatgcttgcattctcagtttttgaagcaactgttacaggaatctggtgtgagaaatgctctaacaagatgtgagtcaggggttgggaggtactgagtctgagttgggcagttggggatggaaggatggatgaagaacagcttgacagagaagctgacacttggcaactctgtgggaccttgaagggttagagggacttcaccaaagaaactggtggtcagggaaacgggagggtcacggcaaggagggaaaggaaactgtaccacagcagagagtctgaagctactacagtgtagttcagcgtataaagaataattattttaaggtaaacttataacctcatgcaaatataaaatgaacacgtgtcaaagatcttatttaatttattaattaatgagggaacctgtaagatgttacagccagttcaaaggataattcaaataaatccatgcacatatgtaggcaataaggaatgctgaaatgaatttaaaagtagatgtaaactgatttatccacagagaaataatcagttgcatttcacataacaaaattcagttgcttttctacagaaggaattgtttgcatcattaccaatttttctacaactaacagaattataaaataactcaaacacaatgaaaggcagatataacccacaatggtatgatagatacaatatccacatccaggatgtttttttctcatttcaaagtctttcacaagttttcctgataagggagtgtcaataatactgtatggcaggcaataagactggatggatggttggggccaggttttaaggggtaataaatgccatgtaaaggtatgtgcatactgtgcaacatgtcggggaatctcaaattattggtagagtatgtaagaaacacttgtggagcttgttaataaattcaaattcccagacccaactcctcaagggtctaatacagtaggtttggagtaaagcctgaaaatctgcaattgtgcaaaaaaaaaacccaggtgattctgatacactttgagaagcactggtggaactaatagtcactgaacgtttttgagcaggggagaaacctgaggacgtctatgttgcagcagtggaaacttgattagaagtaggagaagatgcatggtcttaaaagaatgcaaaatgatggctaatatttgagtgcttatgatgggccaggggctgtgctaggcgcgtggcacacattcaatacgatggaagcctgtaccagtcagtattagtggggtatctttaagagtgaccagaattaaggggggttttcaccaaagcctgaggactgagcctcctcatcctaaattcagacacaatgctgtacctatgcatttgcctccaggctgttcctgggcctccagggactggcccaggctcctgataaatagggactcccaacaacataaagcctggattttggaacttcctgaatgttactcaggctttctagtaactgtggagatctgaataataacacaattctaagttcccctactcataaagctgctcatcatttagatggggtaaagcacctgaaatacaatgagcatcactattttcattcatccatgaaatgaacattccggggagatcagtaagttgatgtatcacccttgaacagggcaaaatgaatactcaccaggaatatgtggtattttaaaaagaaggcaaagggaagaacagtggggatggggcaaaaactttaaatagattcccccaatcatatatggcaattgaagataattaaattatcattttaattgagtaagtactcatagagccctcactatttgaaaatgaactgcctcctaattgttattgtgcaaatgtgatacattaaacttaagctattttaataaaacatccattttcggaagctgtagtaggttctcccaggtcagatttgataagccataaagaacaaatgccaactcctatttttctatggtgctgggaaataagagagaaatgtgtaattcaaagcaatcatttaattttatccaatagcttgattctcctctctcttctagccttttagctaagctgttaccaagtaaccacactagttggcttgagtcttaccactgtttccctgaccccacagtggagagactgcatctgttaaagagcagttatgtaaccatggctatgctgagctgggattcccaaggcttaggttctttctgtgaatgaccttcaccaagacacctgaggtctgtgtggaaccacaggcttgtcatctctaaggcagagttgataattccatctgtttcttgagcccacactgagaaaaagattacatgactgcagttatttgaatgcctcatggaaagacgtcttataaatattataattaatgttatcattaagtaatgcttcaatgcagatcttccaagtataaatatcagctgagtaagaagtcaatcttccctgaagcaaaattgaaatttgtaaatgcgatttctgggagcttattttgtaatacatgattccagagtgtccataacacacacaattgtcttttttcccctacatgggctatttacaacaaaattggacttataatgtttatttccagggatgactagaactttaataacaaaccttgggccaggcatagtggctcatgcctataatcacagcacttcgggaggctgaggctggtagattacttgaggccaggagtttgagaacagcctggccaacatggcaaaaccctgtctctactaaaaatacaaaaattagccgggtgtggtggcgcatgccagtaatcccagttactaggtaggctgaggtacgacaatcgctggaacctgggaggcggaggttgcagtgagctgagattgcactactgcactccagcctgggtgacagagaaagactctgtctcaaaaaaataataataataataataataataataaaccctgatgaaaggtttctaaaatgttttcatctaatggttttcttgacaattaaattttctatataatgtcagttcataaaaaaactgagaacgaccacatgtcatatcgactgcttaaaagaaaatacgtatatttacaaacatatacacaatactgtcttttgtctggttagtttagaggttagaataaactgcagtatgttgtagtggacagatcatagaactaggagtcaggatgtctggattcctaggaagcaatgaataggttgcacggtgcagctcaaggttattcaaagtgtggtgcccagaccagcatcatgagtatcctcagggagcttgttagaactgcagatcctttaactcattgaatcagaatccctaggtgtggggccctgaaatctgtattttagcaggctctctgggattgtgatgtgccttagagtttgacaaccactgggtagctgatcctgacttagacttatcaggcatgtgatcttgaacaagtcacataatctcactgagttcagttttcttatgtttaaaataggcccaataatatctatttcacatggactgctttgaggattaggcaagagatctgtaacagacactgtagaacagtgtctctggtctacagctgaccttccataaatggtagttgccttgattctctgctctgccacataatagctggttaactatgagcaagtaatttagttcttctcagtttagtttcttcacctgtaaaagaaggaaaataactgttatactcaatttctgaagtggctataaaaatcagtttaaattatgggcattgaagctctttgtacactgtataaggactgtacatctaagggattaatgagaccaggcttatgattttaagcatggagtaaatagtaatactgactctgttctatgaaccacatggaaactctaaagaatatgcacatttgaaacacaggtatcatctggggaaggtgatctgctcacccaaaccagttcatgaacatcaatctccagtggcgtgctggagctagctgtaccagctcatgagggccaattgtttcatttttaggaattttgtttgctggttaaaaatagtcattatttaaaattaaattatgtaaacaataatattagataaaataagttaaaataaaaacaaaggaactaattatccccaaactcttccccacctaattattttactatctgtgccttgggattatttacattgattttatccatatggtgacaatactattcatatataaatggtgtgcttctcttcataactctacatagcctgatgtcaggctagtagcttgaaattggccacagtgggagtgtgagcatttgtaccatgaggcttggccaaggctacaaatccagacttttgtttttccctcctggagagctgtctgttaaaaatttaccaacacaccactggtcttacctttgttaatttaccacagtccaggttctgacctagacttagaaacctggatttgtcagcaagctgaggatagagccattatttctaagaaggactcacattacccaagtgcaaagcctgatatataccttcagaatatcaatttattaatttacagtgaagaaagccaccccagggcattccccaggggaaggcaaaaagagctagttgcacattttgaatgtttgatgacattagggtaaggtgacacagaatatccatttccacaactgagatacctgctgccttaaggaagggacaggcaagtccttgggcaggaccttagattgtcactgtccatcttgctctaggactctcctttccaggcatgacgatggccaactctgtcctcctaccctactgatgggattatcttttcttgacacatggcaatgcctccaatcagaggctggtagctatttttaatcttcagggcagtatttttcaaagggaagttcatggaccatatgcatctgtatcatttagatgtatattaaaaatgcttaggtcttccccagttatactagatcagaatctctgttggtggggcccacgaatcggtattttcaacaaatcactaggtaatttctgtatatactatagtgtgaagaccactgcttgaaggtttctttgcatatctccactaaatataaaaaatattgacttctagatttaactcccaaagcacttgcatttttaagtttctgggggcattatattgtggtacccctataccactcacactctagtcaggaggtatattatggactgaatgtttgtgtccctccaaaactcatatgttgaagtcttagcttccaatgtgatagtattaggagatggtgccttctggaggtaaaatcaagccctcatgaatgggattagtgcctttagaaagagagctccgtcactgtctttccatcaattgaagatgcagtgagaagctggtagtcttgcatctggaagagggccctcacacaacctgatcatgctggcacctggtctcagactttctgcctccagaactatgagatgataaatttctgttgttcataccccacccaggctacaatattaggttgctgcaaagtatttgtgatttttgcctttacttttcagggcaaaaactgcaattacttttgtgccaacctaatattttgttatagcagcccgaactaaggcaagggagactacatcagacagtgtagctatgtaagtacaaatgtatccctgttgaggaaaactaagttctaaccctgacttcaggccagtagccaccttttcaatctctttcatgaagggaccattatcattatcactggtggcaaaaatagaggcacgagaatggaatttgcttttctgtgaaatctcagtgtatacagattgaagagcaagggtttgctttcatctctaagaagcaaaagtgagtacggactggcacattatcagagaaagaatcattctagctcggtgggtcttaaccaggagtgaatttgactccagggaacagttggcaatgtctggagacgtttttatttgttatagctgggggatgagtgggtgggttgctactggcatctagtgggtggagaccagagatgctgttaaacatcccgcaaagcacaggacagtccccgacaacaaagaattatctggccccaaatatcaatagtgccaaagttgagaaacctcattctagcttccttttcccttctacgttctaatcaactgttgttctttcagcattaggattcatccagcagtctctttccccagcaatttgttgaaatttttttaaaaatggactcattttagtgtcacaagaaaaaaatacattcacaggaaaggatgggtcattttgtttaatgatgttttgcctttcacatagcaaaagcttaataaagtatttttaaataaaatggtgaatagatcaaaacattaatttcacatgtgttttaataaataacaggaagatggctatattatataaattgttcttgtatatgtcttgagtggatcatcaaacacaaacgtatctacatgccttttcttgtgaatagatctaataataacgctcttctaaaaacaaattaaatggatattatttgctgagaatgtaatgcttgtgtgaatagaagccagccctgaatccaagcccccagatctatttaaagaatttgaagaatgtcagaaaagcacgtggcttcaaggttaatgtgtaagactgacagaaacttgaaaaatcactatgactaaaaagaaagtatgagctccctgcatgcctgtaaattggaatgacagccaaaaccagttaattataaaaacagctaatttaacaggttttcaaatttgtttctttctccaagtagcatatagtcaataatccttaaagagaaagcaaagaaggggaagcactgaaccaaatttgcttttttgtacctgctcagctcaaatgcagagttctctacctggaaattgactgcttccatagtttgatagccacagagagatgggaacagaaggagaggtataatcccagacttgattcagctatagagaatgacaatagtgtcagaggccttccaaccagagcgactccatcttgaatacgggctgggtaaaacagggctgagacctactgggctgcattcccaggaggctaagcattctaagtcacaggatgagacaggaggtcagcacaagaccttgctgataaaacaggttgtaataaagaagccagccaaaacccaccaaaaccaagatggccatgagagttatctgtggttggtctcactgctcattgtatgctaattataatgtattagcatgttaaaagacactcccaccagtgctatgacagtttacaggtacattggcaacttccggaagttaccctctatggtctaaaaaggggaggaaccctcacctcccagaattgcccacccctttcctggaaaacttgtgaataattcacccttgttcagcatataatcaagaagtaactgtaagtatccttaggccagaagctcaggccactgctctgaatgtggaatagccattcttttatcctttactttcttaataaacttgctttcactttactgtatggactccctgtgaattctttcttgcaagagatccaagaactctctcttggggtctggatcaggacctctttccagtaacaatagtagtaaggggtcagggagactggacaaaggagtttaagaagccttagataaagggtcctcatcattgtcataacataaaatcatggactcctagaattttatagctgataggattagaaatttcaaaattcaatttcattaattttcatctgcgaaaacagatggccagagaggccaaacaatttgttaaggagcactgagggcagaccacactggaacgcaaacctcttagcagagtatacaaggcctttgatctcctcagtcagaatgaactagagctttccagggtaccctttctgactgtttagcatgtttgccagtctgactaattttgaagttgcttaaatatctgtcatttccactgtatcataatctcctcattcatcttcaatctccaatgccttgaactcagtaaatgttagttgaacaaaagtaaattgaacccagaatttctgatcataatctggagcactttaaaattgtcagcttactgggaaacgggataacatgtgatttgtctttgattttttttttctcatatgctttttccacctatagatgctacacgaatgtttttaaaatctgatataaaaattaaaattaaaaaattaaaaaaagaaaatttgatacaatgctacatttagagtgttgtgattagattccttaagtgtatcatggtgatctctacatcacgtggtgatcaaattgctttgggttttaacacataactgacaaaggcttggggacatgtaagatcccaaatacatttttattgatttttttttcttgtttgtcctcttttaaataacttttttttgttataagaataattcatgttcagtggagaaaccatagaaaatagtgacaagtgaaggaataaatttaaaatgacccataattgtaccatacattctgattttttaaacgctgaacaaattagccttgggtaagtaccaggaatagagtgcagcattgaaagttaaagtttggggaaggatagctgacttaagaaattatctagttagacattttttgatggggtaattttgcagatgacattagtgagagaaaggacttgccactctcacacagctagtaggggtgtgggaggatattggaaccaagtttcaagtcttcagtgaagaatcaagggagaagttctaaaacctaacaatatccctctggatggacatttattttattactacaataagccacacggtgagtcataaggagcatttcattcttctaatatgtctctactgtatttagaatctgataaagcccctattagaattcatctctttaagaataaaagaagctgaggaactaaagagagggttggaataatccactaattatatccgttaagcttcagttacgctaataaggaatatcacatgactgtggtgtgtgcttgttctgaacagtaaagtacatgaggaaagataagattcagggctgaaatgtccttcagcatatgtaggtagtggtgatgaaagtcattaaaagaaaaattgattgaggtattttagtaaacaaaagaactcaccacttacccatcaggaagtgtattgttaatgcagtgctgttcagccttctggaagaaaaggtttcttcatgcttctctctttagcctaattcttatcctgtcacttttcaggcaaaattaaaaaaaaaaaagattgaaaacgatgctcctattttatttgcttcaaaagaaacaggctgttgcattgtgcttggaacagtttactcttggccttgatgtaagtgtgaaaggaagcccatgtaattgactaggcagtatctgaagaagcaggaaatacagtgttaagaaaatgaacaggcatgaaaaccatggctatttgataaaagtaaataatttctgcagttcacatgttctcagcatattttctttgatactgacttgcttaatatgacaatagcagaaccatggtagcttgtaggcattacttttcttttaatttcttttacattttgaatttaccagcactcacatttgtattacttttgggttatactgaggatctataacttatagatcaaatacctgacatatatatgcattctctgaagtcttagggcagaactagaacattcttgtgaacatcagtataagatattaaaatggaagttttgcctaagactgaagacaataaaaatatcatagtctgaaatgaatgccagcacaccatacaggatttaaatatctatacatatatatgtgtgtgtattatatatatttaatatatatctgtgtgggataggaagaggtagggggaaatcagttttacaattattaagtatttcacccttgacaagagtatatatattggaaatcagttggagagtattttcaaagataaatgttagtgtgctatgaatgaatccacccctaccaccactgaggcagggtaggagaggcctgtgctcctcaagcatagttggaaaaggacctcaacaagaccacttcaagagcctaatgtgtggagactgttgcttagggagaccttatggtctagcttctgactcacagctaagtcagggagacaggttggctgctctgatcgtggagtccaaaagatggcctgcactgaaaagcctcatgagtgttgacttagggctagtctaagaggtccctggaagaagaaacactcagtaggagagaagctggaggtaccttcagtgctgaattggaacctagattcattcccccgtggagcaaattacataggaaagatgcccagtgatggagagtgggggtgtctctaacaattacccacccacctgcccccacccctaagaaaaagaaaatcacatacaaccagtcagctgtaaacatatgccgagcctagtaaactcagatactaagttaccagggtacctggcaagtaagaacattcctgattcccttccctcctcttcctctttgccctccaaccttagtggctagcaagatggggagaggaggagaagctgtaagtggggaaaaaagagcagctttctctccttttcagctgctggattctccctcatcataggcctgagctggggaatcaggaagaaggattctttttaaaactgaagtaacgttatcatttaattttaaaacattttaaattttgacaatgttgagattagatatactaattattaaactaagattatgttttgcagcttgaagtgataagaaaaacctcttatctaagagcatccaggaaagtcgggggtttcctgaacatccttttaaatcctttggaagtcagctttcagagaggatttaaagtgtagactgggccttcagaaacttgtttaatgtaggggtttcctatgcagacttggggactataccttgtgtggaagagagaaaataagattatgttacatttttcccattcctttttcaaaaagaaagctcagctagcatgaaagttaaattcaaaacgtaatgggtattatttgcatattcaaatctagtgcatatcatgtaagtactgaattatggtattcattatttcaaatgacaagctggatttttttttctttcgaatttcacaaattaattttccttggaaccttttggtttgggctttaagagtttaggctttcatcacaaagagaggacagccttgaagattaaagtgtgtggctcttctcaagatgttcttagtccagcaaaggattctatgcatatttgggcttccttctgtctcataacctgtatttcttgatattctatttatattctgtaagattttttttttaaaggaaaaattcttccatggttgaaggacatgtcaaaaatagaggatacagttttatatcaaaggaagtttcatgatatgactgtagaagctcatttgacttaagacacatcatttcctcatggaagtgttaaacagatctgtacaataaggttggcaatctttgtgtaaaacagttttttttctcctgctctaaagaaagtgtatatttcaaaatgtgaatgtcagcagtcagaaaatagtatttttttaacttcgttttcaaagtcctcaaaaacctgtacctaatcatgaattttttttcccacagattgtttcttcttctccctcccagaaactttgaagtttttctacatgacaccaggacctatgtctttttttaattacacagaaatgaaagaaaaaaagtgtgttgtatcgttaaccaaatatatgaaatctttaagctgtatttttatttttaactttgttttgcaaagaggccattccctttggttaaataatttgttattcacagtttccttgtcctcatattatcaaggggaaaattgtagaaattttaaaggaagctctaggcaatgttttcatccctgaatctttggagagttataaaaacaaacagattactgaacctgtaagagaaccaatcgtgaagtcattacatctaagcataagcaaaatctcctcttggatcattaagttatagaagaaaagaaagcctgcactttgaaatttagataaagcttggtaacttgtaagtcaaacacgtaaaattttacaattcaggaatatcgatagcagttgagtttaatagacttctcacattccaaatttaaagcttccttctctgtgctaatagagatacaatagcagtaggcgtttaagaagaatgaatcaacaatttaaaactataatgtgttttttattcatctcccttattcacatatatttgttttgttttgagaaggagttctgctctgtcgcccaggcaggagtgctgtggcacgatctcagctcaccgcaacctctgcctcccgggttcaagcgattctcttgcctcagcctcctgagtagctgcgattacaggcgtgcgccagcaaccccggctaatttttgtatttttagtagagacagggtttcaccatgttggccaggttggtctcgaacccctgatctcaagtgatcagcccgcctcggcctcccaaagtgctgggattacaggcgtgagccatcacttctggcccttattcgcatacaatttaaaaatcatcacagaaggtttgaaagaaggaaggggcagaaaattacctacttttcctctccccagcgatctccttcaaatctgtgccttttcctcaggcccaggcctcaatttactgagcagtcacacctcacagagggaggtctgggcaatccactcttggtcacaggaaagccattgaccctcccacttcctctcctccaccttgttctcaactcttgactttgggctttgtttctgttcaagtcctaggaactggtttcttttatcaggttaagtgattagttctctttccctctagttgctctcactccctgactcttgccttctgtaacaactggagacaactctttcaaaaccagctccaagccccagacttctctctgggctttagttcgtaaggcaggtgccctactgagtgagcctagatcagacagaaacatagctgttggcaaggatttaggtgaatttccttccattgtttttctaataccttttttttttttttgtaaatataaccatgcacctacacacatatttgaatatcctgcctttttatttaaaatgacatgataggtccgggagtggtggctcatgcctgtaatcccagcactttgggaggccgaggtgggcagatcacctgaggtcaggagttcgagaccagcctggccaacatggtgaaactccatctctactaaaaatcaaaaattagccgggcatggtggcaggctcccagctactcaggaggctgagatgtgaaaatcgcttgaacccgggaggtagaggttgcagtgagctgagatcttgccattgcactccagcctgggcaataagagcgaaactccatctcaaaaaaaaaaaaaaaaaagacaggataaacattctagatagtctctataatggtcatgattaagacaataaaatagtctgaaattgtcaatatatattaataataatttatttggccattctgccaagtagcagacacctgtcattctgcccactcagcacctctctttcttttagggaaatgctacccactctttgcatgggttctggatggaactgttgatcacagtgttttcactccccattttgcctcaccagaggtagacagaagacccaagccaggccagttacacacaatcttcagataattaccgtattgatcacagtatcaccccactcaaggcttggttggagatgagcagaagagactaaagctgggtcattttaattaacacctgtaccccaaagaaagactgtcaatgaggcttttataccgacactcctggtttccattcttcctgatgccattcatttgacgaactacccaatctttccaacagtgtctttggaagaaagatagtcagaaaagaagatagagttgttttctgttctttgcaaccaaggaactctaaatgatagacttgttgctaggcactttggttatttttattatcttgaatacttctgtgatatacttctttgtgcatgcctgtttgtacggatgtagctttttatatattttatataatttctcagaagtggaattacttagtcaaaaggtatgaacatttttctgattcttaatataaattgtgcaaatgctttttaagaggattataccagtttacattttgtgttatatataacagaaagtactactgaaaaaatattacaaaaatttgtctctctgttcaggaggaccttgtaatagatgataaagtacttgaaataggaacatagagcattttcagtttaaaataatttcattgggttatttacggaatccttagaattatggccagacatttatagatgatctgtaccaaacctaggttggttacataaattgcttattcaactggcttaaatctataatagaaagatgacacttactgaatgtttaatatacactttgtcaggggctttgtattattctatgacatcttcaaaatgaccctactttcctattttataagtaaggacaggaaggcttcaagaacatgactaattttcccaagggctgtaccaaagccagaacccaaatctataaggcttttaaacctgcattctaaaactgcatctcggccatcttattcctacagaacttaaggttagaaagccagattggagtcccaatttcaccacttagtaaccagacaaacttgaggaattcactcaacgtctttgaatcttcattttctaatctttaaaactaaaacaataatacttgctctacctatgtcctaagatttcgtgaggcacatagagatagtgtggaagagtgctgtacagatgtcaagtgttagcgtgattacttagatccctgaacaccatggatgaatgtctctgactgctattagaggtcataaagaatattggggccaggtacattggcttattcctataatgccagcactttgggagcctgagacaggaggatcactcgaggccacgagttcaagaccggcctgggcaacatagtgagaccccttctctacaaaaaaaaaaagcagccacgtgtagtggcacacacctgtagtcccacatactcaggagggtgagttgggaggataactttagtccaggagtttcaaggtgcagtgagctgtgattgcaccactgtactctaacctggacagcagagtgagaccctgtctctaaaaaaaaagaaaaaaaaataataataataaagaataatggggccttgggatacccactcctctctttctgctctgagttgtgaagcagttgagttacatatgcatgtccaatggatgaggttgaaaatatcaactggattggaatgtggcttacttgcgtggccacaatgagcttcgtaacacttcctgacagggtgagaagacaaacttcctcacccagtcactggcagagctggacactctgtgtctctcccacagaacaacctcttactgcatggaggtggatgaaaaagtcaaccgagaacaggctactccaaaaagcagagcaccaaaggcaccagctggtcaggtcccccttcctaagtaaacaatcacgtaattcattcgggacaaagccagagaggtggtgtggagaaagagagggcagtttcctcccaagtttttcctggaattctttatgggaatatgaggtttaggggaataagacttccctttaacagtgaagaatccccagctctattggtaataggaaatcgcttacaaggatcatggggagtatttcctcagctcgttctgcctcctacttggctgagtggaatggaaccatctgtggctgctgcatatgatattgtcaactttgtcattccacacccactccttgacgccctaccatgtggtcataagactccctttaaagtgttcctttaaaaaacaaaatgtgttttgtttctataaaatacagctcaatgtcagaacccttgtcttgtttgctctctgatgtaaccctttcacaatgtttgggcagcttattctctctatttccctgtagggtcccatccaggccaaagtgagtgccagcctcatttgggcagcagatgccctgtggaagggcaggaggagacgagagctaattgtaactttgtgattagctgtcatggatgcctggtcctgtcaatagcgctcaataaagccagaaggccaagcgttcgcttctgcatactgattgctgagtcagatttctcagtgcagaagggctttctaggcagtcaattttagaatattagtcttggttcttaagtggttaaaatccctagctggtctttaatctgagcctggagaatttagttatggctgacattctgctgtgatatttttgccctcaatatatatgtctttcctccatctcttagatccctgaatcatagagatatatatgttatataatcaactgtctccagtctctaagagtgataagtacacattgtgtcaggttgaggggacaggagaactttcaaaagcctttcttgcccctttttccttctcactgcctcccactaagtccagccacttattattcagctgacactatcatcatgaccatgaggtcttttggggctaccctggttcggatccttctggaggtttgttgcttaactctgtcttcagtcctatgagctgctttttcaataagtttctattttggctaaagttggccagaatctccttgtaaccaaagaacaaataaaataccagcttgcaatgttctatgttgcttccaccaaacttatgcagcacttcctatctaatccacctactagtcttttttttttttattttttttgagacggagtctcgctctgttgctcaggatggagtgcaatggtgcaatctcggctcactgcaacctctgcctcccgggttcaagcaattccccggcctcagcctcctgagtagctgggactacaggtgcatgccaccacgtccggctaatttttgtattttaggagagagagggtttcaccatgttgcccaggctggtcacgaactcctgagctcaggcaatccgccctcctcgggctcccaaagtgctgggattacaggagtgagccacctcacctggccccgacctactagtctttagtgtttgcttccttctattgggtaattgtctgtttatatgcatgtcttgtttcctcaaataaaatgtggtcttctcaagggtattggcccatgttctatccatctgtagatatcacagcacctagcagtgtctttcacagaggaagtacacaactggcattattgattcattgctccattttttccttctttatccccagcatttctcaataatttcaaacatctccattggagtaccggagaaagcaggtagctttacttgcagctatgtttctatccccatagtaactaaaagaggacccagagaaacatgtttaaatgctgtcctgttatcaggacctcagccttctgatgctccgtggcttgggggttattgcttgatcatctcctccccaacctacactgtgtacctatgctagtctcttcatgaggactaagccccatagtaaaagggctagataaatagaaaatcattttatgtaattataagaatgagaatactgagtattctggtgtttgtttaggataagcacatctttatttgtatgagaaaaagaaaaagagagtgaaaaatatattaacgtgcatattgttcagaacccttggattgcaagtgacagaaactcaattcaaaccaacgtaagtcaaaaggaaaatatattggctcatgtaaccttctcacagagagggcaggatggaaggggctttgggaacaagagaattgttctcaaattctaggaatactaggattagtccaggatgggtcaccttcctgtccctgaggtggtggtagcgatggtagagtcttatgggaggaaagagtgcatgttaggatgaaggtagggctaagcaaacaagggcaagggccactatatcatgctaaaaatggttttttttgatgtcttccttaatttcacaaatgcttccaacaaagtagcacacaggaaaaagaacatagggactctactggtgggtgcttttatcttaagccttgtacttgcttttcacagcttactcactgcttgtacctgaggccatatgccctgtaaaagcttctgcagggtttctactaagctgggttccttatatggctctctcccatttctgttgcctcactctagtgatctttctcttttcctcacctctgggactggtggctgtttgtatggactgccttagctttgctttgggttttttcctggggacaatgtcttcagattatcctagaccaaataaactacagccactgggccaggctcttcctcctccaactggaccatgttcccagggctcttcaccttagtttaggtcaagcattcttggcaaaagaaaggcctagttaacaatagacattctagcaattgattctttttgacatgttgtaagatctattcacattttgtaattaaagcattcccctatggaaaccaacacgaactaagctgctcctggaatgcagggtggcctcctcaatacaggatgttctagaaagctgtattttgggcacttaactattctccactacttagggcacagcactgaaattaacaccactaagtttgtcatgtccatgtagttagtctcaggcagtgcagcctcaggagtggaactgacctcttatgtgtgtccagcctttcttccttcagaagtcagctgtgttttctgctgactctccataggaacatcagtcctgaatcctcagaccaccatctggagtagtaagtgctcctgacagtcctagaagttgtctaccgctggatctccaaagcgtgtgacacaccgtgagagagaaatgagaaagctgggctcttcaggtaaatcttgctttttcacaagccccctaattttactgcataattattttgaattcactgataatttctacaattttcccataagtcatctacacacaataccctctcatgcaacacttggctttgctaatacatatctattatgagagctgtgcttcttaagcgtaaatgttttatatgcactaaggctcttggcttacatataaaaggggtattgagcaatgtgatacagaagtcttttctccacaggtctcatatgtaaagaattcattagattggctgaaatagactgatctgtccatttctctgctcacttatcataaggaagtcattagctaaggaacaaaaactacaatctatgtaattagaagaacaagctggttttgctcaatataaaaataagaaaaagaaaccatgtgaaagtcaaaatatttgtttaatcaggtcattgagaatctattaaaaagtatttgaattctttatgatgagaactatcttgactcaagtggacagtggtgagctttttggcctgtggtccctacgtagaaaggaggctttgtcataaagtcttatatggtacaggtgccaagttaagtgcccaagcttgctcttaaaagcatactggattttgttttagacttttagtgaactgaagggaataaacaaatccctctgggagaacttctcctccatccttggtgaagtcattctgccagaattctatctggtagttaccttctccgattcattaaatgttgtcccatggtccgacatgggtaatttttctctcatttgtgattagttccactacaaggaattaaatattcaacttcttgccttctgggatatactcagccttatcacagagctcctccagggaaggaacttagattctttgaagaacttccctgctcttacccaaaccgattcagttgttaattctgtccaccttgctccattttcagtgcaggagaaaaagcatttgtggcaagtctgaccttacaaaggctcgttaatgctcaataactgtgaggacctgctataagtcatgccttttaagaaaaaatacacacatgcacacactcacaacaagactgcaacacaactgtgatggcagcttgcatattgaaccagctgtttccctaaaacatttgattcggcatcctttctagacagtaaatgcaaaagacttaggttggaaaagtgcattaggttttgattaacgattggatgagggccagttaaatttttaaatctgaatgagcttgctgactcaggagccttagcagcataatggacagacagtcctcaaagctttcattaaaagggtttctggtaactgatgtctagagaaatgagttgaaatacaattcactgaaccactcagctttcatctaaaacagaatatgtaatctcaaagaactcaactggtctcttgaaatattcaggtaaaattaaatgtaaagaagctagagcttaaatattttgaggaaaggaagcctcctgtagctttgtgactatatcactttatccttttgaatgccgtatttaattatgttaattgcattttaagtatagctggagtcaccgatctgctgaaaacaaactctagaatggtttgtgggaggtgctcaggatgtatcagagactgatttgatttgcattttatttttaactttagttcctctctgaactctgccttctcatgtttgttttttttgttgttgttgcttaatacagtcatgtgccacctaatgacagggatatgttctgagaaatgcattattaggtgattttgccattgtgcaaacatcacagtgtacttacacaaacctagatggcatagcctactacacacgtctgctatatggtagagcctattgcttccagactacaaacctgtatagcatgttactgtactaactactgtaggcagttgtaacactggtatttgtgtatctaaacctatctaaacatagaaaaggtacaataaaaatacagtattataatcttatgggaccactgctatatatgcagtccatcattgactgaaacattatgtggtgcatgactataataggatcaaactatgcctttgcagaaatccccctggaaagcctctgaaactaccctgatcttagaggcagttttataaatcacggccaatgattctcagcctttgggttgtgccagagatgtgtccgctctccttttgcaatgaccctagaggtaaaggtgctctttcttcttctgcttctcatgaaaaaatgtaaatgttgtattttagcttcttttcccagtctagtaatatcttgttaaatttacaagattgtagcggtgcctccaaaaggggatagcaatagttactttgaaaatgggtgagttctttgcaaccatctctgagttgaacagttcttgtataatctgtcttcccagttaggctgtgagccgcctgaaggcagcaagtgtatctttcactcttctctgatctcctcagccactcttctgccccacaattccaaaaatcagttaccaagccattgtaattccttttctgaaatgtgtagtagactccttttagggtatttgcccagttcacaaagacccctgccctctttggaaatctgtccttgcagccatatatggtttttgtttgtttgtttgtttgagacagagtttcactctgtcgcccaggctggagtgcagtggtgcgatctcggctcactgcaagctccccctcccgggttcacgccattctcctgcctcagcctcccaagtagctgggactacaggcgcctgccaccatacccagttaatttttttgtatttttagtagagacgggctttcaccatgttagccaggatggtctcgatctcctgacctcgtgatctgcccgctttggcctcccaaagtgctgggattacaggcgtgagccactgcacccggcagccatatatgttctatatgactctttctgagacaatagctgattagaacagtgattagaactgtgatttctgagacaatagctgatttctgagacaatagctgattagaacagttgccacgagctggaccaatcatattaatattctctatctctctcttttgctctcgaaatctcaaattgagattcagaaacagctatgtagtctctgtttgtggctagaactgtaacatatgaacccagagctagagagatgcaatattctatcaagcagagagagaagcagaggaagccggtcggcacagacggaatgcagtagcacacagagagaagcagacactcggagatgtctgacacctttctgcttagattccagtcagttcagaggcccagacgcattcctgtctggaagcattctgatcctgttttgtaaatcaacaataaatcccttgccaccctctttgcgtgttagcttaagttgtcttgctcttaaaaatctaaagagttctaaatgatatgaaatgtctgttatacagaaagtagaatgacaattgccaggggctgagaggagagggaaatggaaaattgctcaatggttatagttttagctttgcaagaggaaaaagttgtggatattggtggcacaacaatgcgaatatacttaccactactgagctctatgcttagatacggttaagatggtaaattttatgttatgtatattttatcgctgtttttaaaaaagtttaaaatagcctgttgtagtcagcttccttgtcttccttactactgcagccatattcaggtctccatggcccaaggtatggacaactgtagtcaccaaactggtctccccacttccaccccttggaatttggtccccagcaatctaccctacatgcatggagcaatcaatattacccataaagcactaacgctgtgctgtactccaaaatgcaaaccttcatggtgtcccattgaattcaggatcaagttcatactccccagcttgtcatacaggacccagtgatcctttccaaccttctgacctactgattcccagtaggaagcaaaccctagcaagactggtctgcctcatcccagaacagtacttactcatgctgtttccttgccatgattaccttccttctcctcaccacatcttatctttctttcacttgatcttagtccaaatgccgagaagcaatcttatcttactttcaaagcccaggttcagacccatcaattctataaaacatttctgaccacactagtcctccatggacatttatttgaattgaacttcttagcatttaaatatacacagtttcttattcatctgtcttgttcttctgctagtttataaattgcttgattatagaacatgagcttgataatctttgatttttcctggatactgtgttcttgctaggctgttaataatgcttgttgaatgaaatgagaaatgaagaacggctgctttaccagtttgtctcttctgccaacttttttacatggattttacacgtcaacttttttacacaatgattaaatatacctaatttgatcatcccaacaacactagtaaatatatatgatcattatcctcatactacagatgaggaaacacaggcacacatcgtttgtttgtttttttttttgagacggagtcttgctctgttgcccaggctggagtacagtagcacgatcttggctcactgcaacctctgctcctgggttcaggccattctcctgcctcagcctcccgagtagctgggactacaggcatgtgccacaatgcctggctaatttttgtactttcagtagagatggggtttcactatgttggccaggctgatctcgaactcctgacctgatgatctgcctgcttcggactcccaaagtgctgggattacaagcatgaaccactgtgctgggccaagcacacatagttaaataacttgcaaaaaaaaaaaaatcgtatctatttgtaggaggcagagtcgtgattctgagctgaatctatttggctcctaagcttatgctttttctacagtatcaccacatatcccatactctattgttattgttggctttattgcctgtttttcctgtgaattttaaccttcccaaaagcaggaatcttatctcagtatatcacagagaatcactaagtatctatagaggaaaggaaggagagaaggaaagaagaaaaggaagaaggaaaggagggaagaaaggaagaaggaaaggagggaagaaaggaaggaaggaaggagggaaggcaagagggcaggaagacagaaaagaaggaaggaagaaggaaggaagggagggaggaaggaaagaagggagggagggagggacggataggagggcagaaactctggaaaggagcttgtcttactcctaagcttggtaaagatcagtcttgcaaggggcttgactagaaaacactggcttatctcactgaaccatattcccaatgtcattgactcctttcccctggggagtaattcaaccatgtgttcactgtatggatcagagttgatgatgaatattctcttgcctcagtctcttttggccagagttccttggcttccagcctgctccttgcttgttttgaacgaataatatatgactttccttcttaactggcaaatgctgaactgtggcctctcttaaccctcaagtctcccgataaaaagcaaaatattagattcgctgaccagcgctactccttaccccggctgatttcacatgaagagctatatatggggtggtaacataggtttaaggatggatgtgcatataactcctggataccgttcctgaaaatatactattggggattatttctttggttgaagagtcccttcactaccacatgtcagtccccttacctataaaatgggaaccttagggttgttataaggattaaatgagttaatgtgtataatgtgcttagcacagtacctgccactcaatgctattattgttgttgttgttattattattggtagtagtagtagcagtagttgttgtatgaagatgcatgatttcctgggaaaggtagcacattaaggcaggatcagtcatgagttacctcaagcagattaatttactagccctttcatgctatttcccaaagggatggtttatcaagttgaggaagatgtagatgtgatttatgatggatttgaggttagtactgtgtatccaggttgtgtgtgagaagacaagaaggaactgagggcacagctgtacttaggaagaactctggtttgcaaggtacataagctaattcagacgagtttaaaccataggagattttgttacaaaggcactaggtaactgcagggaccagggagcagggtgtccactctcattccagattcttttgaattctgtatattttattctctttccacaaacagactttctatccacggtggtgatgataaccaataacatttccttcagtctcacccttgtagctctgtgaccaaaaatgcaaagctgctgcttctccagcttcaaaatttaataagaatcacagggcagaacatttattggctaggcctgagttgcatgtctaaccttggagaactcactttgaataggggaattcagaactaggattggtggctccacaaatctcacaaaaatggagcaaagtaggaactcatcaaacagaaatcaatagatctccactggctttatagtacgtggttctgggaatccagatattcagagcctaggtgaacctgaacatttccctttaggcagatggaaatccacgttcttctagctaaaatttttccattctctttgaggggagtttccatggagaggctagctttgtgggagagagtgggaagaaacaactcatgctgtttttcattggggaccattcttattgctactttagtccagtcctgcccacggatcacacattattccttactcttgttgcttctgggctttttctttttcctttgcatgctgcttatattcccttccctaaaagctactctattaagagggagattaggcaagtaggctggtttgattatgtgctggtttaacccataatcacatacctcaaaaagaaaatgtcagacacactataatagctccagatacaaaacatgaagtacgaagacctcttcagaaaactgcaggcttgctactcacccacagacaaatagagctgattctattagaacagtgaggaaagaacacagtaaagaatggcatttaagatcaattgtggcaatgtctaattttgtctgggaagaccatggcagtgagggatgcaaagggatgacatcaagttttcagaacagtgcctatatgtttaggacgaagagttaaataatgagagaaaacaaatgcaatacaatttcattggctacctggttagacctagcatgaactgtgtctgtgatggtgctattaatttgtgatggagacattggatattgtctttccctatttggtaagagcttgattcaggtagagagaaacaataattattttacagtgtacaaagcactttcttatacgatatattattttcatcctcccaactagtttgataggcagtaatattattcccatttcacagagggggaaacctgggttagggcccaggaacttggctggtgagtttggaaagcttgaatagcaatgattataatcttggtgcacagaagcagccagtgaaattctgaaatgcatatttctgttctctacttccagagggtctgattgagttagcttggggaagggcctaagaaatggaatcttttttattcacaccaggtgattttgaagcatggggtctactgagtatgcttatgaaacattaactttaggtcctaggcactggcttagttgactgtgagaaactgaagcacaaaattgtgtgaccaagttctttctgagcctcagtttcctcacctgaaaaatgaatgatgatgataaaaataactaggctccatgccaagtgatttacatatttcccctcaaatcatctttcttacaaacctaggaggtcggaggcattgttgttcctatgctatgggactcaaacccaaatcatttctactcactcttcctttcataattgtcaggaagattagacatagaaagtatctagcacatattcctgatgttgaaggaatagcagcagctgttataactactactaaaactgacaatactgaccatacagccaccactaaaatgctggcgttgaattcagataatctctaaggttcttcccagctccaccataccctgatttcagcatttcaaatatatgctgtatttggggggggggttcctagaaagagtgtggcagtaactgaactcaactatacaaaagaccgaattcttcctttagttggagatttattgatttttgtaagtgagtttatagacaaaaacgaggaagatacagagaaaaaagagaagaattactgtgctttgatagtagggctatgggtgattattttatttttaaaattttattttttatacattaatgtggtttctataacaaacacaaatttagaataaaagtaagatatttctcttgtgcttccaatttaccatatacttcttaaatgtatttgtatcataatcatcagctgtaagtttactattaaaaaaaatcaacaaaagaacaatatcagagctaaaggacttcaggcctgatgaacctaagtctagtttctgtgctcactagccttggcttatcccaaaatattaaaagtaaaatatgatccaatctgcatctcttgcacatgtcatgttttgtaaatagaaagttcttggaacaatctgtaacatcgttgaagtacttcattcaattcttgggcattaaattttatcttctgttcctgcctcatatcattaaacagtaccttcacctacattgcagtcaactatggaggactaatgctctattttttttatgttgaacatgaagcataaacatgtacagctctgaacctgagttttccttgctttagaaataagaggtgttgatgaaagaggaaatccctgagactctgtaaaccttacctgcaggtatgagaatacaatctgtgttttatttattgtattctttagcaaaattatagtaaaattagtatttttcttttcatttgctctcgaattatcctttagttaacagagtgaacttgtatgtccatattttgggtttaaagaacatggttactgtagcaaagaaggggctagcccatgtattaaggtcctggattatactgttgctcacaggagagcatgggtttgaagatgaggctgcatagtaaagtaggtaaaagtttggaccttggggccaaactgcctaagctcaaatcatggtcctgccactactctctgtgcgacctttagcaagttacttaatccttgtagacctctgatttggtctcttcaaaatagggatagcaataatgcctgtcttatagagacattgtgaggattcaatgaattgatatttgtagaagaatattgagttggttttgctagaagatattaagtgcgcagtctttctaaaataactaaatgctacaaaaagcaaaatagccattctgcaaagagcagtgattgaagcaggaaaaatgcctgccctcataaagcttacattataaggagagaaaaataagcaaaacaaactacatggtatatatgtaaaataaaaataaagagggggaagcatggggtggggcagatattgcagttataaatagaatggtcattggaggctttattgaaaaggggacatttgagcaaagtcttcaagggggtatggaagtgagccatgtgagtattttggtgtagggaaggaaaaacatccttctaccctcttaggtttggtggctaacctaagaattaaaacaacatagattaacaagagaaaagcatgcacatttatttaatgtttttatgtatacatgggagtcctcagagaaaaatgaagacccaaagaagactttatgccccaaagcttatatacattttttacacaaagaatgataaactgtggagatgtgacaagacaaaaggccttgggctagaagcagtaaattgtgggagtaagggatatacaggcgaaactagtggaaaatgaggatgattttagtttttttttacaggtccatttcgatgataactccagtcatctctggtgatactattcttctcttcctggcacaaggagggcacctttctcatgggaaattttatgacctgctttttggtagaaaggggaagtctgagagctcttcctgcccctagtgtttctcaagcgccttcagctcaaaataatcattatgccaaagtggcatattttgaggtggcatgttctgagccatttcatggggtaaggatattccaggctgaaggaactgggaatgcaaaggcccttagacaggaacatgcctggtatattcaagagacatctgggaagccaaggtaatgaatgacagcagagcatgagggtgtgggtggcaggagatgaggagatggtacaggaggcacaaatcaggcagcatgttattgatcaccggcagagctccaggtttcattccattctgagtgacatgaacggccatcaaaggtgtttgagtagaggagtgactgtgtttagaatggactgcaggggaataagggtagaagcgggaagaccagttagaaactgttagagatgatagtggcttagacctgagtgacagcagtagaataggtaagagatggattatgagtgtgtctggctgattcactcttatatcccctatgctaaggcatcatgcttggcacatagtagggactcaataaatacttgcagagcgaatgaataaatgggagttcaacttgggtaaggcaacttctctaaggctctgtttcctcatctctaaaatgagggtaagaaaaatattaatagatctacctccaacggttattgtggagattaaatgaggtcattcccatgcattgcttagcatagtaactgaaacataagatagggctaagatgtatacatacacataaatataaagcatttttgcaagagtttacctttggagacatggaggaaggtagacttttattcttcattttatgaactaaaagcaaaagaagaaaacaagtgttgaaattatgagtcattttcaagttctttttgtacttttcactaccatttggaattttcctataatgaatatgcgaggcaaagacagaaatgaaaggataagatcactcagaatttcaggtttttataaagcatcagaaatgtaagacttttttctgctactgcatggcccatttctctgactctttgaatgtgggtattattctcatctttctccctcctcttctctttttggttaaaagtaaagagagcttttgaagctattatggaacaagaacaacagcctagttcatcctcacattttggagcctcttattccttccaaagaacaaacacatctatttagtggctaagagtctcttgagctgaaaccattcatcaccataactacattcaaactgtctgaggtatacattataactaagaaaatggggttcctcattggaatttacaaactaaatattcaaagaagggttctgatgcttttaaaataggggcgccaccaaaaggtaaagtaagacatgtggttgaagacacaggaaagggcagaggtcaccagaaaagttggttgtcacgcctgatcttagggcctcataaagaaataattatggcagaatgagccctaagaagcaagcactttagcatggctctccctggacaaagtggagaggcccttccaccctaacttatcctattgtcctggtcttcagtctttcctgtctgtttgcctttcctggtgttaatatacttgttcctaaggttttcaccctgctgacttttagctcttcttgctaagattcctggctgtacattagaaaactcctgagcaactaaacacaaaaaaatatttggcagggggatagggggtgcttctaggccctaactaagacctgttaaattagagtctctttcgggtggctcctgggcattggggtttttttgtcctttttttttttttttttaaatctaaagcttcccagttgattccaatatgtagccagaattgagaccagaaagctgttaatacccaagtagtatactaatattaataatgatcataatagattaataactaacattgaatgaactttaaatgtgttagctgatttaattctcaatgactctgaggcagttactattattattaatgtaccccttctacagatgaagaattcaagataccaaaaatctacataatttggcaaacaagtaaatgctaaagttggaattcaaacacaggtagtttagtgtccgagcccacactcttcaccaccacactggtggattgcccacctgcaatgttaaaaatcgcagaggatagtgatgatactgcagacacactgcctgcattttatctcctccttgttaggctgagccattcatacctcagtggtccacaccttaaaggcaggatataaaggtaaatatatgtaccttctctgatatgaactagagactccatcccttctttttaagtaatgtaaatgattaaccagctttctgttattcctttcagaatctcattcatagaataaactcctggcataaattagtatcataagttttctattattgctcattaatcagtatgtgatgtaagatcaagcagtaagagttccccccaaccccaaagaatggtctttctgtttgtgacaaattattcttggcaatgtaattagccagttgggttattgaaacagatgggaaatgttacttccaacattttagaactgaaatgattcttagtctggtgataaatgtcaattaaaatagttctcctttcacagaaaaaattaagaaaaaattagttcaagaaaatatcaatcatgattgccagcggaaatttgtttctgcagtaaaacaagcaaaacaaatcaaatccattaaaactagcaacagactgtcttctaaagtcaagttcacatctggagatttttataaactttattggaaaagttctggttatctatatttttagcatagcaaaatattcttcttgtttgttgaatttgatataaaatgttatttttagccaagtcctggggcaactcctacatggctggaaaatgttctcggtgttaacaaagatgcaaagatcttaaatattaatgttatcaatcaactggatactcttaagtattatttgtaattatgtccaatgtcatcaccacagggctgaccaacaagcaaagagctgacagtagtagcaaaatgtagaaatctctggtaagcatgttgtgtttatcaatcctcttcaaatagatgaaattaaattgcatttaaagaatgttacttatattaggcattttttgtgaaagacgttttaaactatggtgtcagaaaacagaaatactaaacagaatgcatttaacaggaccttgaaatcactgaatactcacctgtgtaaaagtcaaagttcagataattgaaatgttcttactagtctcaagatgtcttttggttacatagaaatttccatgctgaattttgatttttttaaaaagccattaatatgagtcaaaatccattatttcacaagtaaatgacctttttattaaaaaaaaaaaagagagagagagaagagcaaggaaccacccacatctaacctcttaaatctgagatcaatatatcaaaattttaatgtacattgaaaacatttgcattttattccacacactaccttttcttcataatttcttattctggacatatagcagttttttttgtcttttaaaacaggaaaaataaacaaacatggtcttattattgttactaagtcacaggtagtaaagatgggaccaggagaaccttggaggactagaaacttctcaagagtagttagatttcacattcagagggaggactcagagtcctgcctgggacatacatttgcattctaggctcaagagcaaatatgtcagctttcctttggtcaaacaatctttgctacaggtcctaggtagttatatcagtggaacctactaaagatgatggaatttgtggtatttcagggtaggaggtaaagtcttagcaggctcaactatacatgatcttaaaactaaatttgaaatgcagatgttctatgagttagttggatattgtagttatcccatctatcaactgatcacatttggtatgagcttgttagttctgattaggactcatctcaacataataagtagggtggcatttagggcccagtgtgggggcctagtgatcactgctgggacactgcttctaaatcaacataactaacctctctaggatggcaggctgaggctgctcaagtacttcctgtctggcatctgggacagggctgagtctctgggtgggaagatgggtgggaggactgaggctgatgagtatatgatataaatgagagccattggaatggctccacatacaggacatgttgataaatcattttaacatattttgctttctctctctggtggcccattgagaatcaaaacttgcagtgagtgactctataaaacggaaaattgaatcaagtctgaaaatgatccacatagttctacagcagggctggacaccgtggtcaggacctcaatatattctgcttccacagaattcagacagttcagagtttggtgaattaacctcaaaggcagcaagatatctgtcccgggagtcagcaggtaagcatagcagaaatggctggagcagcgggagcctgctttccttctgttggctgctagcgtccactccattatagctcctgatggaagatttctacagagtgatgcctcagaatcttccttatacctttcttccatgatccttgcacctctttttctagatttgcccacattcttatgtgcaagtaactagatatacattatcagacaagctagcagacctgcatatatccacttccctacttttcctataatttcttcacctgaacctctatcattcttctctttctgtgttgactctggtgttaaccttgcaggcaagttgagcgtgggtttggtgtcacagtgaaggactaagggaatagttagccttctatttattaacaaatcttccctttgatgtctggatcagtgtctctctaataggaattattggcatgttaaggcaaaagaacatatgcttattgagtgctgactgattggggttaatactaatttgatactattaaggtgtggggcccaggaatgccaaaattctacctcaatgtagagccaccattccccttgaggtaacctaggtgggatagatatacgtgtaagggctaatggaagatagggaatcaaagtatcactttattttttatttttattttttatttaatttttttgagatggagtcttgctctgttgctaggctgtagtgcagtggcgcaatgaaagtatcactttattattatctgagcttgtgccctaaacttcactgcagaatatgctggtaaaatggactggattacaggatttagaggcaaggtccacaggtcaggataagaggtaaagagggaaatctttctctcttcctaagcccaaaccctccatgacaattgagattaaaaaaaaaaaataaactgatgagagaatccaagcacagttgatcaaagaggaaagagaaatgatgatgtttccctctttctttttcatgagaaagtggctctcttattgatcggctacttgattagagaaacagtgggggaaagaactgccatatccacatgtgcaattttttaaaacacacagtgattctggacactagtataaattcccagtcagtgttctggccatctgactactcaggttataatacctaatttttacaagggagttgggaagtgtgccaaacctgtagaagtctatatctactgtattcagattttatatgcattattttatataaccttttgacctctctcctctatcatcacttgagtgatttcatccagcgtcatcatttaacatattttaaataactctatatactgataattcccaaatttatatctccatccccgattgttctcctaacctccagcctctaatatccaactgcctactcaagcctcagcaatggtgagcgcccctgccccagcctcgctgctgccttgcagctcgatctcagactgctgtgctggcaatgagcgaggctccgtgggcgtgggaccctccgagccaggcgcaggatataatctcctggtgtgctgtttgctaagaccgttggaaaagcacagtattagggtgggagtgacccaattttccaggtgtcgtctgtcacagctttgcttggctacgaaagggaattcgctgaccccttgcacttcctgggtgaggcaatgcctcgccctgcttcggctcatgctcagtgcgctgcacccactgtcctgcacccagtgtccgacgagccccagtgggatgaacccggtacctcagttggaaatacagaaatcacccgtcttctgtgtccctcatgctgggagctgtagactggagctgttcctatttggccatcttggaactgccttgcattcagtttttaatatccaactgcctatacgatatcttcacttggattttgaataggcatatcaaacttgtcatgttcaaaagtgaggttctaatcttccctcccaaacctgcttctcccatggctttccccatctcagtaaataggaatttcatccttccaattgctcatgccaaaaatttgggagttatccttgactcttctctttctcacaccccacattcaatccatcaccacattctgatgcctctatcttcaagatatacttagactttcaccacttttcttcactctgcaattaccactttggtccaagccactgttatctctttcttggattattgtaatagcttcctaataatttgtcccctttcttccacctttgtttcccctacagtataatcttaacgaagcagccagaatggttgcctacaaacctttaaaatggtaagccagaacatgtaggtatattcaaaaccttccaatggcttgtcatggaactaaaagtctctacattggcctataagaccctatgtcatctacccctagtctcctcctttctaacttcatctcctgctatgctgtccttcaactcactctgctccaggtgctctggcctcctcaaacacaccacacacacttgcagctcacagtcttggcacttgctgttcttctcctctaggaccttcttcctccaactgtctggttcacccaccccttccttctggatttctgctctgatgtcattttatcagtgggcacttcccaatttctctatttaagaccacaattccaggccagggtggtggttcatgcctgtaatctcagcactttgggaggccaaggcaggaggatcacctgaggtcgggagttcaaaaccagcctgaccaacttggagaaaccccatctctactaaaaatacaaaattagccgggtgtggtgacacacacctgtaatcccagctacccaggaggctgaggcaggagaatcgcttgaaccagggaggtggaggttgtggtgagccaagattgcaccattgcactccagcctgggcaacaagagtgaaactccatcttaaaaacagaaaaaaaaaaaaaattagctgggcatggtggcatgtgcctatatacccagctacttgggaggctgagatgggaggattgcatgagcccaggaggttgaggctgcagtgagccatgatcataccactgaactccagcctaggttacagagtgagaccctgtttcaaaaaaattttttaattaattaaaataattttttttaaaaaaacagagactgaaactagaactcaatagccattttgaatccaaggcagctctagaatgctcagcaccaagagttcatgaatctctactgcttagccagcaatatgactcaaaaactctccagtgtttgcttctctatgtctaatcaccagtagacagaaatctcttcatcttctactctatgtctccacgtcataagttgctactaatccagaagttcttcttactcataatttttaccttcttgtaactgttactcaggtctttttttgcccctccctatctaatgatctctctttttctgcataaatttttagccttagctcttgattttagttacttctttctgtgtgtgtgtgtgtgtgtgtgtgtgtgtgtgtgtgtgtgagagagagagagagagagacagagtctcgctctgtctcctaggctggagtgcagtggcacgatcggctcactgcaacctccacctcccaggttcaagcgattctcccaagtagcctctaaagtagctaggactacaggcaggcacatgccaccacacgtggctaatttttgtatttttagtagagacagggtttcaccatgttggtcgggctggtctcaaattcctgacctcaagtgatctgcctgccttggcctcccaaagtgttgggattacaggcatgagccactacacctggccctttctgtatttcttaattcaaattccccaaagtgagaatttggttgtcccagtgcatcccagtgtttgattggcactttcatgccaatcaacttgtaaaactgccagtgagcctagggactggctgcccgcaggttggtgcttgcctctgttctaatcagcagctgaggagagcagaatcatgtatacaaaacacagctgcagggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctagttgggaggctgaggcaggagaatggagtgaacccgggaggcggagcttgcagtgagccgagatcccgccactgcactccagcctgggcgacagtgcgagactccgtctcaaaaaaaaaaaaaaaaacaaaaaaaaaacagctgcataagtgggctttatcagtggaggacatgtgccggacagttttcttcagaaagtgttaagggcctgtctcccaccataattatctagtgcagatggtaaaggagttagaaatctagaagcatctaggtattttacttaaccagatagatgaacacaccaaaggcagaaatttaactcgagagtctatgattctaatgcatctcagaaggaaataacttaaataatatcttcacaggtactgacttagttataacccttcaggaaaagcatgtagacaccattatggacagttcaaagaatacatctttttaaagagcagtgataattaagtaaataagaaactattctggctaaaaagggttatagaaaacaatatgatacatttatattcatttttacagggtatataatcatcctaattttgaatggcctgttccattttatcttcttcatcttaaaaatgactgagctagacaagaagtagtgtaaaggaggtcataaaaattacagtggcaagatagatcccaaaggtgaatgactaggacttttaagttgggagaaaaacagtagaaatctgataagggctataaaataataaatgttaaagagaaggatgattggatgcttatttacattttctaataataaaggaataaaaatacacttgataaaatgaaaaggcagaaaaatttaaaactcatgagtcttttttcaaacttaattaactttagaacttcaatcataggataattgctacagatagtttaggatgattcagaaagattaagcattcatgggaatgaggatagcgtttccagcaccagaattaaaacaaaaataatgagcattagaaagtcctgagacttcagggcatacactgagcataagccagaggaaatgttcccagctggtataatattgtcgacctgccaggattgctggtgatctacaagcctctgagcatgaactgggggttagcactggcttctctggtggtttcctttgagtcattgcatcctcaaaggccatattaccaacacagtattgctgctttgctgtttattcatacatatttttggtgtctggctagctcagaatgcccatattttttctccttttaatgaggctaatttttttctaattttgagtgatcattttcagttttaccctttccaatctttctctaataagtatttcattttgactagtctgcatgtttaaaagaagatcggttgatccaagaatctgtcagtaatgatgttattatttatgcagaggagagttgggataatcttagagactgacatttccttaagcaccctcctagccattaaaaatagcagaactgttgctgatgatatctgccagacttgagtttgggaagagtgtttcccagtgaagacctaacctttcattttaattctccccttagattcattcgctgtgtagtcagagatgccaaaattccactgctagttttgacctccacttaggggatgtaagcagctacctaccataactgacttgagatgtatgtcaaatctttcatccaggagccactctgtctcaaatctcaccgttagtatttaactcctttgtgttcattccctcttttggtattcttgtaaaaataagcattccctccatggatgagatattatgctaagatcactagaggatgttagtgattctcagatagtgtttcctctaagaggccaggtaacaaagaatgtccacactgtgtgcgctgggttggggggagttgttggtggcagtagaagtgatatatctttatatttttcttatattcgttatgaaaactactctcaagaataggtacaaagtcattcatggtaagatgttaataactggtacaaacaaaatgtgttagcctttcaaagcctttcgcaatggaacaagtgcccctaaacctttagcctaaaggacagaatccttagctggagttccaagtttatagcaagagtgtgggggcagtgtattttgttctctggggtcttccgatggtcacttcagtcaccctacacaggtggtcagttaccttgcctaggcataaagcaatgggctgtgaagttgctgctcccccaccactccctgccccagtgacaggcgatggggctgtagctgcagaggaattattgagcttgctctgtggttcaccagtgttacatggccccactgggtccttgtgcagagaaaggaatcgaagctgacacagttcaataaggtttcactgtttttaaaataattttgacatcttatcttatttggactttggattcttccaacaatgttcagggatgctcaatattttttgctcttttatgaataaagaaacagggtgaatgaggcatgccctgtttggttgttgagactgggtctgctggctctttgtccagttctcttggcactacctcctgctacctccatcaaggattgtgtccagtaataaagaacatggccataaaacatgtcctaaaatatctgctaccaagtggttcagataacttaataaataaaattgtcacacatgcttcctaattgtagatatagcattttctgtttaccctggaacaaattttcctaggaaagtatgcttccatttcctgtgcggagagacttttagactacgttccaatttaaaaatgtagaacttggggctctggcttaaaatcagcaaggttcatgttgactttttttcatttaattttaaatttcacatcagcttttgcagaggggtacaagtgagggacttaaaatgagaagaatcataagcctggttttaatttacttgtgtacattttcagaattactgtgcctgaagtcttccaagactgatggttttaataagtggaatgtcgtgttatcgggatttgtggggcctggctatcatttgtcagatatttttctttttttatgtgtgtgctgttttgtggttcctttttgtctctgagctcttcaagaaaaccttgttgcatcctgatagctttgtctctcctttgagagggtccataattctctttcatgctcctttccttgtaaacataaacgtattttcctgtgtcagaaccccaagcagctttctaaaagccagtatgttattgttcttatgaattgtttattttgcttggaagcttttgttttttaagtacttcctgtgactgactttttctttaaacagagagcacatgaaacaatcctcaatttaaggattatagaaatttttacctggtttatctacatgtgaatgatgccttattgtagcagttgttggatgttctcacaaccaaaacgatcctttctgtttctcaaaatcaaaagtgcttctctttatgttcaatgacacttaaaattggtttatttagatttaagatgatacaacacaatgcagcgattcctaataagagttaccttgagaaattagaattatctcttagggaaaatttatgacatctgaaaataaaatagtatgacattttcttttttgctacttgattcaaattgaacttctgttcattttaattcacagaactgtattcttaaaaagagtcccagcaactccccgccccctggccttttatgaagaaaagtgccagcaaatgatttcctgtatggaatggaggaaaggtccctgacccttttatcttcctcatgtcctcatccctttcaacattatcccaaggaggagaaaacggggaagcctattagttgttttgcaatagcttcaggagttccaaattcaggcacttcttgacacattttgtccatcactaggccatgccctttcttcatttgtttcctttcctttttctcactctctctcctggtttggtgaatccaattttcacatcttcattttcaagaggaatattctgttgctgactctgcttgtctaattgctatttttctttttaaagcatgcctattttctttccagctcttctctccatatttaggcaggaactgtaatcagctagttaatatagcaatatagcagattatattattgataatctgctgtgttacagactgggctgggctttcaatttatgcctttaaccattctggtgaactttcatttggttctgagtttttggttcaaggtttgtgctttggctgtttatttttttttggtttactccactgtttacttatatgatcttggccaagtcacttaactttattgaaccttggaaaataaggaactttggctacatccatctttaaaattatctcctcttcttctaggtttgcctgtttttgtatgtgtatgtgtgtgtgtgtgtttgtgtgtgtgtgtgtgcgtgtgtgtgtgtatgtatgtgtattgacccaaatccctttcagtaaacctttcctttacatgggaatataatctcttcctaataataatttttggtgaacattaaatatcaaagttcgtttaatgctttatatcatttactaggtgctttcatatgttctatttgtaccctcatctcagtcctaaaatgaacattgatagatatttgactactctaattttatatgttgggaaactagggcacagacattaatggatcactcaagggtaaccagcatatagacagcagaattaggaatcaaacccaggtttttatgagtctttggtgccatgactctctattttattatgaatgcacatatttatttgttatttttatctgtcttagaatttttaattttcaatcgatcaaagagtactaaaagccttataataaaatgtacatctcctgcccttctttcctatgccccagagtaagaagctttcaaatcttttcttcaatgtagtgtgattatactgctatttctggatgtattaatttggacatataatgacttcttgctaaaaaattaggatttaacattactgtttccctgcttctatcttttaaaaataggtaattctaatttttggttaaattgatggtcaatgtttaccttactataactatgtaagcaagtattgatcacatcttgtacattttttttctagtcaacaattgccttattttattcattttctcaaattcttatgtgtttattctatttcttccctcaatactccaagatgtgtcacatcttgttaatcttctttccaaaagtccaaacatttccaaatactcatgtattagtcagttctcacactactataaagaaatatctgagactggataaattatgaagaaaaaggtttaattggcttacggttctgtaggctgtacaggaagcatattggcttctgcttctggggaggcctcaggaaacttacagtcatggcagaatgggaagcaggcatgtcttacatggctggagcaagaggaagagaggaagcagggaggtgccacacacttttaaacaaccagatctcatgataactcactcactcactatcacgagaatagcactgaggggatggtactaaccccttttatgatacctccacccccatgatccaataacctcccaccaggccccacctccaacactggggattgtaattcaacatgagatttgctggggacaaagatccaaatcatatcaactcatatccatgatcttcatggatacctctctccctagccctctgttccaggttagattgattattctgttggcctggggcacagctgtatgtcatcctgagatgtccctgcacaattctcttctgttttgtctcttcctttattatattttctagtagtagcctaaaaaagggcacactgggagataaattttataaatgcttgtgtgtcattatcctcatatcttactgttaaatgtctttatcctcatactttactgatagcttggctgggtatagaattctaggttgaaaataattttcccttatatatctactttttcccttacatctcaggtttgttgttgagaattttaatgctattcttcctctaatccattgcatttgtctttcccccttcaatttgtgagtcttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggtgtgagtctttttattcagtgttttatgttgcagtgggtctttcatctgggggttcagtttagttctgggaaatttcctcatgttaatactaggatgaactgatataaacaaattttgtctgctcctatatatgttgtgtattaatgtactctcatattaatacatgcattcatagtataaatgcttaatttaaaatactatctattcatgaattctctaattttcttagtttttccttcatgataaaggagaaactttctttaccttttcattataatttctaggaaatttcctacactttattttcccaaattttattgcattttaagtttggttactgcttatttatttacttatttatttatatttttgttttctgattgtccccttattattattatttttaaagaatatccacttttgttttatggtgcacaatctttgcgtatcatttgactttgtttcctttaatttcattttctttgttttgtttctatcttttatgtctagtgaacatttactgtccttatttaggagaaaattatggaaaaaaggattaggcaaagcttattaactatcaggcttcactgtatagtgatccagaagctggattttcatttggttggaagatgccaaatgacagtatcttttgtcttggaaccattcaacgtctgcagataaatatccttcagttttctgtctgggggttattcatttgattattgatgttctgggaaccggaggaaaagatggcagggaaattttatcattcattatgtagattttcacttagtctctcaagttccagctgtatacttcactccctccttctaccttgcctggtgttccaagtctggagcctctgattcaatttctcaagagattaaacctctgtcagggctgggtttggggtagtgtttagcttcttgggatgagagggagagtatgggtccttattctgctctcaaccattccccttatttttatcctagagccccacctctgccttcctggtaactcttgcatctgagtcctgaggctttctggggatctttgggagaaacagatttgtttcttgttgttacttatctctgatggtgtgtatgttttagttattacgtctcaattcacttttctccttcattgacacttccaaatgccttgtcacctctcatctgcaagttggctgttttctcattttctttatcattgtgagtttatacctgaaaaaaattaaaagaaaaaacaaaaaacaaaaacctttcctatcatgttggcagagtttccagagggagcagaggtaaatgcacatacttgatctactttgtttatcaggaagccctagcccatatttttattgaattagatttcactaaagacaagtttctgcaattggctattagcaatcaactttttttggtgacaagactgaatatttaggattaaaagtttaaggatgttcattttatttcccagctaaaaaagaatgtagtagcccagcatagtgaatttataatctttggatttatttccttggatttacttataacaatatgtttgaaatgtgttaagtagaaaaattggcagaagtgtatgtgtgtgtttgcaactgtgacagcaagggaaaccgatggaagaaaagaatgaatccaagagaaagcagaatgttagattttgattgggacggtggtggtgtttcagatccatagccatataaacattttaaatatcatcaataattttttaataagtacctaaatttgatggttgtttttttaaactgtctaacgttacagaccattcatcatctatttgtgtcttaagaatactgccccagtttcgctgtgggtccctttgagtgaatgcatttctagcttttgaggccacgctatctgtagttctcattatcttggttgctttcagaagcctcatataagccaaagggtgaacaataaccagagaacagagattcttaaattaagcaactgaaaagagtctgctttggttcattagcccaaataggatcttttactttttgagtagcaatcaaaagatattggatctatcatttctcttgttctcttaaaaaatcacttaaatttcctttaaacaatctggtgatgtgatgtcagatttttgcccatcatattataacatcattgttaagtagtatgaatggaaatgaaacatacacctcaaaatatctaacggtcctgatataaggctaaagaaaacaaatagtcttttcttatctttccccttggatgaatttaaaatagataattcttaacagtttcatcctacttccgtagggtgaattttcccccagtatggctttggagtaaattttcacctttttgctagatttatgactgctattaccaatactattaattatttcagtatgatatagcacttctaggaggctgaccctacttaattggaaaaaaagaaaatatgttggagctttaacatttcttgatcatagaaggtactgaaacataactcatgattctaggcaaactttgccattgagtttttgtgtgaccatataaaataatttaagttttctgtgtctacatttgtaaagtatatgacactcaactgtataatgagctcacagtctagtgagcttgatagaagataagctaatctggggtagaaatcatgctttattcatatttgttttctcttgcttaaattcataatagttactcagtaagtgttgactaaaagtgtttgagagagaaacaaaatacaaggtgagtgaaaattctgagatccttgtgagaataattcatataaatttaatatattcagcttgattctaaaggcaatgttgagaggaggcccgtggggctgcatgttcttcagtgtaatgtgaagtactgagctgattatagtggttattcaattaaaagatatgtattttaaaattattattatactttaagttctgggatacatgtgcagaacgtgcaggtttattacataggtatacacgtgccacggtggtttgctgcacccatcatcccgtcatctacattaggtatttctcctaatgctatctctcccctagccccccaccccacaacaggccctggtgtgtgatgttcccctccctctgtccatgtgttctcattgttcaactcccacttatgagtatatttttaatgggcaagctctgctcaaatacaggctacagtcagtatgtgactgagctgtgatctctctcgtcaaagggactacagcgcaccctttgaattaccttcacactcactgacggttttaagagtttggccactttccccacgtctgaaagcgactctaccttagatgtgagaaagatgcggctgactttggctggcagatggagaagaatggaaaagcagcagacagtgttcatgcatggctgacactagaaagaattcttctggatttcacagtcattgaaatgaaaagatgtgatccagaacaggatcttccttttaactggtgtctgcagtgttctctcctctgcttcttcactcatttcaagaagtctctaaggggcagcctgatgtggaaaagatgttaagggaagaagagggcatcctaattctaggtttgataaggacatttttgatactggtaaaaccctgaaattatggaaattatgatttgttctgtatgccaacgagaatcgtggttttccttttgctcttttccttgcgaaggagccaactccttctggatctttgtttttattttttcctccttaagtcactgctgaggtatttttaaaccaagccaacacgtatattttattcaccgaaggaagaacaaagcatctgctaatagaagcagtgaaaaaagcacagcagtcagaggcctcgtgtctaaagctcagttcattactcctaacctgccattggccaatatttcaacctttctgagttgctctttctcatctgcaaaatggggttaatggaggatttcatctgcaagtggggataagagacatgaaaagaactgacgcgaaataaacacgagttgaatcctaacaataatattttgactatgtagttacaacaaacttttctttcttctttttttttttttctgtgagaagtgcctttggtggattttgaattctttttcatactgcctgttctttggtgggactccagcaacattgctgtaactcgaggatatatggctgcaatgtgtgtttggcttcctttctcaagggggtcaaataaaaaggcaactgtttagagaaggcaccaaagtacaaaacaaaaatctcagaatatgccagccaatcttggaaagtcatctgaagaagaaaaagtgctgctgaggaaggaaaacggcccttttgtgggcatcacttctgctcttctgaaaaaaagccccgatgctgcaatatttttcaaggcagaatatcgtcccagatggaggagggagcactgacaagcagaaaaggagagacgtgcggtttcgaggcagcgtctgtaaggggtggagagcgcggggctcggagcctcgcagttctttgttgggggcgcgggcttcgttattcccgaggcagcaatggctccccctcggaggtccctccgcggagaccgcctcgcgcctctcgcagtccccaatccccgcccctcccagccctcgctgaccccacaacgtggtcggactgcggtgcctttaaggcttttgcctgctgcacatgctcagctctttgtgtgttgttggagtttttctctcttaagagaaaaagaagaaataggcaggaggatggggcggaggaagggggaagcgctagggaaaaagcgttgcacttttgcagctgcagacggcggacgggaaggacttcttttctgctgaagctgcgaagcctgtgtcgatctctcattcgtggggctcccggggcgcggggtgcgggtggggccggggtgcccgcaccggccggggggaagggcacgcgggccacacctggggggcctgtctccagtcagcgcgcgggccaggcggggtgggcgcgcgcgcgtgggggagtccccggtccctgtcaggggcggggcgagaccaaggcgccgggcctgtggggaggagtgtaggcgcgcgcgagggcggggggcggccccacgcatcgtgggctcccggcgctgccgctgcggccggctcgaggcaccggagacagaatggctgccggggcgcccttgaccgccgggcgggcgaggcggggctgaccgccgcctccttgatcgcccccttccacgttgggcgcgcccacttcggggcgcccgctcggcccccgccctcctgggcgcgcggcgctcggagccgaggcagttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagtaagtgccttcgccggaccccgaacctccagccctgcctcgctcccgtcgcggccttccccgcccccctcgcggcctcccccgcccccgtcgctgcctctgatcccccggccgtgagtgaacctcagcgcgcggcgggagcgggcgagagtggggcccgcgccgcgccccctccagccccggggcgccccgggagagctcgggcccgcgcggagccctgaccaacggggagctaggcatttctcgagcgttccagatgtccgcagcgacttctgatccgctgctcagcacgaacattttcacaatcagttatgatgcccagcaccattttcttgggataatatttaaaaatcagaaattgtccaagttacttatgaaatacatgcgcattgtgaaaaattcacaaaagtgtaaaggttcagttatgatctatgagtgcctctctctttccccatcctcttctctctagaggtgaccccttctaacatttatttagtcatcatagtgatgttaataagtagagtttatgatggacttgctaagtgccaaacactcttctaagcgctttatgtcaattttctcatttattccctacaacaactctgtgagttgctagaattattatgctggatttacggagagaaatcgaggcgatacattgaagtaacttggccaggattacacagtagtaagggccgagttatgattccaaatcagctggcacattctggagccagtacacactccagaatgtgtacttttaacgaatttgctgtgttgtatttgctaggacaatcttgaattgagaaatacaaaggtgactttaggttagatagaaggacgtttttatgtggtgaggataatggatttttttctgatcggttaattcactgtcagcttttgtgcgggaacatcgctttggcttgtttgaagctcaaggagcctaagaagtttgcttgctaaggtgaaggtactttcttcgtactggttggtgtttattacattcttgcctgatataaaaagcaatgggtcacagtgtaggggagtagcaaaagtcacttaatattggggcaggcttctaacaacatgcaggtaacagtcattaagaaagtcagcttcttagtcttctagatacttaatatgaagtttgctggctggtttgtggctcttgaatattgtagattactgatattgttaggctgatagccaaaatctaggtgaaatttctcttgggctctaaggcaaaggtaagactggttcaccttattaatgtattctaggacaatttcctggaattttaaacacagcatactttcctttttttttttttaaaaaaaaacttactattactgattaaaataaatgtcccttaaaactcaatgtaaaaatgtatatttttaaaatggcactttaaaattttaggtagagtctatgatttaaattaactagtaggttttggaagtgaaatcttaaagtgaagttttatgaaacttatgcaataggttgaaatttttctagggtttatactttaaaggtagtatagtaatgtagttttaaaaatactttttaaaaaaattaggagagatgctgattaaaagtttaaaaagtgtttcaagatgaggaaagagatcttaatgaattctgcttgttagttgtttttttttgcttgtgttcttaaacgtttgctatgacagtagaattcagcgtctttacctagcaagagagaattttgaacatgtaaactggtagtcagcagtgaaaaagcctcatccattttttacattttttttacataaatagggagagtgcctgatttatatgtagggatattggcttttgtgtgggtgggtttgctccgtttgtctaaagaggacaaaatttgctgcagtcctgagaagcttcattttaaagtagcggaacttgttaatcagctggatcagcagcctgtgacctcactagcagatgttgtcccagttaaaaagatcacagatcaagttaaaactagcttaaataacattgagaggtggtgttcataaacaaaatacattagtgagtagaagaagaatagatatttgatgtagatattgttaaataacaataaatcctgagctaatcactgagtattcatcttttccttggaagctattatttcctaggactcattgtactctattgggtaaatgcttttgcatttctctgtggaatacaagctattaattagagtaaatataactggtgtaacgatctgtgtttttattatgtatactcttggggataaagaacacattggtatttaatgttaaagagaaggattatgtatagtagaaaagaattcttcttggtaaagtacatgcaaataaacctatgaaaggtttatttgaagatagtagcttgttttacctggcatttgaagtaataacacagtgggaaaggctttaactagaaaatctcacttcactaactatcttgaaaatctttttctaaactgaaggatagcaaccttacaaacagacattaaaaatgattgatcaatcttggtaagcaggtgtcaaaattaattggttggctccatggtaacttagctttttttctactatagggatttcgccagggaataaaaatgttcttcaaatgtttcttgaggatagaagattgatagttgggggaagaaatgcagaagcaaatatagtatcaaaagtggtacttcagttctcttagcattgattccagtcttctgttttcatttgaaaagaataaagcactcagaataacaagccattccttccttacacaggtaaaacaaaaggaacattgatttttcacccaaagctagactaaaggacttgggattgagaataggaaaatatatttgaaatataataatcaaagatacagactctaattcaagttgtatttatttgaatagttcagtgtaatgttaagcaagaaaatattctgctataatctatttgaatgacgttctcttttagaagggagcccttgagaattaattttgtagagtagagatttatataaatttatataaatataaagagtattgctctttatattagtcaaatataaaggggtatatttttacccctcttaggttagtcaaatttggatacttcatttcacgcatttaaaatggaagtatgctgggtgccgtggctcaggcctgtaatcccagcactttgggaggccgaggtggaaggatcccttgagcccagaagtttgagaccagtctgggcaagatagtgagacctcatctctacaaaaaatattttaaaagtagctgggcatggtggcacacacctgtggtcacagctacaagagagagtgaggcggaagaattccttgagctcaggaggttgaggctgcagtgagctgtaatcacgccactgcgctccagcttgggtatcagagcgagactcttcttaaaaatttatatatacatatatgaagcattctatttgtagtgacagcaaaatgaagatgtaatgatataatgtcaggaattaggttgttattatagacaaaaacgggcagaataaagtgtgtaaactcttcccctaagctgttaaaaatatatgcatattgcctggcttggtgtctcacgcctgtaatcccaactctttgggagaccgaggcgggcggatcatgaggtcaggagatcgagaccatcctagctaacacagtgaaaccccgtctctactaaaaatacaaaaattagctgggtgtgatggcacgcacctgtagtcccagttactcaggaggctgaggcaggagaatcacttgaacccaggaggcggaggttgcagtgagcataggtcgcgcaactgcactccagcctgggcaacagagcgagactccgtctcaaaacaaaacaaaaataaacaacaacaacaaaaaacaaatatatatatatgcatatgtaaatacatatatatttggaatcctttttacttgtaaggaaactgacagtaattataaacttaaactgaatgttccctgtccctaagacttctttatttcaaagttttattttaatggataatttatatccatggattatttttacattattaaagtgtataatcacacagtaggaatttaaaataatttaaattgagtgtttcttagattctaaattgataaggtaagttacttgtagaagcatagtagcatggttttcaagaacacgtgtctgcatgatttggcccctttagctgattagactcaggcctcctttcctctgccctgactggccttttgaagttccttgaaagtgtcacattccttttggccttagtgcattttatacacgtaactgtgaactctttcctctctggtctttgcttgggtgattactgatcatccttctaatcttagcttaaatactagtttcttttttttttttttttttttttttttttgagaccgagtctggctctgtcacccaggctggagtgcagtggcgcaatctcggctcactgcaagctccgcttcctgggttcacgccattctcctgcctcagcctcccgagtagctgggactacaggcgcccgccactacgcccggctaattttttgtttagtagagacggggtatcaccgtgttagccaggatggtctcgatctcctgacctcgtgatccacccgcctcggcctcctaaagtgctgggattacaggcgtgagccactgcgcctggccacttaaatactagtttctaaaggaggcttgtctgactcttcacactaggttaccccttatatactgccctaatagcactatttttccttcttagtattgtcaaaaatgaggtgtttaattataattttgatagttatttaaacaaaatttttaagagattgaggtataattgtcaaacagcacaatttaaaatgtacaatttatttaaattatacaatttgataagttttgtcatatgtatttgcatctgaaactgtcaccacaatcaaaatcatgaaaataccaatcacgctagaaagtttccatgtgtttcctttgtaaaccctcccttttctagttgccaattcctgtcccagggcaactattgatctgctttctctcactatagatttgttggtattttctagaactttttgtaaatagaatcatacattatatacttcttttttgtctggcttctttcacacagcgtgtttattttgagattcattcatggtgtgttagtagtttattctactgccgaatagtgttccagtgtctggatacaccataatttgtttatccattcaactgctgatggacatttggattgtttcaaatttttggctgttccttataaagctgctacgaagtttcatgtggaaggctttttatctttgtatggtcatatgctttcctttctcttggggaaataacctgagaatggctggatcatatgggtagatatatgtgtaactgttaaagaaaccgacaaactgttttccaaagtagttgtatcatttatgttcccaccagcagtgagtcagtgttctatctagttaatttcacatccataccaatacttggtatggttagtcttttaaatttttgtgattctaataagtgaatggtatattattgggttttagtttgcatttcccgaattactaatgatattgagtatcttctcatgtgcttacttgccatccgtatatcttctgtaataggcatttattcaaaccttttgcatgttaaaaaaattttcttactgatttttgtgagttctttacattttctggattactagcttcttatgaggtatatcatttgcatatattttctaccagtctgcggcttgtctatgaaaacaatgcaaagagaatgaaatctcttgacagtatttttcaaagaatctaagttttaaattgattaattccagtttatcatttttttcttttatacttttcatgttgtgcctaagaaaagtttgcctaggctgggtactgtggctcatgtgtgtaatcccagcgctttgggagcctgagacaggaggatcacttgagtctaggaatttgagtgcagcctgggaaacaaggcaagacactgcctatacaaaaacatttgaaaaattagctggtcgtggcggtgtgcgcatttagcccatctacttggaaggctgagatgggaggatcactttaacacaggaattggaggctgcagtgagctgagctgtgattgtgtcactgtactccatcctgggcaacacagcaagaccatgtctttaaaaaataaaaaataaaaaaaaaaagaaaactgcctaaaccaagttgatgaagattttcttcattttttttctctagaagttttgtaattttagattttacatttatatttatggtccattttaagttaatttctatatatggggagaggtatggatctaaattcagttttttggcatataggtatttgttttagcactatttgttgagaagagtattctttctctgttaaagtagctttgcacctttgttgaaaccattcatatatttgtgtttctatttctggactctgctttgtttcttgatctctttgtctatttgtatgtcagtacaacaatgtcttgattattgtttctttgtaagtcttgaattctgggagtgtttttcagttttgttcttttccaattattttggctactctgagtcctttgtatttccatatgaattttagaatcagcttgtcagtttctataaaaagcctactaggattttgtttgtaattatgttgagtctatagatcaattttggggaaaatgaataccttgtcagttttgagtttcctacatggtatatctgtttatttatttagttgtttaatctgtcagcagtgtttttaaatttctagtcaatagatcttgcacctcttttgtcagatttttccctaagtagttaatatttttggatgctattgtaaatggcattttttaaactttcacttttgattgttgctattatactgaaacacaactgatttgtgtatgtttgattttttatcttgcaatcttgccaaacttacttattacttgtggtagatttttgcagattccttatggctttctacttagatgattatattgtttacagacaaagatatatttacttctttctttacaatctagatgcctttttttttcttgccttatttcactggccagaacctctattacagtaatgaatagaggtgatgagagtggtcaatcttacttaagatttagggggagatatttgatctttaaccatgaagtatgatgttatctgtaagttttttttttagatgccttttatcacactgagaaagttcccttctattcctagtttgccaagagtttttaccagtgatggaaactggattgtattaaatgcattttctgtgcccattgagataatcatatgattttttcaagtttgttaacatggtgaattatgtacataatttttgaatgttaaaccaaccttacattcctaagataaacttcctctgacacaatatgctttcctttttattttaggttggatttggtttgttaaagttttatttagaatttttgtatctgtgttcatgagagatattagtctgcacttttcttataatatatgactagttttggtgacaagataatgctggcctcatataatgagcaccatgggactctcctgatcatttgctgaaagagtttttagggaattggcattatttcttcattagtgtttggtggaattcaccatcgacaccctctaggcctgaagttttctttaactccaaattcaacttttattaatatacattcaacttatttaatatacagaaggctatatgactagaatcctttaaaatttattggccagaatattgtctatcttggttaagtatttttttgggcgtgtgaaaataatgtgtattcttctattgatgggtggagtgttgtatacatttcagttaggtcaacttggttgatagtcttgttcaagtcttctacaaccattctgattttctgtctgtttttaccacttattgagagaagggtatcttcagttataattttgtatttacctgtttgtccctgcagtcttatctgtttatccttcatgtattttgaaactatgttattaggtgcataaaattttggattatgtcctcctgataaactgagcctttatcgttatccaatgaccatttgttgaaaagactatccttttttcattaatgtctttgtacctttattgaaagttaattggacgtctttatgtatatttattttttgactcttttctgttccattgatccatatctctatccttttgcaaattcctcactttattaatgtatgtatgtactttattaatgtatgtatatgtgtatatatatatatacatacatatatttgagatggagtctcactctgttgcccaggctggagtgcagtggcatggtatcagctcactgaaatctctgctcgtcaggttcaagcggttctcctgcctcagcctcttgagcagctgggattacaagcatgtgccacctcacctggctaatttttgtatttttggtagagatgaggttttgccatgttggccaggctggtggtctctaactcctgacctcaggtgatccacccacctcggcctcccaaaatgctaggattagtatatttttacagtaaatcttgaagttagataatgagattcccccaactttatttttatttttgaaaatttacttggttcattttgtttttcatatacattttagaactgtttgtcaattaaaaaagtcttgctgggatttttattgagattgtgttgacttagtaaatcattttgaggagaattgatatgtaaataatattgaattatctcgttcttcattgcagtatgtttttttcatctatttgggttttcattgattttttacaacagttttttgtagttatcagatacagattctgtgtatatatttttagtgttttttttttttttttgagatggagtcatgctctgtcactcaggctggagtgcaatggcatgatctcggctcaatgcaacccctgcttcctgggttcacgcgattctcgtgcctcagcctcctgagtagctgggattacgggcgcccatcatcacgcctggctgattttttgtattttttgtagagatggggtttcgccatgttggctaggctggtctcgaacttctgacctcaggcaatccgcctgcctcagcctcccaaagtgctgggattacagatgtgagccactgcgcctggtcatattttttgattttataccaaaatattttatgttctttaaggctattgtagttggtagtatttcttttaatttcaatttccagtttgtagactttaaaaaaataatcagggaaatctttctttggtgatatttcctcgcccatatctctttattttttatttttgtggttacgttataggtgtatatatttatgggataaatgagatattttgatacaggtatacaatgcctaataaccacatcagggtaaatagggtattcattacctcaagcatttatcctttctttgtgttataaacaattcatactaattatactttctacccattaaccatccccatttcccccactccaatacctttcccagcctcaggtaaccatcattctactctatctccatgaattcaactattttaatttttagctcccagaaataactgagaaaatgcaatgtttgtctttctgtgcctggcttatttcatgtaatgtaatgatgtccagttccatccatgttgttgtgaatgacaggatatcattcttttttatggctgaatagtactcccttgtgtatatgtaccacagtttatttatccattcatttcttgatggacattttggttgcttccaaattttggctgttgtgaatagagctgcagaaaacattgaagtacagctgtctcttcaatatactgatttcctttcttttaggtaaatacctagcagtgggattgctgaatcatatggtagctctatttttaattttttgaggaacctgcaaactgttctgcatagtagttacactaatttaccttcccaccaacaatgtaagagggttcccttttctctatatccttgccagcatttgtttctgtctgccttttggatatgagctatttaactggagtgagataatatcacattgtagttttgattttcatttctctgatgatcagtgatgttgagcatctttttatttaccttttgacattggtatgtcttcttttgagaaatgtctattcagatcttttgcatatttttgaattggattattagattttttttcttacagcattgtttgagcttattatataatctggttattaatcccttgtcagaatgatagtttgcaaatattttcttccattctgtggatcgtctcttcatgttgttgattgtttcctttgctgtgcagaaactttttaactcgatatgatcccatttatccatttttgctttggttgcctgtacttgtggggtattactcaagaaatctttgcctagtctccaggtgtcctggagagttttcccaatgttgtagtagtttcatagtttgaggtcttagatttctaagtctttaatccattttcatttgattgttgtatatggtgagagataggggtccagcttcattattcttcatatggatatccagtattcccagcacaatttattgaggagactgttacttccccagtgtatgtgcttgacacctttgtcaaaaatgagttcactgtaagtatggatttattctgggttccctattctgtaattgctctatgtgtcctttttttttctcttttttttaatgccagtaccatgctgctttggttactatagctctgtggtataatttaaagtcaggtaatatgatgcttccagtattgctctttttgcttagaatggctttggctattctgggtctttttggctctgcatacattttatgattttttttctatttttgtgaaaaatgtcattggcattttgatagggattgccttgaatctgtagattgttttggatagtatggacattttaacaatattgattcttccaatccatgagcatgaaatatctttccattttttttggtgtcttcttcaatttctttcatttttcccctgcctagaggtttgtggaactttgaacttcagcgagatgatttaaggtatctggcagaagaaatttctaagcagcaaagcattcaagatgtgacttgggtgctgttaaaggcattccattctcaaagggaaacagagcataaaaatttgggaaatgtacagcctgacaatgatagaaaagaaaatcccattttctgaggagaaatttaagccagctgcagaaatttgcatgagtaacgagaagccaaatgttaatttccaagacaatggggaaaatgtccccaggccacgtcagagatcttcggggcagcccctctcatcacaggcctggaggcataggaggaaaaaatggttttgtgggccaggcccagggttcctgtgctgtatgcagcctagggacttggtgtcccttgtcccagctgctctagctatgactaaaaggggccaaggtgcagctcaggctgtggcttcagagggtgcaagctccaagccttggcagcttccatgtggtgttgagcctgcgggtgcacaggagtcaagaatcgaggtttgggaacctctgtctgcatttcagaagatttatggaaacgcctggatgtccaggcagaagtttgctgcaggggtgggactctcatggagaacctttgtatgtcagtgtggaagggaaaagtggggttggagcccccacacagagtccctactggaacattgcctagtggagctgtgagaagagggccactgtcctgcagaccccagaacagtagatgctcctacaccttgcaccatgtgcctggaaaagccgcagatgttcaacgacagcccatgaaagcagccaggatgaggctgtactctgcaaagccacagggtcggagctgcccaagaccatgggaacccacctcttgcatcagcatgacctagatgtgagacctggagtcaaaggagatcattttggagctttaaaatttgactaccctgttggatttcggacttgcataggccctgtaacccctttgttttggccaatttctcccatttggaatggctgtatttatccaatacctatacccccattgtatctaggaagtaactagcttgcttttgattttacaggctcataaatggaaaaaacttgccttgtctcagatgagaccttgggggtgctgaaatgagttaagactttgggggactgttgggaaagcatcatttgttttgaaatgtgaggacatgagatttggaggggccaggggcagaatgatatggtttggctgtgttcccattcaagcctcagtttgaattgtatctcctagaattttttgatgtgttatgtaaaggaattacccagcgggaggtaattgaatcatgggggccagtctttcccgtgctattctcgtgatagtgagtaagtctcaacaatatctgctgggtttatcaggtgtttctgcttttgcttcttcctcatttttctcttgccactgccatgtaagaagtgcctttcacctcccaccatgattctgaggcctccccagccatgtggaactgtaagtctggttaaatctccttttcttcccagttttgggtgtgtctttatcagcagtgtgaaaatggactaatacacttggtaatttataatgaatagagatatattggctcatgattctggaggctgggaagtctaagatcaagaggctgacatcttgtaagggctttcttgctgcatcatcctgtggcagagggtaaatagagggtcaagggataggcaaaagcattcaaatctcatccttttataaggaacccattcccctgataatgaactcactcctgaggtaacagcgttaatgccctcatggtttaatcacctcccattatgccccacctctcaacactaatccagagccttcactcagtccagcaccaactcaaaagtccaaagtctagggtctcttctaaatcagatgtaggtgagactcaaggcacaattcatcctggggcaaattcccttccagctgtgagcctgtgaaatcaaaacaagttgtttacttccaaagtgcaatggtgagacaggtataggatctacattcccgttccaaaagaaaaaaaggggtaacaggccccaaataagtccagaacccaacagaacaaacaatgttaaatctgaaagctagagaataatcttttttgactttatgtttcgccttctgagcatacttggatgaggattgggctcccaagacctcaggcagcccagcccttaggctttgctgggctgagcctacatagcagctctcatgggttggaggctcatgcctgccgctcttatagtctgaggctgcacatgggtgactctatagttctgaggtctcagaggcagccctgctcccatggccctattaggcattgctctagcaagtactttatgatgagtctgctgctgtagcatcctttcagatctacattgaggtagccgcatctccacaacttgtgcagtctgtgcacctgcagaattggcaccacatggatggataccaccaaggtttatttcctatacttttcagagctgcagccagagacacaccctggtttgcttgaacagtgactggggaggctaagggaagctgtgccagaatgcagggagcagatacttgaggcagcacagggcagtgaatgctgaggtcccatagatgcctttctggaaactgtgatctcaggatcctagatgggaggggcagcccaggagacctctgaaatgccttcaagatctctttctatcttgatgaatagcacgtgacttccttttatccatgctaatccccttatgcaagggttccttggccacacccttgcatgctttgcttttttgttctttacatatacaaactgtgacttttccaaatcattactttctgcttcccttttcataatatgttttgtttttaaatcattctaccttctcgcatctttactatatgcagttaaaagtagccacgcagctctttcaatattttgcttagaaatttcttccaccagatatcctagtgaagtggctacattgtctggggtatataccctggggttcatcatcatgcaccaggaaaatttagggcatggacacacacaaggggtttaggagtagaggtttaataggtagaagataagagaaggagaaacagcctcctttataaagggaggggtctctgatcggaaaggactggctggtggcaaatgtgccgagttttatagtccagtttgaggaggcagtgtctgatttctgtaggggtcacagattggttagatcaggtatgaagtttacatagtgcatggggaaggctggttgccccaccataatcttcttatgaaaatggatttcccagttgatcagcatcatcttgtctgctccttacaatacacatggctggcagagaagagaggatggagccaccattttgaaaatgtctagtccttagttcctgtcagcattcacccatgcaagctctcagcttgcaggctgctccttgttagaaaatgatttggggctgcttttcattgaaaaggaaagccttaccaagcactcccatgcccttgttctctgactaagtaattcctttctaactcccattatactagcttattgctcttaaattctgccttccatgaagcactcagatatgggcacaattcagccaagttatttgctgcttcatgtcaaggatggctattactccagtttgcagtatctctttcctcctttctgtctgagatctcctcagagttccctttactctccacatttctgccaatattctgatcataagcactaatgtaatctctacaaagttttaggctttccctgcagttctcttctgagccctcatcagaatcatccttaatgttcttttcataccaatacaagttttttctagccttttttttttcccaaactctcccagcctctacttattgctgagtttcaaagtggcttccctattttcagatatttgataaagcagtgttctatgcttcaataccagttttttgtgttattcagttttgtgctgctataacagaatacttgagacctagtgatttataatgaataaaaatttattggcttatgattctgttgggaaggccaagattgaggggccagaatttggcaagagctttcttgttgcatcattgcatgacagaagagcaaagagagggtgaagagagaaagagaggagggcaaaagggggtgaaatcatccttttataaggaactcattcctgcaataacagcattaatccattcatgagggctatgctctcatggcctaatcatctctcattaggttccacatccccacactgttgtatcggggattaagttttcaacacttttttggagggacacattcaaaccatagcagagactctgcttcatgtcaaggatggctgttattccagtttgcaatatctctttcctcctttctgtctgagatctcctcagaattgcctcacaattaaatattctgttttaggaggcaatcaacttgttttggttcagcacacatgacctagctcacttttcaaaaaacagagctttactgagttacaatttgcacctcaccatattcaccttttaaagatgtacagttcacttatgtttagcatatttagagagtggtacaaccatcaccattacctaattttaggctgaagagccaaattgtataaacaaattggtatctgtgacttgttaaaaaataatttctagggtatcttatatagtcagtataaaatcaaactaatctgtactttagatgtataaaaatgaatttttataatgatgttttatcataacatcattatatcagtattttaccatcctgagttatcaaagcatattataatttccaaaaatatagaaataaactgaggtaggcaaaactttaagatggcccttttgacttttatccctggtattactgtcatgattatgttatgtcatttgtcaagagggagattatttgggttttcttactctaatcacatgagccctttaaaagcagagtatttcccctgggtgctagcagaagaggaagctaaagactcaaagcataaactggatttgacatgctaatgcttgtttgaagatggagggagccatgcctgaaagtactagagaaagtggcctcttggtgctgagagcgagcaacccctggtcagcaactggcaagaaagttgggacctcattcatataactggaatgaactgaattctaccaacagtgaataagcctggaagtggatgcttttctggagcctctggataacagcctagctcaactaatacccatctgagtctatagggacttctgtcctatagaactgtgagataataaatggatgttcttttaaatttctatgtttatggtaatttgttaccagcagtaaaaacaaatttaggggcatatttagcaatacatcgttgaaaaaagttattctggctgaatttcaatgatactgagttaaccagaaaattaaattaattctttaaacatgatggtcaattgagttttattatctttaacagtaataatacaaggtgattgtcatttattaatttaagctttttataacaccttgtgtacctgtctttgatttctttggtctgccatgaatggttagaattaatgctcaaaatgtttgccataaggttactaattgctgtctggatccacgaaaggaagatgctctggcattttagatatctgatttatttgaccctatttgatgcacagtatacttccagtctaccatttgagccaaaaagtgaataggagaactattttacagatagcataaagttatgaaatgatcagtagatgtgatgaagtttagccaaaaggggaagagattgatcttatcattagatagtagattaatttgaaaataatgattaccatgtgcaagagaagtattccctgattaaaaaatgtttgagttgtatagttatctcagtagctgaagggaatgttgaggaaaaaatgtattaatgagctaaaatcttatttggaaatatccttgttagaattatagagctcagaatcagctgatgttgtagtccatttgtattgctacgaaggaatacttgacgctggataatgtgtaaggaaaagagatttgtttggctcatgattctgcaggatgtacaagaagcatggcaccagcatctgcttgtattgcggggctcaggctgcgtctactcatggcagaaggcaaatgggagctggtatctgcagatttcatatggcaggagaggaagcaaggggtgggagcggccaggccctttttcataaccaactctctcaggaactaatagagtgagaactcactctttactgtgaggatggccccaagccattcatgagggatctgcctccatgacccaaactcttctcagtaggcctcacctctgacattagggatcaaatttcagtgtaaggtttggaggagtcatatattcaaaccatagcagttgagaattaggcctcaaagtcagatagataatggttaaaatatcaactatatcaatactgaattggagaacatctttttcttgtgtggccataatgggctaatatttcacctcaaaattaaattacccactcatttatgggccaagttaggcaactgctgatctgtattgcaaggtaggacaacagtagtggaagatagtagtcagaatgcatttcctgtgcctaaaatagtctgacagtgaatgatctgataaagaagttaggaaaacagttccatttacaatagcatcaaaaaacaaaacaaaaaaaacccaaaaaaaaaacttacgataagtttaaccaaagaggtaaaagatctatatgtagaaaactagaaaacattaatgaaagaaattgaaggtgacacaagtaaatggaaagatactttgtgtattcatgaagtgaaagagtattgttaaaatgtctatattacccaaagtaatccacagattctatgcaatcctatcaaaatagaattagaaaaaaatcctataatttgtttgaaaccacaaaagaccacaaatagctaaagcactgttgagcaaaaagaacaaagctagaggcattacactagctgactggtctttgaaaagttaatggaaaatgcatattatgaaaaaactgcgtggatttcaaattttttttgcaccaaaacaaactcataccaaattgttataacaagtctgaatgggatcaagtttgaggcactaaggaggataagacattggtttgaaaagggcccctatcagagtaacataaattctgctaaaattgaagcaagagcaaacatcaaatttatggtgaagcttgggtggaagaaggtgaaattattgatgctttatgaaaagtttaggaggacaatgccccaaagtaatcagcagtttataaatgggtaactcattttaagaagggatgatatgatgttgaagatgaagcctgcagcaggagactattcacatcaatttgtgaggaaaaaatcatcttgttcattctctaattgaagaggactgatgtttgacagcagaagcaatagccaacaccatagacatctcaattaattcaacttactcaattctgaatgcaaattaaagttcagtaaactttccaatctatgggtgccaaaaccactcggaccagattaactagagataagagcagaggttttagtggaaattataaacaagtgggatcaagatcttgaagtatttcttggaagaattgtaacaggtgaagcatgactttaccactacaattctgaagacaaagcacaatcaaagcaatggctaccaggaggtagaaggggttcaatcaaagcaaaagtggactggtcaagagcgaaggtcatggcagcagttttttgggatgctaaaggcattttccttgttgactttctggatggccaaaatataacatctgcttattatgagagtgttttgagagttagccaaaactttagcagaaaaacacctgggaaagcttcaccagagagtccttcttcaccatgacaatgcttctgttcatttctttcatcaaacaagggcaattttgtgagagtttctatggaaaatcattaggcatccaccttatagtactgatttggctccttttgagttttgtttgtttgtttgtttcctaattgatatggtttggctgtgtccccacccaaatcttatcttgaattaccacgtgttgtgggagggatctggtgggagataattgaatcatggggccaagtctttcccatgctgttctcatgatagtgaataagtcttatgagatctgatggttttataaagaggaggtcccctgcacaagctctctctgcctgctgccatccatgtaagacatgacttgctcctccttgccttccaccatgattgtgcatgctccccagccacgtggaactgtaagtccattaaacctctttcttttgtaaattgcccagtctcaggtatgtctttatcagcagcatgaaaatggatgctaatacactaatcttaaaatgttttctaagggcacctatttttcttcagttgataatgtaaacaagactgcattgacatggttaaattcctaggaccttcagctctttagggatgtactaaatgactggtatcattgcttacaaaagcttcttgactttgatggaacttatgttgaaaaataaagtttatattttttatttttatctgtttttttttccatgaacttttagtcatctcatagttattaaaacagcgtgatacctgcataaaaacagacaaattgacccatggaacaggatagagagcccagaaataaattcacctgtctgctgtccactgattttcaacagaggctcgaggaatacacattggagaaaggacagtcttgtcaataagtgattctaaaaaactaggtatccagatatagaagaatgaaattaaacccttatctgatcccttatagaagaatcaactcaaaatggattaaagatttaaatggaagatctgaaactaaaacaactagaaggaaacataggagaaaagctatgactttggtctgagcaatgacttcttgcatgattccaaaagcacagacagcaaaagcaaaaatagacaaatggtattgaatcaagaagcttctatacatcaaaggaaataacagagtgaagagacaacctacacattgagagaaaatatttgcaaatcatacatcagataagggactcatacccaagacataaaatgaactcaaatcattcaataacaagaaaacaaataacccctatttaaacatgggcaaataatctgaatagacatttttcaaaagaaaacatacaaaaggtcaaaacatatatgaaaacatgctcaacattactaatcatcagggaaatgcagatgaaaaccacaatgggatgtcatctcatacctcttaaaatagctcttataaaaaagatgaaagataacgtgttggtgagtatatggcaaaaagggaagtttttgtacactattgggggaaagtaaattagtacagccattttgaaaaaaaatatggaggttcatcaaaaaactgaaaatagaatcaccatatgatccagcagtctgagtatatatccaaaggaattggaatcagtatgttggagagatgtttgcattcacatgttcattgcagcattgttcataatagccaatattgggaaacaacctaagtgcccaccaacggatcaatggattaaaaaaagaggtatatatacataatgaaatagtattcagcctataaagggacaaaatcctgtcatttgtgacaacatagatgaaactagaggccattaggttatgcaaaataagctaggcttagaaagacaaatatcacctgatctcacttacatgtggaatctaaaaatttgaatcaattgaagtagagagtagaatgggggttaccagaagctgtgggtggtggtcagttgggcagggaaaagaaaaatattggtcaaagggtgcaaagtttcaattaggaagaataagtgttctattatttcgttggcgttctattgtacaatgaagtgactaatgttactaattgtgcattgtgtatttcatatactacattgctaatagagtggattttaaatatttttgctgcaaaaaatatgtatgtggggtgatgggtatgttaattagcctgatctgctcagtctgcaatgtatacatgtattgaagcatcacattttaccccatgaatatatacaattattatttgtcaataaagatgaaatgaaaataaaaaggaattaataagctgataaatagtattttaactagaaaatctgtttttaaaaaagatttctatgtgaaaaaggcttacaaaggccaccctgcataaagactatccctgagtggatctgactattccttgtaggctggttatgccaggactaaacctatattctgtgataaacaggatttattgtttcagagatttcgtaaattaaaactatcacactttcttatttttataatgtgttaagttatatatccatagtcaaattatatatccatagtcaggatagacaacaacatcccactagatttaattttagtattgtctaatatttgtgctggttttcctgcatttattagtggccaaccttgtgttataaacagcccagcatgcttttaattaaggactctactttcagctagaatgagatattgacaaggcatatggatatgtggcaggcatctagacaagtgattggcaaactttttctggaaagggccagatagtagatattttaggctttgttggccagatggtctctgttgccagtactcaactctgtcctcgtagtgtgttagcaatcttagataatacttaaacaaactagtgtagttgtgttccaataaaagttcatttacacaaacaggctagtagtttatgtagtactgatctagatgaataagtcagtatggttctcagttcaagaagaggaatgatagaaagtttaaaaaaaagttgtttgaaacttggaatatgtattagaaataatattagaaatagtagttatgtaagagcctattttactttctttagggagttgaactatgtgctacctaatttctggagagcactacacaattggaatgtaagggtattaggagtaagaagtaaaaaaaaataaatggaaaactaggtgtttatggttagagtatggtcctggagtgcaagacttctgaattttagaagaacagttctagactgtaaagaggtccaaagtatgtaatgggaatgctttgcccaagtggcatgcaggtaaaggttcttggagtttaagaagagatcatgaaactgaagaaggagaattgttctttctttattatagaagtagcaggagatttctcccctttacgcatgtcttttggtggtgagaaggaattttccatttcttttaccttgattggtgacatcctcccatgcttccagtggactggtattggcaaggaggaaacctttttgtagtaagtggaggaaaaggtgggctcttggtaagatctttagtgctaaggataaggaattcagggattgtggtgagtagtttccttttaagtttgggaaattgtactactgaagttgaataggacgggacagggtgtgtagttttcaggtactcctattgtttagcttaggtagggaggcataacagttccttcacatcacttataagagggagataaggattactatggtagctcctacaatatatgtttctttggaggaagggggatatatatttttaatttttgtgggtacagagtaggtgtatatgtttatggggtatgtgggatattttgatacagtcatgcaatgcataatcacatcatggaagatagggtatttatctcaagcatgtatcctttgtgttacaaacaatccaattatactctcagttattttaaaatggacaattaaattattattgactatagtcaccctgttgtgctttcaaatactagtctcattcattcattcattctatttttttgtaccccttaaccatccctacctcctcctcactttaccactacccttcccagcctctggtaaccatcttcctactctctatctccatgggttcaattgttttgctttttagatcccacaaatcagtgagaacatataatgtttatctttctgtgcctggcttatttcacgaaacataatgacatccagttacatccgttttgttgcaaatgactgaatcacattatttttatggctgaatagtaattcattgtgtttatgtaccacatttctttatctgttcatctgttgatggacacgtaggttgcttccaaatcttggctattgtgaacagagctacaacaaacatgggagtgcagatatttcaatatattgatttcctttcttttgggtatatacccaacagtgggattgctgaatcgtatggtagctaaatttttacttttacgaggaacctccaaagtgttctccatagtggttgtactaatttacattcccacaaacagtataagagggttcccttttctccatatccttgccagcatttcttactacctgtcttttggatataagccattttaactggggtaagatgatatctcattttagttttgcttttcatttctgtgatgatcagtgatgttgagcaccttttcatgtacgtatttgaaatttgtatgtcttcttttgagaaatgtctgttcaaacctttagcccatttttaaaattggattgttggctttttttcctgttgagttgtttgagcactgtatatattctggttattaatcctttgtcagatggatagttcgtaaatattttctcccattctgtgggttgtctcttcatgttgctgtttcctttgctgtgcagaagttttttaacttgatgtgatcccatttgtccatttttgctttggttgtctgtgcttgtgggttattcctcaagaaatctttgcccagtccaatatcctggagagtttccccaatgttttcttgtagtagtttcatatgcttaactacctgttattatgctagacattttatttgaaaattattgatagaaataatttaaggcccaggataatgttatctttctttagagagtaccatgtatcttctgttaggagacttggcatattggcagttctggcagcaccataagccgattttaagacttgggagttttctgctgctcagatgactcatagctaacctacagttgaggtaaaggctggttaacttctggtacaccactattttaatagcaagtcattatgtcccaagtcaaagtgccctgttgtttctttgaacccctatgttttgtgggttattgcttccaacttttgtcctcctctccccttgaggctactaaatgcactctcaaccttttggcagtctcttctaaataagcaaatctctcagaacaaaagcatctctgaatgcctgcctcctcttaaagaatttgcaacttctggatcttggctttgtacattttatcattttgttacttgtaagattttaaaattgtcctttaactttttaagttgtcttcagtggagagtttttctgaattactgcacttagtattaatattattggaagtgaaaaatcagggcaagttatttaacttgttacttaaaatgtgcttcagacttctcatctgtaatatggagttattaattatttactatcttataggttttttgagatttttaaatgaggcaacacattgtgtttatagtggtacctgacatgtagaaaatgcttaagttattattacatttatttgagaatataggaatttgttgctcttcaaagattttccaagcatgaattagccactttattacaaaagtaatttgcagggattatgaaagatttgcaaatgacattaacattgactgacatttctgtcaaccctgatttaggtaaattaaagtttttcccccctaatgtatttaaggctctatactataaggaaaatttaattttatctaaaagtagataatggccctgatatgtatatgtgtgtgtgtgtatgtttatgtgaatatgtaaaaactgattagctgtgatgtgtgtgtgtttgcatatataagtatagtatataaatgttaaatgggaagacattttaattctttaaaatatggtctcttgataaaataattgggctggaagtaaaaaaaacaaaatgaagcagaattgagatttttgttttaaagatttttaatttctgaaaatagagtttttccaaatatctttttcttttttatgcataaaatagaagatacaattttttttatttgtcctgttttaaaaattgagttcttggactagatgtaaagtagacaggagaaaatgataataaaaaatatatttatagcagaactctttcaagtttggtgacacctattttagcaataccagtacatgaagaaaaaatatagcttacatgctaactccccaaagtggaacatacgtatactttttctctattccatagatttgtatttgatcttccttctgcctcaacctaatttttgtgcagatgaagtttaacttactctattttgcatcaacattgaatccttcagtactatgttcagtctttcagtgtcttttttcgcttcgtaaattgaaatggtcatgatatattaagatttaaagaaatccaaaataagtatcttttgagatgcagagaaaaatacagcactttgaaattttcctaagttgtaaataaatcctcctttttgaaaattgttatgtcccgttcctttggcttaatgacttttaaattttcttatcctgctatatgtcttaaagttattttaaggtaattattttcattattttattttctcttccaggttaacagaaccttctggatatttaacagatggcccaattaactataaatataaaactaaatgtacttggctcattgaaggctagtaagtatacagtctgagtcaaattaatgtattttattcttaaatgataaaggtgatcatattaatgtcagagcattagagtataattactttatcatttagtttgtttattattagataatatttacaacttctagacatcacatttaatgtaaattacactacctcttcacttgtgacagtagtttaatttttatatatattttgtttttgagttatgttattgtggtattaaattgagtaggcatttttttggtttattttgaacatcttgttatgaaatttgaagacttagaaattataaaagtatttcttgctgagctatgctattcatataatttagcattttagttcaaagggtatttttaaaagaacattttgtagaagagagagttaattattcatttagaggtattttcagtaagtagggcttgaaacaatctatctatttaaatgtattgtgaatggagcataaaagaattgatatgaattatttttgaactgttttgtaatttctaaagagtatatttggaaaattttgtatttaaatttttctaacttaaaagctgttcattctctgctgtgcacctgtagttacattttgtttatttgttaacattatatcacattgagaattttgattaaaatttaaatagttttttagtgcctccaacttaagggttctgtaaaaataagaatagtggcttcttgagtgttgatttttaaaaatcaactttatttaagtaccatttgtatacaacaaaatgcacccatttttaagtgtacagttccataaggtttcagtgatgtatacagtctatgtaacctctgccttcaatcaagagaaagattttttttttttgagacagagcctcattctgttacccaggctggagtgcggtggtgcgatctcggctcactgcagcctctgcctcctgagttcaagcaattctcctgcctcagcctcctgagtagctgggactagaggtgcatgccgccatgcgcagctaatttttgtattttcagtagaaatgggttttaccatgttggccaggatggtcttgatctcctgacctcgtgatctgcctgctttggcctcccaaagtgccgggattacaggcgagagccactgcacctggctgaacattttttattgactacatttttagaaaacaatgatacatacatatgtcctgttaatagattttgaaagttacattttatttgtacaaattagatatgatggcttatcaatctttcaccctgataaggatttatagcaaaattatctataaacagatttctaataaaataccctatctaaagtttcttcactctgtgctttgtatattatataataaatattatgtatttattcactctgtgctttgtatattttaatttgaaaaatatttcatattcattttcagtccaaatgcagtgttaagattaagattcaatcattttgctacagaatgtagctgggatcatatgtatgtttatgatggagattcaatatatgcacctttaatagctgtacttaggtgagtaattatatttaatcagttgcagaaaagtgactgtgtaattgcttctttaaatatatattgatatgtactgcaaaataaatttagtaaagatattgatagttacatttcacagatgattataatactttgttatgtgctgtaactgtcaatttaggtaataattatgtaaatattgatataacataaataagtactatattggaaatatagatttctttctaaatattttttattctcattgtatttagtttattctttcaaagtgccttgaatatgttttcagaactatctggatatattagcgtgagttctagctgacaaataaatagacaagttttgttttttaatagttgtttttttattttagtgaaatggtaaaattttaaattctgcataaaagggttaagttatgctttgtgcaatgattaataaagatggagtttctaccaattgtcaaaatgtgagagttttatttgtttcaaaatattttattgttagtcgtaaggtagattattaattttaaaattatagcattgtatcaatttaaaaatcttttcttgtgtatgtttagattattataaaaagtttcgtgaataggagaaaatctattagacacagaaaaaattatgaacatgtatagattttatatataatttaacatgattgttgataagttactcattatattatttacttttgctatttatacaatatctgttatatgttctgtcattgctggaaatttaagtatggataaaagcttattggtcccttcaaaatattttctttccaatttttctttttattattcatgtggcaaatattctatttcattctattctaatacattttattttgttctattttatcaggaatgtgaattattattttggacaaaaatgtaacgacttgtatttccttaggagcttaggtacttattctatgatattgctattgcttacatttttgagtcatttgaacattagaaaaaggatagccataagcagcccttcatctaaggacaatagagagaaaatagagtggagccttgcaaataattaggttgtaagataatttattgtaacaattaaatttgatcctcagttcatacatttattttta

SEQ ID NO: 893 - DNA, 6606 bp, Homo sapiens
atgagaaaagaaaacaactagattcctaaaggttgtagtcaactttctggctgttatggggaacgcgtaatcatatattatcacttaggaagaatggcctgtgttaattaaggctgcctagtaactttgttttttccccaaagttctttgagggctagcatctcattttagtctcaggggaatcttgagctgttattaaggaaggttctgcttgtcccatttgacaggtttggtgattagcatgggggttgccccctaggaagtggaggagtgtgggttgggacccagaccacctggatgttctgcaggctgccctgccctgcacaagcttctagctcccagacaggcacggcaggcccagacagtggcccagcttggggcaggggcaaagcccatcgcagtccacagtccttggcggttttccgtccctttctggggactcccagggaagactgaccagccactgtccctgtcttacagcaggcagtcaccaggagcatgagggaccaggtgacttcacagcagcatgagaatagccatgaaaactaaaacaaggcttgtggacactccaaaaatactccactgaaagcgccagccagcatcgaaaataaacctgtctgctggctgcctgcacagaggagccagggaggggccactgagccacacttccggccccacacccttttattttgggaaaatcaaacccttcccaccatgagcttgcctgtgggagggaagctgaggctgccgttgtcctgtgagatttcgctggacgatgctcaggtgcagaagcgagagctgacccttccattcattctttcgtccacccgcaggcacgtgcgcctccctctgtgtgccaagcgctgtccgtggcatcagggcagatggagcaggggccgccagactcggcttgaatctgctgtgctgtggacaggcctagagagctcggcagcactttccctctaggagatgggagtgggcttattgtgctgtgagggggtaaggaggcaggggagatcttgtctgtgccaggcacgtcctgggccccatgcagatgaccagcctcattagttcgttatctgcactcgctcatgcagcctcacctctgtgtgtggcagaggaccctggcctttaacattcctgccgtcttacagccccacctgcttcaaagcttccgcacgcttcttaacccctggacagacctgcaacccccgcctgtggccttggctcccacttccaagaccctgatgagttttgctgggagggcctggtcgctgctttcttctcagaggaaagtggccccttcccacctcactcagcctcctgctcccctgccctggccctggccggctcacttctggaacaaactccttcctcccagccttcccatctctggtctcttcctgatctggatccttctctctctctctctcttttttttttttttttttttgagataggggctcactctgttgcccaggctagagtacactggtgcaatcacagctcatggcatccctgactttccaggctccagtaatccttccatctcagcctcccaagtagctggggctacaggcccgactaatatttgtatttttggtagagatggggttttgccatgttgccaaggttggtctccaactcctgagctcacacttgagctccacctgccttggcctcccaaagtgctgggattacaggcattagccacagtgcctggcgacccagatccctttctacctggggccagagatttcctcctaaatagaaaacctgaccccaccctggtctttgggcgagacacctcttttgctttttcgtagttcacagctcctttcccaaagctcagtgactcaagggtcagcttggcaatttttgccttagccatgtaccctctgtcgtttttttgttttttgttttgagacggagtctcagtctgtcactcaggctggagtgcaatggcgtgacctcagctcactgcaacctctgcctcccgggttccagcgattctcctgactcagcctcccgagtagttgggattacaggcacccaccaccatgcccggctaatttttgtatttttagtagagatggggttttgccatgttggtcaggctgctctcgagctcctgacctcaggtgatccacgcccccctcggcctcccaaagtgctgggattataggcgtgagccaccacgcctgacctccccctctcgttttatctacttagctttttcttgaaagccttgtccttttatctacttagctgtatcttgaaagcgactctcttaaaaatttaaaatttaaaaatttttaattttttgtgtctctgttacaaaaagaaaacagtctatggcaaagattgctggtgtcacccagtatcttttcatcccttctcactttacacaagatccccaatttttagctaagcagacagtcaaggctgcatttcccaacctcccctgcagccaggtgtggccctttgactaagttctgcatatgtgcagaaatggagtgtggaacttcctaaaaacagccttaaaggagggagaggattgtgcccttcagcatccctttattccttccttctgcctggaatgcaagcatgatagctggagcacaggcagctatattgggtcatgaggaagcaatgcagcaggatagaaggatcctgggttcttaaagattacagagcctccctgctagccctagaaagcttacatcagggttgcctttgtatgagaaaaataaaccctcattgaagtcactgtgatttggagacttcagacacttacacaaagctaaccttgattgaaacacagtatcacttggaataatcaggaggtggctatgaaaaggaatgcaataaaaaagtgacattctgaaactcgtcatacactccactgccttccaggctctgaaactgagggctactcactttgtttaagaagacattagtcatcactagcccgagatgaaatctcactttgttcagagggactgaccgattgttgaaaagggaaagacgttctcaccgtgtgactcaacactgttcagtgccaagttcctcacctcaccattaactggagtcattgactgtctacacctgcaggctgaacgcaccgccccaggatgaagtgtgagtcctcggcatcccagggaggttagtgtcctcctgcgaagctccagccttggggagtgcctccacgtccaggctggagccacctccctactccctctccccagggcctggcacggtcagccatcatgagtgtcccagctagagtcaaccagcagatgatgtttagtgcctctctgtgccttcagaaatgcttcccaccctcaggaattccaatgcctgcttctctctcctgctacactcctactcattgcccatctctgcgtagatgccccagcggatcaccgttcagtcgacatttaccaggcactccctgttcgggggtgagtgttggctatggagttagccgccaggagcctgcctcctgctgactgggcgatctgggcaagttatttagcttctccgcctcagtccttcctatctgtaaaatggggataggaatggcaccttcctcaagggtgttggtgagggttagaccagtcgatatgctaagtgcttagaacacattaaccccctgggacatctcaggtgctgctgttgtctgtcaggctaggaggctaagggatctgctttcatgggggggatggagtgaccttctagaacctgctgcagatagagcttcagcttcaccctctgtattaagcatgccccatgggggtatgggttggatggtggtcgacttacttttttactggcccttcttccttatagcctggggacctgggatgtcagggaagcccatatcctactcacctttgactttttttttttttttttttttttttttttgcagtggggtcctgctctgtcgcccaggctggagtgcagtggcgcgatctcagctcactgcagctttcacctcctgggttcaagcgattcttctgcctcagcctcccaagtagcagggattacaagtgcctgccaccacacccagctaattttgatgggtttttgtttgtttttgtttttttgagacagtcttgctctgcctcccaggctggagtgtagtggcgcaatctcagctcactgcaacctctgcctcccaggttcaagagattctcctgcctcagcctcctgagtaactgggattacaggtgcccgccaccatgcccggctaatttttgtgtttttagtagagatgggatttcaccatgttgaccaggctggtctcgaactcctgacctctggtgatccactcacctcggcctcccaaagtgctggaattacaggcatgagccaccacgcccagctaatttttgtatttttagtagaaacggggtttcaccatgttggccaggctggtctcaaactcctgacctcaggcgatccgcccacctcagcctcccaaagtgctgggattacaggcatgagctactgtgcccggctgcctttgacttttatgtacccaccagcagcctgggcacaccaggtacttaggaaacaatactaataaaggaatccctgtgagatacaggctgggtgaagggactaaggctgagacgctaaggaggcccagctcccagaatagcagaatagtcagcatacaaggcctggccttcccatccaagcctggctgtgtcccgactgctttcatatgaaacgacttcaaggggctttcttactggtatagacaaagtcactgacatgcattcgtgcataagttcaggtgcaaagtggagcccagaccttgaagtcacagactggggttaggtctagactctcctatgtatttgccaggtgatcttggacaaatgtactccaaaggtacactctgagcctcattttcctcacctgagaaatggactgatgttccaatgatctgtttctgcatgacaaatcaccccaaaactgagtggcttaaaaccccagtaagtctcttgtgtctcagggcttctgtgggtcaggaattcaggaagggccccactgggtggttctgcctgacgctccggtatgggcttcctcccaacatgacagcctgaggacagctaaattgcccacttggtggcctgtgagtcacaaactcacccaggttcaaaatcaggagaattagactccagactttttgtttttgtttttgagacagggtctcgctctgttgtccaggctggactgcagtgctgccatctcggcttgttgcaacctccacctccccacatctggctaatttttgtattttttggtagagacagggtttcactatgttgtccaggctgtaaactctagactttgatggggcagtggaaaggtggaaaattggaaaggtggaaaagtggaagagtatatgggacaggagacactgctgcaataaccttttgggagatacagtctgccacagatgatagctctcacgtccactgggagggttacggatgtaaagcaactggaatatcttttttttttttttaagagatggagtcttactctgtcacccagcctggagtgcagtggcgcaatcctggctcactgcagcctcgatctcctggggtcaagcaatcctccttcctcagcctcccagatagctgggactacaggcttgagccaccacatctggtgcctggaatatcttacctgcccataagggatctctgtggtgaccacagctgtcattgcaggttggctgtccacatctgtcccttctcttcctatccctcctcggtgcaagtcgcaccctgtttatggcccataggaatcagctcacaggagacagttggacaagccaagaatccattggtccacttggagtggccaaccattaggccaaccattaggcagagggcagtgaatggggcactgagcccaggccaggtgaatggggggaggcacctgggaccagcagaggatgttacatgggagctgggcattcagaagaggcctctccatcaagccgagtgagcccgtggggccacgcgcccccacctcctccaggagagagggatccatcatcagcatggggcctgggaaccctagcagcctattccagatcctggcagagaccgaccacttgatttcatcccccttccaaagtagtggcacttaattaagaatttctaggtcaggcatggtggctcacatccaccatcccagcactctgggaagctgagacagaagaaaaactggaggccgggagttcaagaccagcctgggcaacatagtgagacctgcccctgtctctaccaaaaaaaaaaaaaaaaaaaaaaaaaaatttttttttcatgagcagaatgtggtggcgtgcacctgtggtcccagttactcagaggctgaggcgagaggatcacctgagcccagaagttggaggctgcagtaagttatgattgtgccactcactgcactccagctgggtgacagagcactactctgtctctaaaaaataaaataaaataaaataaaataaaataaaataataaataaataatttgggaaaagacttactacctaagaaatctttctcctgcacccccaggc

SEQ ID NO: 894 - DNA, 13811 bp, Homo sapiens
gaaaccactgctccaaaactcttaaaagcagagccgagagcctgaattcagaggctgtactgtggggcagggctggaatttgtggcacctgcagggctgaacgttgcctttgctgtccctgcttggggattttggggtactgggtttggatagagtgtgtcatctgcagagggagcactgttctggaagtggactctgctcaggtgtggggggcctgcctgtagggggcaccgtggtggagatggagcaccgctcatgacaggaggctggtgtctggtcaggctgagggatccgtgtgccagcccttctgggaaggctgaatggggcggaactggtcagggcctggcaccaactccaggaggtgctacacccagacagacagatggaaagccacctccctagaggcctcctccccctccccttctgcatgccaccacaccccagcagcgtctcctgaggctgggccatgggtgaatctgagtcgagggcagggcagagtgggagtggcagtgcctctgcctgtctccctggccgtggcaggtcctttgtcacgtatggaccaggagaggtgagtatgattgtggtagtggtgggggcagtggctgaggacccctctctttgctgggctggggcagagcttgaatggagaggggctgccttgtgcctgggaagggaggaccaggtgtcgctggtaccttccaggtcctgaatgcttgttctgtgcctagcccctgctgaggctgcggacgttacaaaccaggatgtgttttgaggctcaggacacctctgaggacttgctgctgttacccccatttaaaagacgaggactctgaagatctgaggtgcatagagtgtagggattaaaagtagttctggctgaattttaaatcctggttccaccatttttgagctctctgatcttgggacccttaatgtatttgctctgtgcctcagtttccccatctgtaaatgagaatgaaagagtaatcccacatccattggttgaaaacttcaataagattatgcatagcaggccgggtgtggtggctcacaccagtaatcccagcactttgggaggccaaggcaggtggatcacttgaggtcaggattttgagaccagcctggtcaacatggtgaaaccccatctctactaaaagtacaacaattagctggacataatggcgcgcgcctgtgatcccagctacttgggaggctgagcaggagaatcctttgaattcaggaggtggaggttgcagtgagccaagatcacgccactgaactccagtctggaccacagagtgagactgtctcacaaaaaaaaaaaaaaagattatgcacagcacctgcagcacagccccagggatgatttttaaaagtgaatccagggccaggtgtggtggctcatgcctgtaatcccagcacttggggaggctgagacaggattacctgacatcaggagtcagtgaccagcctggccaatatggtgaaaccccatctctactaaaaagaaatcccagattctgccatgccacagtgtccaagtcagtcacctgctcgcagtcggccctcaggccctgtggctcctgtttctgctgacttgtccagcctcacagtctggggaggccttggggtccccagcctgcgctgggacaggggtattattccgtcagcccttctgtggaacaagtagggaaggagtgatgtgacctccgtggctctcctgggacacaggttagtcctgtgggtgacctcactttagagagggctggccagctgtgccggaattaggaagtgggtacagctggacaaaaggtggctggagccagctctacagaagccacacctgctcatgagaagggtatccttgtgagtacaggggaaatggcatggagaaagacaaacactggtgggtggctctgccagcttcccctggggtgcttctggcgatgcccaggcctttgcacgctcagatctttgcaccccactgttttaacttggagaggagaggaggaagttagctgctctgaatggtgttgctgctaatctctacagcactttcctgtaaattaggaacggtaacacacacacccctcccccaccccgttggagaagccctgcaccagagcatacagtttggcaagtagggggagggctggagcccagcctcacttgccaccctggccaggccgtgattgcccagggtgcatactgtggctggtgctctgccacctgctgtttctgtcctcagggtaggacacaaggagggcaagtagggctagtcagtgagaggcacaggtgatgcgtgttctagggcttgagatcagctgcttccatttcagtaattgtctttggaggtacgttgtttgctcaagcaacctcccttcaagatagtgcctttttctttctctctctctcttttttttgggggggggaggcagagttttactcttgtcgcccaggctggagcacagtggtgtgatctcggctcactgcaacctcggcctcctggattcaagcgattctcatgcctcagcctcccgagtagctgggattacacgtgtgtgccaccacgccctgctaatttttgtatttttagtaaagatagggtttccccatgttggccaggctggtctcgatctcctgacctcaggtgatccgctcgcctggcctcccaaagtgctgggactataggcatgagccaccgtgctggctgatagtgccattttttaaaatccctatttacccagtggaaaacctgagacccggaaaggtcattcacactcccagaagtgatggttggtccagaattcaggtccaagtgtgagacttcaacatttacattccttattttttcttcttccttttttttattttaatcaaattattacttcaaaatgtatcacactcatcagtttgaaacagttaagcagtacaaatgggaatatgagagaaagtcactctcccacccgccctcttgagaggcaatagccttgttttgcatccttctgagtactctattcacataagatgtatctgaatatgcatgtaattcttttgtgaaagtgcatttggagatcactgttttacacctgccttttacatcttaatattatgctttggagatcagttgacatcagcatgcatcgatttgcatcctatttttcacagctgcatagtgtttcgttgtgtgtgcctaattttttaaaacaggtgcctgtgcatagatttcatgtttccatcttatgctgttagaaaaagtgctgcagtaaagatcctaacagacaagtctctttgcaaatataggaaacttttctgtggaataagcttctggcacggaagccccggggtaaagggtattttgataaatattgtgaaatgtcttcccagaaggtggcctggttttcacttccagcatacatctgtgagaggtcctgcttcccacactcccccagcactgtgtagctcaggacccttgttttttgctgttactatttgtgaaaaatggtatctcaaccacaccggaagttttaaatgtagataaatgtcttatgtgccatttatatttctctacagtaaagtatatattcatagccttagcttatttttaaattatgttccttcattgtttggggagtggggggtagacttgcatgagtatgttataggctaagggaattaactgataagttaatatatgtacatcttgcaaatgcacttcttagttttttactcttttaagtatgagcttgctcacttgctctctgtatctcacttaaactttatgtgagtgtattaatctttcattatttagcttctgaatttatatttcttcaatctccattcctttttttttttttccttgaaatggagactcgctctgtcacccaggctggagtgcagtggcacgatctcggctcactgcaacctctgcatcccgggttcaagcaattctcctgcctcagcctcccgatttgctgggactacagacatgtgccaccacgctcggctaatttttgtattttttagtagagaccattttggtcaggcaggtctcgagctcctgaactcaatcaatctacctgccttggcctcccaaagtgctgggattactggtgtgaaccactgtgcctggccctcgttcttttttttatatgaaaatatttcaaatatgtaaaaattaatataacagacctccatgtgataatcagccagatttatcaagtgtgaaccttatcccatattagatattttttcctttaagaaataaaatattacaagtatagaactaaagatgtgctactatgatctattctattcttccccacattcctttttttttttttttttttgagatggagtctcactctgttgcccaggctggagtgcagtggcgcgatctcggctcactgcaatctctgcctcccagatccaagtgattttcctgcctcagcctcctgaatagctgggattacagacgcacgccatcacgcctgtctaatttttgtatttttagtagagacggggtttcaccatgttggccaggctggtctcaaactcctgacctcatgatccgcccaccgtggcctcccaaagtgctgggattataggcgtgagccaccgcgcctggcctattctttcatcatacacataagcacgcactatttacaaatatacacaaacttagtgctgttttctgattcatcctttatctatttgcaacactttaaaaagttaatgttatgttttcacattgatcccagttgacctgtatggattaatttcttcagttgacatggctatataatattcagttgcgtgaatgtagcacagcttatgtagccatccctctcctgacgatagttaagttgtttccattttttgctattgtaacactgctaataaacatgcttgaatggggtgtcccgtacaagggagggttactcggggctgtgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgtgtctatgagtttgactgcttttgagtacctcctataagtggaatgatacagtatttgtccttttgtaactggcttatttcactttgcatagtgtcttcaaggttgatccatgttgcagtgtatgtcagaatttctttttttcttttcttttcttttctttttttttttttctgagacagagtttcgctcttgctgcccaggctggagtgtaatggcgcgatctcagctcaccacaacctctgcctcctgggttcaagcgattctcctgcctcagcttcccgagtagctgggattacacgcatgcaccaccacacccggctaattttgtattttcagtagatacagggtgtctccatgttggtcaggctggtctcgaactcccaacctcaggtgatctgcgtgcctcgacctcccaatgtgctgggattaaaggtgtgagccattcacccggccgtctttggattttatacagcaaaactccataatatttcctttacatgaatttcctttctttttcaggctgaataatattccattgtacgcatagatcacattttgttcattcatccattgatggatacttgggttgcttcccgattagctattgtgaataatgctgctatgaacatgggtgtacaaatatcgctttgatattctggtttcagttctttggggtatataccccgaagcacagttgtgggatcctatcttgtctcttgttttctctttgcttccatgttttttctcattgtttcgtgggaatactgatattatatattcaagtatttgttgattacatgcactgtacctgacttgtttaaagcctgatgtcttgagtactgtgcacccctgtgcctggctgagtagtggaggaactttgaaagggtctgttctggagagggggtgctgctctggagaggcggtgctgctttggagatggattaatcaggaacttgggtgctgattctaggaggtactgcatctagaaagatgggaggtggggagtgcaacttccccaattttgcctttaacttcagatccttggggtgggtgcattgcttctcctgggatggaggggtgccggggagcccctgaccaggacctggagcaggtccacacaggcactggatttgtcctttactttgggcccaggctgcactcttgattccacctcctcacactggcttcagctttctcaccctcagaatggaattcaaagcctctgcccctcccaggcagacaccaaggtatgattttcaagtggttggtgtcttgtgactggcagctgataaacgggtgatacagtgtttctatacaggagtctgcagtgccaggctgcaggggcggacgggagggggtcgtggtgggtagcctgtggagcctgagggtgggaacagagagacttcttttgctgtaggtggaagcctgtctggctcctttccctcaaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctgcagcgtccagccagggactgtgccgcaggggccagaagatatctgacctactgtcactgcctcttccactctgttccacctgcactggagcgatgctatccgatgaacagatccatttattaattcaacacgtttgtattgagagcctgctgggtgccgggcactattgtcaacatgggtaatacagcagcaagcaaaacaagagaaacatctttgcaagcaggggagggggcctgcagtgttgggtgtgtggagttgttgctgggaagtagagaagctgagtaagagctggacaaagaggccaggcacagtggctcacccctgtaatcccagcactttgggaggccgagtttggcagatcacttgaggtcaggagttcgagaccagcctggacaacatggggaaaccccgttcctactaaaaatacaaaaattagctgggtatggtggtgcatgcctgaaatcccagctacttgggaggctgaggcacgagaattgcttgaacccgggaggtggaggttacagtgagccaagatcacacaccattgtaccccagcctgaatgacaaagcaagactttgtctccaaaaaaaaaaaaaaaaaaaaaaaatagagaaaaggaaagctggatgaagagagatagccaagcccatgtctacggaaaagcattcttgactgagtgaacgaaagtacaaagcctcagaggagggagcatgcctaggtagccccctagacctggtgaggctggtgcgtggggcagcctccatggagaggagttgggcaaggagggaggaggtgctggccagtagagcacgtgtgtctctgtgcgtcagagcaaggacccgggctctccccgtaagtgagaagagtccatggaggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaagttcggcagggaagccagaggagtccgcagcccgggagacctggcctacagcggagagagtcagtccatgccagtggtgggatgtggctgcaaaaaatggtcggattcatggaagtctggtgtccatctggcaggcgttagtggtcccacgaatacagctgtgtgccttgaacacatactgcagagcttccagagagcaccagggctgtgggggctagagactgtgtctcgtgcggaagcgtggctgaggaggggcttgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtgggggttctggctgaagtagccagaattccagtgccagctccgctcctcacgagctgtacaacctgggccggttactgacccctttcccaccttagttccctggctctacaatggaggtaattatcgtgttgaactcacagggtcgagatcatatttaatacttgcacagcccttagaagcatctagcacagtggtcctcagcatttggaaatgtctggaaacattctgtcacacctggggagtgggatttccttctggtgtctagtgggtagaggccagagatgctgctaagcgtcccacaatacacaggacagaccccgcaacaatgaactgtctggcccccaaagttagtggggcagagattgcaggatcctgattccttttcttccttttttttttttttttttttgcccctggctatgagtaagagatcctggtttcgcacaaagtgaacgtgcagtacattgtttcagttgttaattcgccatgcaatacatcgttagtcacgtattattgtttgtcaaatgtgtataaaacatctgccacattcttggcagtttaatagaatctagagatataaagaagttcctgaccacagagttcatagcctcacaggcaagataggaaaacacagaattatataatacgaaattacattatatcatagagcatattctatagtaagttactccgattggcttttggtattaaaatgtcttcagtttcagaggtcccaggatagtgggcaatatttgaaagccagtaaatataaaataaaatatattacctgtgtgaaagagaatttttcaggcacaataatattttaaagagtttatttgtgtaagaagtgaattgggaaacagaaaaccgaaagaggtttagtggcccaatgacagtttcagaggcaggtgtttggagagtgaatgtaaaagcaaaatgaagaatttatttgatttaattggttgcaattacaaaattgctttgtttggtttaccttgttggaagtttcctagtcacataaccatatgttagttggctacttatgattggctgaagttttatttgtgtcaaacagaagcatttaccataaataaccccagttaagatttgattatgctgtcttttaagcaaggttaaggctgttgttaaggcctcattggttttgtttggtaaggaatttttcaggcctggtctccaaattttgctttaacaattccttgcttctggttattctctcagcaagctgatagtgtgactagatgacacagtattactctctgttaccaccaccaatgtagtcactgggacaaagagtcaggtagatgttgttgtcatcatcagtaggtaggttggggatgagaattccatggccacagttagcagttacatagtcagtgttgctttcctcaagttgaatgatcctcatggtaactgtttgatatttgagcagctgttggaaatcatttagaacccttgagagaatacaaggcaccaggggggtaaacataataattataaggagaataatagccaaggattgaaaaattcctctgagcaaagattcccaggagccaagacttaaccagctgagtgaatcaatggagaaggcagtgcccatctaatgaaaaacccatgtgtgttctttaaggtattttaagttttcggtaatacctgatttgttaacataaaaatgacactttttttttttgagatcgagtcttactctgtcgcccaggctggagtgtagtggcgcaatctcagctcactgtaaactccacctcccaggttcaagtgattctcctgcctcaacctcctgagtagctgggactacaggtgtgtaccaccacacccagctaatttttgtgtttttagtagagatgggatttcaccatgttggccatgctggtcttgaactcctgacctcaggtgatccacctgcctcagcctcccaaagtgctgggattacaggtgtgagccaccgtgcctggccaacaccttctttttttttttttttttttgagatacagtctcactctgtcttgcccaggctggagtgtgcagtggtgtgatcttggctcactgcagcctctacctcctgggttcaagtgattctcctgtctcagcctcctgagtagctgggaatacaggcgtgtgccaccacacccggctaattttgtatttttagtagagacagggtttcacccaggctggtctcagactcttgacctcaggtgatccacctctctcagcctcccaaagtgctgggattataggcgtgagccatgcgctcggccagcaacacctttctaccaattagggaacaaggtctccctttttgagcagttaaagtagcaagaagtcttctattgtacagtactactgaggccaattcattcatcccagattgtactgcttaagataattcgaagtgtcaattaaactttttcagaagttggtaaaatattaattgatttttttcaattcactcaactgagagaaacgggctcttacagaagtatgaaatccagaaccccttcgtaagactgtgtctgggatattatgattctcttttgtgaggggtcactttatgtacaaatgactctaaggatttgtatggcaattgaagagtcatatctagtcattttaggtagaagatagcccacaccacagatccagactggctaggtagaacacctttacatactttgttgctgcataaaatgaataattcggtgttatcgatagaaagggtcaaagtgcatcctattacccacgagttgggggtgatacgaatgtcatggttattctccgtcacatctgcgtctgcacagcgccacgttgaatggttatggtttcaattggagtaggaacaaaaaacatttctatgaatttgataaaatgactgtatgccatcatcaattagggatgattggttttctttttatttgagacggagtcttgctgtgtcactcaggctggagtcagtggtgcaatcttggctcactgcaacctctgcttcccgggttcatgcgattctcctgcctcagcctcccaagtagctgggactacaggcaccaccaccacgcccagctatttttttgtatttttagtagagacagggtttcaccgtgttagccaggatggtctcgatctcctgacctcgtgatccaccctcctcggccccccaaagggatgactggttttctttccaaatatgacctgagcattgatctgtccaataagcaagactgttatgtacattatgtagtggatctattgaggcatacgattttcctgtagcatttccattgaaccaatgtctagttctagtaagttctctgatgatatggttgaggctttcatggtcatgttcagattttatatatgtgtctcatgtaggaatctagtcttcataatctgtgtcaaacctaagaatttgagtacagagggattctggaacactgcccagatttggcccagttccattcatgttttctgtgcgtagagataagttaccattaatgacatcaatcgtagttgtaggccatccctttgcctctgttgcttcttccaagagctacactggttgatcataaatatcagccaactgccaagggaaggataccaacccttttcataacgccattttcctgaattgctcactcaagtgtgtatgggagcaggttctaatattagttgtgattctttccatttatctagaggattacgtagccaccaattgctttgcttagtagtgaggatggcttcatgttgagcagtagatcttagaggatattcagtgtggataatgaaattccctaacgaaaataaaagtgtgaaccttttgtgctaaaacaaaacaaaaacaagtctgagtcaatagaagggggccacatggagtcttgtttcattgtcttgggaaagctgtgtctatttcatgatatcatctacttttatggaaggatttctcttgggtatccttaattttgtttttatattattattattattattgagacggagtttctctcttgttgcccaggctgcagtgcagtggcacgatcttggctcactgcaacctccacctcccgggttcaagtaattctcctgcctcatcctcctgagtaactgagattacaggaatctgccaccacacctggctaatttttgtatttttagtagagatggggtttcaccacgttggccaggctggtctcaaactcctgaccttaggcgatccaaccaccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaagctgaggcgggcggatcacctgaggtcaggagtttgagaccatcctggccaacatggtgaaaccccatctctactaaaaatacaaaaattagccgggcatggtgacacatgcctgtaatcccagctacttggaaggctgaggcaggagaatcgcttaaacccatgaggtagaggttgcagtgtgccgagattgtgccaccgcactccagcctgggtgacacagcgagactgtatcaaaaaaaaaaaaaaaagatccagtttccagattccaggtcacgtaaggtgggatcatcaataggcaggtcacagaaagcctccttcacctggtgggatatactttggcatcatacatcaagaccttgcagtattgagtcacatcagagccaccagtagagtggataaatgaagttctgttatgaaaggcacaagtcgttcagtatttattttgtgaagggccactttatgtgttcccctaggggctgatgttcttgccataaaggtcggtgataattcttttggccaaggtaattcagttgactctgttaatttagctaattttagttttgtgataccatttctgcattcagcctttccagaagagagagtgatgagggcaatga

SEQ ID NO: 895 - DNA, 17133 bp, Homo sapiens
attttcgaacaaaaatggctcttccaggagttgagtttggcgaagagacagtgcctgcccaaagtatgcaatgcttttatctttagctcagctcctgagccctcatgcaactctttggacatcttcctgcaaaggacggtgggatcttgtctttctggggcctcagggtctccaaagatgggctgactaagcttccctagcctgggacctgaaccctccaccctcctctctcttgagctctttctcccaggggaagctgctcgaatgaggggagttggccaacacagttttctactctcagaccccattgaggtgagcacacaacagtgttctgtgtgagggtctggatacactccccaccctcccaggcccggcaccgtgtcgccctgccccagcccagagcttgcctctgttggctttgtgaccctcgctttgtactgtggctttgttctgccttagggaccagctggtcccctgctgtggttccacacagtggagactgatccctgaccactcattcagctgcctggcggccctggggcaagtgtttgtcccccatctcccaaaatggcggggtgcaggggctccctgcccggagtcccaaccctgccaaggcagagggaatggggaacagctgcgctggcccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtgttgggctggatgtgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctctcagcccactcatccagggatgcagctctggccttggcccacccccatcagagggcctgtggccctgatcaccgcactccccactctgtgaccagacgttctctcctgagcatcgctgaccctgcagctgtccaaatagagcaagaagtgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcatggtgttggggcctcacagatgatggagaagccagagttcaggcacttggcatgacccctggcatcgccttcagttgatttagtgtctctgccctgggatattccatgggaccctgggctggcttctgtgtgcagaggtgggtgtgggccatagcccagacctgttgaaccagttgtaggctctggaatcctctgtccccaggtagtgaccaggccctgacaggccggtatctgtccctcccatcaccctcccagttatgggtgcagatgaccctgaaattgctaaagcctcagggcttgagcccagaaagtgtgagcaggctggtggggcagctggaggaaggccttgcaggttcctggatttgggtgccgggtgggctgagaggacagtccctgtcactgggactgggcacaggtgcagagaggctgagacgggcccagaggacagtgagtgtgtgttgtgtgggcgccgggccaggaagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctccgggctgcctggtgatagctcccagggacctgcaagctgacaaacaaagtctatacgagccagagctggggtgggaggaacccagtgggcctgggggaggtaaagcagcagcagctgctgtagctgagcccggcccacggccagccctgaggaatggaggaagagagtgccctggctgggggagcccctcaagccctggaagctgtatgtgggcatggggtggtgggggcgtgcagagaggaggaggactgagagctgggtgtgtgtgtgcgcatgcctgtgtctgtgtgatctggttcccgggtgtctgagtagggaccaatgtgtttgtgctggagaagcctgtgtaggttactgacatggggaggggtggggcttgctttcctcaccccgcttcccacgtcttcattgagtcctcatctgggggccctgttccactctccttcccgtgtgcagggccctcccctctggcgagtctgcctctcactcgctcagcccctttaaccctgctggctcctaatgagacttcaggtgtggaccctcgaaccctcagctgcacaggtctggaaacatccttgttcatcaagcaccaggctgaccatggtgtccgtctcagtgcccagcagatgttctggtgaggggaggcgggagtgcaaggtctgccgagtgagggttccttccgggaggaggcagggtgagcgcagaaaccactgctccaaaactcttaaaagcagagccgagagcctgaattcagaggctgtactgtggggcagggctggaatttgtggcacctgcagggctgaacgttgcctttgctgtccctgcttggggattttggggtactgggtttggatagagtgtgtcatctgcagagggagcactgttctggaagtggactctgctcaggtgtggggggcctgcctgtagggggcaccgtggtggagatggagcaccgctcatgacaggaggctggtgtctggtcaggctgagggatccgtgtgccagcccttctgggaaggctgaatggggcggaactggtcagggcctggcaccaactccaggaggtgctacacccagacagacagatggaaagccacctccctagaggcctcctccccctccccttctgcatgccaccacaccccagcagcgtctcctgaggctgggccatgggtgaatctgagtcgagggcagggcagagtgggagtggcagtgcctctgcctgtctccctggccgtggcaggtcctttgtcacgtatggaccaggagaggtgagtatgattgtggtagtggtgggggcagtggctgaggacccctctctttgctgggctggggcagagcttgaatggagaggggctgccttgtgcctgggaagggaggaccaggtgtcgctggtaccttccaggtcctgaatgcttgttctgtgcctagcccctgctgaggctgcggacgttacaaaccaggatgtgttttgaggctcaggacacctctgaggacttgctgctgttacccccatttaaaagacgaggactctgaagatctgaggtgcatagagtgtagggattaaaagtagttctggctgaattttaaatcctggttccaccatttttgagctctctgatcttgggacccttaatgtatttgctctgtgcctcagtttccccatctgtaaatgagaatgaaagagtaatcccacatccattggttgaaaacttcaataagattatgcatagcaggccgggtgtggtggctcacaccagtaatcccagcactttgggaggccaaggcaggtggatcacttgaggtcaggattttgagaccagcctggtcaacatggtgaaaccccatctctactaaaagtacaacaattagctggacataatggcgcgcgcctgtgatcccagctacttgggaggctgagcaggagaatcctttgaattcaggaggtggaggttgcagtgagccaagatcacgccactgaactccagtctggaccacagagtgagactgtctcacaaaaaaaaaaaaaaagattatgcacagcacctgcagcacagccccagggatgatttttaaaagtgaatccagggccaggtgtggtggctcatgcctgtaatcccagcacttggggaggctgagacaggattacctgacatcaggagtcagtgaccagcctggccaatatggtgaaaccccatctctactaaaaagaaatcccagattctgccatgccacagtgtccaagtcagtcacctgctcgcagtcggccctcaggccctgtggctcctgtttctgctgacttgtccagcctcacagtctggggaggccttggggtccccagcctgcgctgggacaggggtattattccgtcagcccttctgtggaacaagtagggaaggagtgatgtgacctccgtggctctcctgggacacaggttagtcctgtgggtgacctcactttagagagggctggccagctgtgccggaattaggaagtgggtacagctggacaaaaggtggctggagccagctctacagaagccacacctgctcatgagaagggtatccttgtgagtacaggggaaatggcatggagaaagacaaacactggtgggtggctctgccagcttcccctggggtgcttctggcgatgcccaggcctttgcacgctcagatctttgcaccccactgttttaacttggagaggagaggaggaagttagctgctctgaatggtgttgctgctaatctctacagcactttcctgtaaattaggaacggtaacacacacacccctcccccaccccgttggagaagccctgcaccagagcatacagtttggcaagtagggggagggctggagcccagcctcacttgccaccctggccaggccgtgattgcccagggtgcatactgtggctggtgctctgccacctgctgtttctgtcctcagggtaggacacaaggagggcaagtagggctagtcagtgagaggcacaggtgatgcgtgttctagggcttgagatcagctgcttccatttcagtaattgtctttggaggtacgttgtttgctcaagcaacctcccttcaagatagtgcctttttctttctctctctctcttttttttgggggggggaggcagagttttactcttgtcgcccaggctggagcacagtggtgtgatctcggctcactgcaacctcggcctcctggattcaagcgattctcatgcctcagcctcccgagtagctgggattacacgtgtgtgccaccacgccctgctaatttttgtatttttagtaaagatagggtttccccatgttggccaggctggtctcgatctcctgacctcaggtgatccgctcgcctggcctcccaaagtgctgggactataggcatgagccaccgtgctggctgatagtgccattttttaaaatccctatttacccagtggaaaacctgagacccggaaaggtcattcacactcccagaagtgatggttggtccagaattcaggtccaagtgtgagacttcaacatttacattccttattttttcttcttccttttttttattttaatcaaattattacttcaaaatgtatcacactcatcagtttgaaacagttaagcagtacaaatgggaatatgagagaaagtcactctcccacccgccctcttgagaggcaatagccttgttttgcatccttctgagtactctattcacataagatgtatctgaatatgcatgtaattcttttgtgaaagtgcatttggagatcactgttttacacctgccttttacatcttaatattatgctttggagatcagttgacatcagcatgcatcgatttgcatcctatttttcacagctgcatagtgtttcgttgtgtgtgcctaattttttaaaacaggtgcctgtgcatagatttcatgtttccatcttatgctgttagaaaaagtgctgcagtaaagatcctaacagacaagtctctttgcaaatataggaaacttttctgtggaataagcttctggcacggaagccccggggtaaagggtattttgataaatattgtgaaatgtcttcccagaaggtggcctggttttcacttccagcatacatctgtgagaggtcctgcttcccacactcccccagcactgtgtagctcaggacccttgttttttgctgttactatttgtgaaaaatggtatctcaaccacaccggaagttttaaatgtagataaatgtcttatgtgccatttatatttctctacagtaaagtatatattcatagccttagcttatttttaaattatgttccttcattgtttggggagtggggggtagacttgcatgagtatgttataggctaagggaattaactgataagttaatatatgtacatcttgcaaatgcacttcttagttttttactcttttaagtatgagcttgctcacttgctctctgtatctcacttaaactttatgtgagtgtattaatctttcattatttagcttctgaatttatatttcttcaatctccattcctttttttttttttccttgaaatggagactcgctctgtcacccaggctggagtgcagtggcacgatctcggctcactgcaacctctgcatcccgggttcaagcaattctcctgcctcagcctcccgatttgctgggactacagacatgtgccaccacgctcggctaatttttgtattttttagtagagaccattttggtcaggcaggtctcgagctcctgaactcaatcaatctacctgccttggcctcccaaagtgctgggattactggtgtgaaccactgtgcctggccctcgttcttttttttatatgaaaatatttcaaatatgtaaaaattaatataacagacctccatgtgataatcagccagatttatcaagtgtgaaccttatcccatattagatattttttcctttaagaaataaaatattacaagtatagaactaaagatgtgctactatgatctattctattcttccccacattcctttttttttttttttttttgagatggagtctcactctgttgcccaggctggagtgcagtggcgcgatctcggctcactgcaatctctgcctcccagatccaagtgattttcctgcctcagcctcctgaatagctgggattacagacgcacgccatcacgcctgtctaatttttgtatttttagtagagacggggtttcaccatgttggccaggctggtctcaaactcctgacctcatgatccgcccaccgtggcctcccaaagtgctgggattataggcgtgagccaccgcgcctggcctattctttcatcatacacataagcacgcactatttacaaatatacacaaacttagtgctgttttctgattcatcctttatctatttgcaacactttaaaaagttaatgttatgttttcacattgatcccagttgacctgtatggattaatttcttcagttgacatggctatataatattcagttgcgtgaatgtagcacagcttatgtagccatccctctcctgacgatagttaagttgtttccattttttgctattgtaacactgctaataaacatgcttgaatggggtgtcccgtacaagggagggttactcggggctgtgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgtgtctatgagtttgactgcttttgagtacctcctataagtggaatgatacagtatttgtccttttgtaactggcttatttcactttgcatagtgtcttcaaggttgatccatgttgcagtgtatgtcagaatttctttttttcttttcttttcttttctttttttttttttctgagacagagtttcgctcttgctgcccaggctggagtgtaatggcgcgatctcagctcaccacaacctctgcctcctgggttcaagcgattctcctgcctcagcttcccgagtagctgggattacacgcatgcaccaccacacccggctaattttgtattttcagtagatacagggtgtctccatgttggtcaggctggtctcgaactcccaacctcaggtgatctgcgtgcctcgacctcccaatgtgctgggattaaaggtgtgagccattcacccggccgtctttggattttatacagcaaaactccataatatttcctttacatgaatttcctttctttttcaggctgaataatattccattgtacgcatagatcacattttgttcattcatccattgatggatacttgggttgcttcccgattagctattgtgaataatgctgctatgaacatgggtgtacaaatatcgctttgatattctggtttcagttctttggggtatataccccgaagcacagttgtgggatcctatcttgtctcttgttttctctttgcttccatgttttttctcattgtttcgtgggaatactgatattatatattcaagtatttgttgattacatgcactgtacctgacttgtttaaagcctgatgtcttgagtactgtgcacccctgtgcctggctgagtagtggaggaactttgaaagggtctgttctggagagggggtgctgctctggagaggcggtgctgctttggagatggattaatcaggaacttgggtgctgattctaggaggtactgcatctagaaagatgggaggtggggagtgcaacttccccaattttgcctttaacttcagatccttggggtgggtgcattgcttctcctgggatggaggggtgccggggagcccctgaccaggacctggagcaggtccacacaggcactggatttgtcctttactttgggcccaggctgcactcttgattccacctcctcacactggcttcagctttctcaccctcagaatggaattcaaagcctctgcccctcccaggcagacaccaaggtatgattttcaagtggttggtgtcttgtgactggcagctgataaacgggtgatacagtgtttctatacaggagtctgcagtgccaggctgcaggggcggacgggagggggtcgtggtgggtagcctgtggagcctgagggtgggaacagagagacttcttttgctgtaggtggaagcctgtctggctcctttccctcaaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctgcagcgtccagccagggactgtgccgcaggggccagaagatatctgacctactgtcactgcctcttccactctgttccacctgcactggagcgatgctatccgatgaacagatccatttattaattcaacacgtttgtattgagagcctgctgggtgccgggcactattgtcaacatgggtaatacagcagcaagcaaaacaagagaaacatctttgcaagcaggggagggggcctgcagtgttgggtgtgtggagttgttgctgggaagtagagaagctgagtaagagctggacaaagaggccaggcacagtggctcacccctgtaatcccagcactttgggaggccgagtttggcagatcacttgaggtcaggagttcgagaccagcctggacaacatggggaaaccccgttcctactaaaaatacaaaaattagctgggtatggtggtgcatgcctgaaatcccagctacttgggaggctgaggcacgagaattgcttgaacccgggaggtggaggttacagtgagccaagatcacacaccattgtaccccagcctgaatgacaaagcaagactttgtctccaaaaaaaaaaaaaaaaaaaaaaaatagagaaaaggaaagctggatgaagagagatagccaagcccatgtctacggaaaagcattcttgactgagtgaacgaaagtacaaagcctcagaggagggagcatgcctaggtagccccctagacctggtgaggctggtgcgtggggcagcctccatggagaggagttgggcaaggagggaggaggtgctggccagtagagcacgtgtgtctctgtgcgtcagagcaaggacccgggctctccccgtaagtgagaagagtccatggaggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaagttcggcagggaagccagaggagtccgcagcccgggagacctggcctacagcggagagagtcagtccatgccagtggtgggatgtggctgcaaaaaatggtcggattcatggaagtctggtgtccatctggcaggcgttagtggtcccacgaatacagctgtgtgccttgaacacatactgcagagcttccagagagcaccagggctgtgggggctagagactgtgtctcgtgcggaagcgtggctgaggaggggcttgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtgggggttctggctgaagtagccagaattccagtgccagctccgctcctcacgagctgtacaacctgggccggttactgacccctttcccaccttagttccctggctctacaatggaggtaattatcgtgttgaactcacagggtcgagatcatatttaatacttgcacagcccttagaagcatctagcacagtggtcctcagcatttggaaatgtctggaaacattctgtcacacctggggagtgggatttccttctggtgtctagtgggtagaggccagagatgctgctaagcgtcccacaatacacaggacagaccccgcaacaatgaactgtctggcccccaaagttagtggggcagagattgcaggatcctgattccttttcttccttttttttttttttttttttgcccctggctatgagtaagagatcctggtttcgcacaaagtgaacgtgcagtacattgtttcagttgttaattcgccatgcaatacatcgttagtcacgtattattgtttgtcaaatgtgtataaaacatctgccacattcttggcagtttaatagaatctagagatataaagaagttcctgaccacagagttcatagcctcacaggcaagataggaaaacacagaattatataatacgaaattacattatatcatagagcatattctatagtaagttactccgattggcttttggtattaaaatgtcttcagtttcagaggtcccaggatagtgggcaatatttgaaagccagtaaatataaaataaaatatattacctgtgtgaaagagaatttttcaggcacaataatattttaaagagtttatttgtgtaagaagtgaattgggaaacagaaaaccgaaagaggtttagtggcccaatgacagtttcagaggcaggtgtttggagagtgaatgtaaaagcaaaatgaagaatttatttgatttaattggttgcaattacaaaattgctttgtttggtttaccttgttggaagtttcctagtcacataaccatatgttagttggctacttatgattggctgaagttttatttgtgtcaaacagaagcatttaccataaataaccccagttaagatttgattatgctgtcttttaagcaaggttaaggctgttgttaaggcctcattggttttgtttggtaaggaatttttcaggcctggtctccaaattttgctttaacaattccttgcttctggttattctctcagcaagctgatagtgtgactagatgacacagtattactctctgttaccaccaccaatgtagtcactgggacaaagagtcaggtagatgttgttgtcatcatcagtaggtaggttggggatgagaattccatggccacagttagcagttacatagtcagtgttgctttcctcaagttgaatgatcctcatggtaactgtttgatatttgagcagctgttggaaatcatttagaacccttgagagaatacaaggcaccaggggggtaaacataataattataaggagaataatagccaaggattgaaaaattcctctgagcaaagattcccaggagccaagacttaaccagctgagtgaatcaatggagaaggcagtgcccatctaatgaaaaacccatgtgtgttctttaaggtattttaagttttcggtaatacctgatttgttaacataaaaatgacactttttttttttgagatcgagtcttactctgtcgcccaggctggagtgtagtggcgcaatctcagctcactgtaaactccacctcccaggttcaagtgattctcctgcctcaacctcctgagtagctgggactacaggtgtgtaccaccacacccagctaatttttgtgtttttagtagagatgggatttcaccatgttggccatgctggtcttgaactcctgacctcaggtgatccacctgcctcagcctcccaaagtgctgggattacaggtgtgagccaccgtgcctggccaacaccttctttttttttttttttttttgagatacagtctcactctgtcttgcccaggctggagtgtgcagtggtgtgatcttggctcactgcagcctctacctcctgggttcaagtgattctcctgtctcagcctcctgagtagctgggaatacaggcgtgtgccaccacacccggctaattttgtatttttagtagagacagggtttcacccaggctggtctcagactcttgacctcaggtgatccacctctctcagcctcccaaagtgctgggattataggcgtgagccatgcgctcggccagcaacacctttctaccaattagggaacaaggtctccctttttgagcagttaaagtagcaagaagtcttctattgtacagtactactgaggccaattcattcatcccagattgtactgcttaagataattcgaagtgtcaattaaactttttcagaagttggtaaaatattaattgatttttttcaattcactcaactgagagaaacgggctcttacagaagtatgaaatccagaaccccttcgtaagactgtgtctgggatattatgattctcttttgtgaggggtcactttatgtacaaatgactctaaggatttgtatggcaattgaagagtcatatctagtcattttaggtagaagatagcccacaccacagatccagactggctaggtagaacacctttacatactttgttgctgcataaaatgaataattcggtgttatcgatagaaagggtcaaagtgcatcctattacccacgagttgggggtgatacgaatgtcatggttattctccgtcacatctgcgtctgcacagcgccacgttgaatggttatggtttcaattggagtaggaacaaaaaacatttctatgaatttgataaaatgactgtatgccatcatcaattagggatgattggttttctttttatttgagacggagtcttgctgtgtcactcaggctggagtcagtggtgcaatcttggctcactgcaacctctgcttcccgggttcatgcgattctcctgcctcagcctcccaagtagctgggactacaggcaccaccaccacgcccagctatttttttgtatttttagtagagacagggtttcaccgtgttagccaggatggtctcgatctcctgacctcgtgatccaccctcctcggccccccaaagggatgactggttttctttccaaatatgacctgagcattgatctgtccaataagcaagactgttatgtacattatgtagtggatctattgaggcatacgattttcctgtagcatttccattgaaccaatgtctagttctagtaagttctctgatgatatggttgaggctttcatggtcatgttcagattttatatatgtgtctcatgtaggaatctagtcttcataatctgtgtcaaacctaagaatttgagtacagagggattctggaacactgcccagatttggcccagttccattcatgttttctgtgcgtagagataagttaccattaatgacatcaatcgtagttgtaggccatccctttgcctctgttgcttcttccaagagctacactggttgatcataaatatcagccaactgccaagggaaggataccaacccttttcataacgccattttcctgaattgctcactcaagtgtgtatgggagcaggttctaatattagttgtgattctttccatttatctagaggattacgtagccaccaattgctttgcttagtagtgaggatggcttcatgttgagcagtagatcttagaggatattcagtgtggataatgaaattccctaacgaaaataaaagtgtgaaccttttgtgctaaaacaaaacaaaaacaagtctgagtcaatagaagggggccacatggagtcttgtttcattgtcttgggaaagctgtgtctatttcatgatatcatctacttttatggaaggatttctcttgggtatccttaattttgtttttatattattattattattattgagacggagtttctctcttgttgcccaggctgcagtgcagtggcacgatcttggctcactgcaacctccacctcccgggttcaagtaattctcctgcctcatcctcctgagtaactgagattacaggaatctgccaccacacctggctaatttttgtatttttagtagagatggggtttcaccacgttggccaggctggtctcaaactcctgaccttaggcgatccaaccaccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaagctgaggcgggcggatcacctgaggtcaggagtttgagaccatcctggccaacatggtgaaaccccatctctactaaaaatacaaaaattagccgggcatggtgacacatgcctgtaatcccagctacttggaaggctgaggcaggagaatcgcttaaacccatgaggtagaggttgcagtgtgccgagattgtgccaccgcactccagcctgggtgacacagcgagactgtatcaaaaaaaaaaaaaaaagatccagtttccagattccaggtcacgtaaggtgggatcatcaataggcaggtcacagaaagcctccttcacctggtgggatatactttggcatcatacatcaagaccttgcagtattgagtcacatcagagccaccagtagagtggataaatgaagttctgttatgaaaggcacaagtcgttcagtatttattttgtgaagggccactttatgtgttcccctaggggctgatgttcttgccataaaggtcggtgataattcttttggccaaggtaattcagttgactctgttaatttagctaattttagttttgtgataccatttctgcattcagcctttccagaagagagagtgatgagggcaatga

SEQ ID NO: 896 - DNA, 17318 bp, Homo sapiens
gaaaccactgctccaaaactcttaaaagcagagccgagagcctgaattcagaggctgtactgtggggcagggctggaatttgtggcacctgcagggctgaacgttgcctttgctgtccctgcttggggattttggggtactgggtttggatagagtgtgtcatctgcagagggagcactgttctggaagtggactctgctcaggtgtggggggcctgcctgtagggggcaccgtggtggagatggagcaccgctcatgacaggaggctggtgtctggtcaggctgagggatccgtgtgccagcccttctgggaaggctgaatggggcggaactggtcagggcctggcaccaactccaggaggtgctacacccagacagacagatggaaagccacctccctagaggcctcctccccctccccttctgcatgccaccacaccccagcagcgtctcctgaggctgggccatgggtgaatctgagtcgagggcagggcagagtgggagtggcagtgcctctgcctgtctccctggccgtggcaggtcctttgtcacgtatggaccaggagaggtgagtatgattgtggtagtggtgggggcagtggctgaggacccctctctttgctgggctggggcagagcttgaatggagaggggctgccttgtgcctgggaagggaggaccaggtgtcgctggtaccttccaggtcctgaatgcttgttctgtgcctagcccctgctgaggctgcggacgttacaaaccaggatgtgttttgaggctcaggacacctctgaggacttgctgctgttacccccatttaaaagacgaggactctgaagatctgaggtgcatagagtgtagggattaaaagtagttctggctgaattttaaatcctggttccaccatttttgagctctctgatcttgggacccttaatgtatttgctctgtgcctcagtttccccatctgtaaatgagaatgaaagagtaatcccacatccattggttgaaaacttcaataagattatgcatagcaggccgggtgtggtggctcacaccagtaatcccagcactttgggaggccaaggcaggtggatcacttgaggtcaggattttgagaccagcctggtcaacatggtgaaaccccatctctactaaaagtacaacaattagctggacataatggcgcgcgcctgtgatcccagctacttgggaggctgagcaggagaatcctttgaattcaggaggtggaggttgcagtgagccaagatcacgccactgaactccagtctggaccacagagtgagactgtctcacaaaaaaaaaaaaaaagattatgcacagcacctgcagcacagccccagggatgatttttaaaagtgaatccagggccaggtgtggtggctcatgcctgtaatcccagcacttggggaggctgagacaggattacctgacatcaggagtcagtgaccagcctggccaatatggtgaaaccccatctctactaaaaagaaatcccagattctgccatgccacagtgtccaagtcagtcacctgctcgcagtcggccctcaggccctgtggctcctgtttctgctgacttgtccagcctcacagtctggggaggccttggggtccccagcctgcgctgggacaggggtattattccgtcagcccttctgtggaacaagtagggaaggagtgatgtgacctccgtggctctcctgggacacaggttagtcctgtgggtgacctcactttagagagggctggccagctgtgccggaattaggaagtgggtacagctggacaaaaggtggctggagccagctctacagaagccacacctgctcatgagaagggtatccttgtgagtacaggggaaatggcatggagaaagacaaacactggtgggtggctctgccagcttcccctggggtgcttctggcgatgcccaggcctttgcacgctcagatctttgcaccccactgttttaacttggagaggagaggaggaagttagctgctctgaatggtgttgctgctaatctctacagcactttcctgtaaattaggaacggtaacacacacacccctcccccaccccgttggagaagccctgcaccagagcatacagtttggcaagtagggggagggctggagcccagcctcacttgccaccctggccaggccgtgattgcccagggtgcatactgtggctggtgctctgccacctgctgtttctgtcctcagggtaggacacaaggagggcaagtagggctagtcagtgagaggcacaggtgatgcgtgttctagggcttgagatcagctgcttccatttcagtaattgtctttggaggtacgttgtttgctcaagcaacctcccttcaagatagtgcctttttctttctctctctctcttttttttgggggggggaggcagagttttactcttgtcgcccaggctggagcacagtggtgtgatctcggctcactgcaacctcggcctcctggattcaagcgattctcatgcctcagcctcccgagtagctgggattacacgtgtgtgccaccacgccctgctaatttttgtatttttagtaaagatagggtttccccatgttggccaggctggtctcgatctcctgacctcaggtgatccgctcgcctggcctcccaaagtgctgggactataggcatgagccaccgtgctggctgatagtgccattttttaaaatccctatttacccagtggaaaacctgagacccggaaaggtcattcacactcccagaagtgatggttggtccagaattcaggtccaagtgtgagacttcaacatttacattccttattttttcttcttccttttttttattttaatcaaattattacttcaaaatgtatcacactcatcagtttgaaacagttaagcagtacaaatgggaatatgagagaaagtcactctcccacccgccctcttgagaggcaatagccttgttttgcatccttctgagtactctattcacataagatgtatctgaatatgcatgtaattcttttgtgaaagtgcatttggagatcactgttttacacctgccttttacatcttaatattatgctttggagatcagttgacatcagcatgcatcgatttgcatcctatttttcacagctgcatagtgtttcgttgtgtgtgcctaattttttaaaacaggtgcctgtgcatagatttcatgtttccatcttatgctgttagaaaaagtgctgcagtaaagatcctaacagacaagtctctttgcaaatataggaaacttttctgtggaataagcttctggcacggaagccccggggtaaagggtattttgataaatattgtgaaatgtcttcccagaaggtggcctggttttcacttccagcatacatctgtgagaggtcctgcttcccacactcccccagcactgtgtagctcaggacccttgttttttgctgttactatttgtgaaaaatggtatctcaaccacaccggaagttttaaatgtagataaatgtcttatgtgccatttatatttctctacagtaaagtatatattcatagccttagcttatttttaaattatgttccttcattgtttggggagtggggggtagacttgcatgagtatgttataggctaagggaattaactgataagttaatatatgtacatcttgcaaatgcacttcttagttttttactcttttaagtatgagcttgctcacttgctctctgtatctcacttaaactttatgtgagtgtattaatctttcattatttagcttctgaatttatatttcttcaatctccattcctttttttttttttccttgaaatggagactcgctctgtcacccaggctggagtgcagtggcacgatctcggctcactgcaacctctgcatcccgggttcaagcaattctcctgcctcagcctcccgatttgctgggactacagacatgtgccaccacgctcggctaatttttgtattttttagtagagaccattttggtcaggcaggtctcgagctcctgaactcaatcaatctacctgccttggcctcccaaagtgctgggattactggtgtgaaccactgtgcctggccctcgttcttttttttatatgaaaatatttcaaatatgtaaaaattaatataacagacctccatgtgataatcagccagatttatcaagtgtgaaccttatcccatattagatattttttcctttaagaaataaaatattacaagtatagaactaaagatgtgctactatgatctattctattcttccccacattcctttttttttttttttttttgagatggagtctcactctgttgcccaggctggagtgcagtggcgcgatctcggctcactgcaatctctgcctcccagatccaagtgattttcctgcctcagcctcctgaatagctgggattacagacgcacgccatcacgcctgtctaatttttgtatttttagtagagacggggtttcaccatgttggccaggctggtctcaaactcctgacctcatgatccgcccaccgtggcctcccaaagtgctgggattataggcgtgagccaccgcgcctggcctattctttcatcatacacataagcacgcactatttacaaatatacacaaacttagtgctgttttctgattcatcctttatctatttgcaacactttaaaaagttaatgttatgttttcacattgatcccagttgacctgtatggattaatttcttcagttgacatggctatataatattcagttgcgtgaatgtagcacagcttatgtagccatccctctcctgacgatagttaagttgtttccattttttgctattgtaacactgctaataaacatgcttgaatggggtgtcccgtacaagggagggttactcggggctgtgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgtgtctatgagtttgactgcttttgagtacctcctataagtggaatgatacagtatttgtccttttgtaactggcttatttcactttgcatagtgtcttcaaggttgatccatgttgcagtgtatgtcagaatttctttttttcttttcttttcttttctttttttttttttctgagacagagtttcgctcttgctgcccaggctggagtgtaatggcgcgatctcagctcaccacaacctctgcctcctgggttcaagcgattctcctgcctcagcttcccgagtagctgggattacacgcatgcaccaccacacccggctaattttgtattttcagtagatacagggtgtctccatgttggtcaggctggtctcgaactcccaacctcaggtgatctgcgtgcctcgacctcccaatgtgctgggattaaaggtgtgagccattcacccggccgtctttggattttatacagcaaaactccataatatttcctttacatgaatttcctttctttttcaggctgaataatattccattgtacgcatagatcacattttgttcattcatccattgatggatacttgggttgcttcccgattagctattgtgaataatgctgctatgaacatgggtgtacaaatatcgctttgatattctggtttcagttctttggggtatataccccgaagcacagttgtgggatcctatcttgtctcttgttttctctttgcttccatgttttttctcattgtttcgtgggaatactgatattatatattcaagtatttgttgattacatgcactgtacctgacttgtttaaagcctgatgtcttgagtactgtgcacccctgtgcctggctgagtagtggaggaactttgaaagggtctgttctggagagggggtgctgctctggagaggcggtgctgctttggagatggattaatcaggaacttgggtgctgattctaggaggtactgcatctagaaagatgggaggtggggagtgcaacttccccaattttgcctttaacttcagatccttggggtgggtgcattgcttctcctgggatggaggggtgccggggagcccctgaccaggacctggagcaggtccacacaggcactggatttgtcctttactttgggcccaggctgcactcttgattccacctcctcacactggcttcagctttctcaccctcagaatggaattcaaagcctctgcccctcccaggcagacaccaaggtatgattttcaagtggttggtgtcttgtgactggcagctgataaacgggtgatacagtgtttctatacaggagtctgcagtgccaggctgcaggggcggacgggagggggtcgtggtgggtagcctgtggagcctgagggtgggaacagagagacttcttttgctgtaggtggaagcctgtctggctcctttccctcaaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctgcagcgtccagccagggactgtgccgcaggggccagaagatatctgacctactgtcactgcctcttccactctgttccacctgcactggagcgatgctatccgatgaacagatccatttattaattcaacacgtttgtattgagagcctgctgggtgccgggcactattgtcaacatgggtaatacagcagcaagcaaaacaagagaaacatctttgcaagcaggggagggggcctgcagtgttgggtgtgtggagttgttgctgggaagtagagaagctgagtaagagctggacaaagaggccaggcacagtggctcacccctgtaatcccagcactttgggaggccgagtttggcagatcacttgaggtcaggagttcgagaccagcctggacaacatggggaaaccccgttcctactaaaaatacaaaaattagctgggtatggtggtgcatgcctgaaatcccagctacttgggaggctgaggcacgagaattgcttgaacccgggaggtggaggttacagtgagccaagatcacacaccattgtaccccagcctgaatgacaaagcaagactttgtctccaaaaaaaaaaaaaaaaaaaaaaaatagagaaaaggaaagctggatgaagagagatagccaagcccatgtctacggaaaagcattcttgactgagtgaacgaaagtacaaagcctcagaggagggagcatgcctaggtagccccctagacctggtgaggctggtgcgtggggcagcctccatggagaggagttgggcaaggagggaggaggtgctggccagtagagcacgtgtgtctctgtgcgtcagagcaaggacccgggctctccccgtaagtgagaagagtccatggaggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaagttcggcagggaagccagaggagtccgcagcccgggagacctggcctacagcggagagagtcagtccatgccagtggtgggatgtggctgcaaaaaatggtcggattcatggaagtctggtgtccatctggcaggcgttagtggtcccacgaatacagctgtgtgccttgaacacatactgcagagcttccagagagcaccagggctgtgggggctagagactgtgtctcgtgcggaagcgtggctgaggaggggcttgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtgggggttctggctgaagtagccagaattccagtgccagctccgctcctcacgagctgtacaacctgggccggttactgacccctttcccaccttagttccctggctctacaatggaggtaattatcgtgttgaactcacagggtcgagatcatatttaatacttgcacagcccttagaagcatctagcacagtggtcctcagcatttggaaatgtctggaaacattctgtcacacctggggagtgggatttccttctggtgtctagtgggtagaggccagagatgctgctaagcgtcccacaatacacaggacagaccccgcaacaatgaactgtctggcccccaaagttagtggggcagagattgcaggatcctgattccttttcttccttttttttttttttttttttgcccctggctatgagtaagagatcctggtttcgcacaaagtgaacgtgcagtacattgtttcagttgttaattcgccatgcaatacatcgttagtcacgtattattgtttgtcaaatgtgtataaaacatctgccacattcttggcagtttaatagaatctagagatataaagaagttcctgaccacagagttcatagcctcacaggcaagataggaaaacacagaattatataatacgaaattacattatatcatagagcatattctatagtaagttactccgattggcttttggtattaaaatgtcttcagtttcagaggtcccaggatagtgggcaatatttgaaagccagtaaatataaaataaaatatattacctgtgtgaaagagaatttttcaggcacaataatattttaaagagtttatttgtgtaagaagtgaattgggaaacagaaaaccgaaagaggtttagtggcccaatgacagtttcagaggcaggtgtttggagagtgaatgtaaaagcaaaatgaagaatttatttgatttaattggttgcaattacaaaattgctttgtttggtttaccttgttggaagtttcctagtcacataaccatatgttagttggctacttatgattggctgaagttttatttgtgtcaaacagaagcatttaccataaataaccccagttaagatttgattatgctgtcttttaagcaaggttaaggctgttgttaaggcctcattggttttgtttggtaaggaatttttcaggcctggtctccaaattttgctttaacaattccttgcttctggttattctctcagcaagctgatagtgtgactagatgacacagtattactctctgttaccaccaccaatgtagtcactgggacaaagagtcaggtagatgttgttgtcatcatcagtaggtaggttggggatgagaattccatggccacagttagcagttacatagtcagtgttgctttcctcaagttgaatgatcctcatggtaactgtttgatatttgagcagctgttggaaatcatttagaacccttgagagaatacaaggcaccaggggggtaaacataataattataaggagaataatagccaaggattgaaaaattcctctgagcaaagattcccaggagccaagacttaaccagctgagtgaatcaatggagaaggcagtgcccatctaatgaaaaacccatgtgtgttctttaaggtattttaagttttcggtaatacctgatttgttaacataaaaatgacactttttttttttgagatcgagtcttactctgtcgcccaggctggagtgtagtggcgcaatctcagctcactgtaaactccacctcccaggttcaagtgattctcctgcctcaacctcctgagtagctgggactacaggtgtgtaccaccacacccagctaatttttgtgtttttagtagagatgggatttcaccatgttggccatgctggtcttgaactcctgacctcaggtgatccacctgcctcagcctcccaaagtgctgggattacaggtgtgagccaccgtgcctggccaacaccttctttttttttttttttttttgagatacagtctcactctgtcttgcccaggctggagtgtgcagtggtgtgatcttggctcactgcagcctctacctcctgggttcaagtgattctcctgtctcagcctcctgagtagctgggaatacaggcgtgtgccaccacacccggctaattttgtatttttagtagagacagggtttcacccaggctggtctcagactcttgacctcaggtgatccacctctctcagcctcccaaagtgctgggattataggcgtgagccatgcgctcggccagcaacacctttctaccaattagggaacaaggtctccctttttgagcagttaaagtagcaagaagtcttctattgtacagtactactgaggccaattcattcatcccagattgtactgcttaagataattcgaagtgtcaattaaactttttcagaagttggtaaaatattaattgatttttttcaattcactcaactgagagaaacgggctcttacagaagtatgaaatccagaaccccttcgtaagactgtgtctgggatattatgattctcttttgtgaggggtcactttatgtacaaatgactctaaggatttgtatggcaattgaagagtcatatctagtcattttaggtagaagatagcccacaccacagatccagactggctaggtagaacacctttacatactttgttgctgcataaaatgaataattcggtgttatcgatagaaagggtcaaagtgcatcctattacccacgagttgggggtgatacgaatgtcatggttattctccgtcacatctgcgtctgcacagcgccacgttgaatggttatggtttcaattggagtaggaacaaaaaacatttctatgaatttgataaaatgactgtatgccatcatcaattagggatgattggttttctttttatttgagacggagtcttgctgtgtcactcaggctggagtcagtggtgcaatcttggctcactgcaacctctgcttcccgggttcatgcgattctcctgcctcagcctcccaagtagctgggactacaggcaccaccaccacgcccagctatttttttgtatttttagtagagacagggtttcaccgtgttagccaggatggtctcgatctcctgacctcgtgatccaccctcctcggccccccaaagggatgactggttttctttccaaatatgacctgagcattgatctgtccaataagcaagactgttatgtacattatgtagtggatctattgaggcatacgattttcctgtagcatttccattgaaccaatgtctagttctagtaagttctctgatgatatggttgaggctttcatggtcatgttcagattttatatatgtgtctcatgtaggaatctagtcttcataatctgtgtcaaacctaagaatttgagtacagagggattctggaacactgcccagatttggcccagttccattcatgttttctgtgcgtagagataagttaccattaatgacatcaatcgtagttgtaggccatccctttgcctctgttgcttcttccaagagctacactggttgatcataaatatcagccaactgccaagggaaggataccaacccttttcataacgccattttcctgaattgctcactcaagtgtgtatgggagcaggttctaatattagttgtgattctttccatttatctagaggattacgtagccaccaattgctttgcttagtagtgaggatggcttcatgttgagcagtagatcttagaggatattcagtgtggataatgaaattccctaacgaaaataaaagtgtgaaccttttgtgctaaaacaaaacaaaaacaagtctgagtcaatagaagggggccacatggagtcttgtttcattgtcttgggaaagctgtgtctatttcatgatatcatctacttttatggaaggatttctcttgggtatccttaattttgtttttatattattattattattattgagacggagtttctctcttgttgcccaggctgcagtgcagtggcacgatcttggctcactgcaacctccacctcccgggttcaagtaattctcctgcctcatcctcctgagtaactgagattacaggaatctgccaccacacctggctaatttttgtatttttagtagagatggggtttcaccacgttggccaggctggtctcaaactcctgaccttaggcgatccaaccaccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaagctgaggcgggcggatcacctgaggtcaggagtttgagaccatcctggccaacatggtgaaaccccatctctactaaaaatacaaaaattagccgggcatggtgacacatgcctgtaatcccagctacttggaaggctgaggcaggagaatcgcttaaacccatgaggtagaggttgcagtgtgccgagattgtgccaccgcactccagcctgggtgacacagcgagactgtatcaaaaaaaaaaaaaaaagatccagtttccagattccaggtcacgtaaggtgggatcatcaataggcaggtcacagaaagcctccttcacctggtgggatatactttggcatcatacatcaagaccttgcagtattgagtcacatcagagccaccagtagagtggataaatgaagttctgttatgaaaggcacaagtcgttcagtatttattttgtgaagggccactttatgtgttcccctaggggctgatgttcttgccataaaggtcggtgataattcttttggccaaggtaattcagttgactctgttaatttagctaattttagttttgtgataccatttctgcattcagcctttccagaagagagagtgatgagggcaatgatagtgccgtcaggtctgtaaactcttatttggtggataacctgtcaaataaagcgaattgccctagcactagagacctcctcggcaggtaggtgggatttcatctttctggagcctgagcatctccaaagaagagctgccgcatggagcttccctgactggtgacctccaccctcttctctccagagctctttgacccagaggaatctgcaggaatggagggagttggccaaagtagggagatttttactcagaccatatccaggtgagcacacaacagccttttgggcttgggctgatgcgtgcatttctgtctgtacatgcgtgcctggaagtgtgcagatgagtgtgtgagagagggtaatggccatgcatccttgcatagacaagaacatggggtgcacttctgcatgtgcacagcccctccccaacccgggcctgtggtgctgtcctgcccctagcccagagctggcctctgttggctttgagaccctagctttgcactgtggctttgctcggccttagagaccagctgctcccctgctgtggtctctcatagtggagactgatccctggccacccattcagctgcctgagggccctgggaccagtgttcatccccccacctcccaaaacagaggtgtgtaggggttccctgcctggagtcccaaccctgcaggatggagaaaatgggcaccagttactgtgacccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtattgggctggacttgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctcccagcccactcatccagggatgcagctctggccttggcccacccccatcagagggcctgtggccctgatcaccgcactccccactctgtgaccagacgttctctcctgagcatcgctgaccctgcagctgtccaaatagagcaagaagcgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcttggtgttggggcctcacagatgatggagaagccagagttcaggcacttggcatgacccctggcatcgccttcagttgatttagtgtctctgccctggggtattccatgggaccctgggctggcttctgtgtgcagaggtgggtgtgggccatagcccagacctgttgaaccagttgtaggctctggaatcctctgtccccaggcagtcaccaggccttgacaggcgggaatctgtccctctcatcacccccccagttatgggtgcagatgaccctgaaattgctaaagcctcagggcttgagcccagaaagtgtgagcaggctggcggggcagctggaggaaggccttgcaggttcctggatttgggtgccgggtgggctgagaggacagtccctgtcactgggactgggcacaggtgcagagaggctgagacaggcccagaggacagtgagtgtgtgttgtgtgggtgccaggccagggagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctctgggctgcctggtgacagcttcggggacctgcaagctgacagagtctccaggagccagagctggggtgggaggaacccactgggcctgagggaggtagagcagcagcagcagcagctgagcccagcccccggccagccctgaggaatgggggaaaagagtgccctggcttgggggggccctcaagccccggaagctgtatgtgggcatggggggcgggggcagagaggaggaggactgagaagtgggtgtatttgggcaggtgtgtgtgtgtgaccaagcttgcgggcgcctgagtatggactagtgtgtttgtgctggaggagcctgtgtaggttactgacatgggagggccggtgtgagctgcagggaccggagagctgctggaaggggctgtctatgccttcaggctctgagtgtggatgcagctgggcctgttcaggcagattcaccagaggggctactgcgcagagcctgggccctggacacctagaagggcccctcctcccctcgtcttccctccctcatggcccacctttactctgagggggtgggcttcctgcgggggacaaactggagagggactctcttgccgccttctctgttcctggggacaggctgctgcagggtggagggcttgcttttcctgcccaccctcatctttgccgagtcctcgtctgggggccctgccccactctcccttcccaatgcagggccctctcctctggcgagcctgccttgatactccccggctcaacccctttaaccctgctggctcctaatgggactaatgggatttcaggtgtggacccttggaccctccgc

SEQ ID NO: 897 - DNA, 67264 bp, Homo sapiens
tatgtagggctcatattcttcatgactttagttgtcgtttttaggtctgttaaatgggcaaataaaagatgcttccgacagaaaaaagttgaactggctggctaatttgtagctgtattcatcaattatatggttgttttaatgtattaaaatgatacaattctagaaattaggtgaatttgcttctgaattaaaaatcagttgaaccttggcattcactctccacttagctctgaaattgtgtcataatctatcaagcaagtccacaccagcttgggaaatcttgcatgaattaggctagtaagtgttaccttaggtatgtcttgagaggctgactgagtaaacttgtcatctcagtcctttcccttatcaggctaaattccatcgtgcagagacttgcttgggccccatgagagattatgcccatccagcagtcgggggtgctccaatgggcctgtgctctggggaacgcttgggaagccctattggtcagtgtcatggatcaaaaagccctatcttcatatcggtgaaaggtgtccttgtcaaatagagcaactcagttttatccttgttggttctgtcactgatggtggggctaagagtccttcactgatactgaaaactcaaaattatagctggagtgatggggactttctctacccagcgtatatgcaaagaacattcacttgagcctgttttctgttgtaaattaagactcaaagatagccagaagagcagaggtacctgagtaataaatttctttaaaaataaggaattgcataaaagtgcctctacagggtctgattcctgcccttgtctctgttcagatgctcagttacgagcaataaggtagctattgtttaggtttccagggttcgagcactgaagggaaggtatagaagaaaccacctctttttcagccctgaggtcttaagtagatgcctcactggtgctgaagctgccaataaattgctgtattagcgtgggctgacatggttgatgaatattgtgtaaggaagattgcccactgtaatctaaccaagtgaagtcttggcagatagcagcaccctgcacttagagaatgccacaaaacaaattgagtccatcctgcaggtcctgagctgggttttcttcctagagcacagtgcatctgatcccaaagagaactccctctgtaattttgtttcagttcctccaactcctctgccaaccaatgatgttgatgtgtatttcgagacctctgcagatgataatgagcatgctcgcttccagaaggctaaggagcagctggagattcggcaccgcaaccgaatggacagggtaaaccttgacaatttcttcatcttcatggtacttggctttgggtagcatggttctcatagctgaagaaaagtaatagcttctccctagattgtcatgctgatgtataaggactggtgagtcaggagagagttaccagtggagctgccttctgggtggacttcttcaccacctgcatccagataatatataatataattatcctctgagcacttcctataccattatctgccctttttttttttttttttgccattaacttgctttaaaatttctttattttaaagaaggaaactttatatcactgttatcaataaaaagctagtaccatttgccgtgagaagaaagtgaccaaccatacaaatatattagatgaaagcaaacatgtactaatacatgctagctagatactgctgtctctggaaggttctgagtctcagagatgtttcttttcctttaaaagggttataagagagcagcaggaacaccaaagtgcaacttttcttctggatttactcaggattgaagagaattgaaaagggaatgccttgctaggcctaagctccaccccaaatcccacacagtcccatgttgggcttacagtttgcaaaatgcttattgttttatccacatcagctctgaaaagtaggtattaacctcaatttttttggtgaggagactaaggcacagagacttttaaataacttactcaaggttatgtaacaaagaggtcatggaattgaggctccatctggggatagttgaggcctggaaccttctgaggcagtaacaatgctaagctcctaagagattgtgtgattggtttccttttgcagtttcctgtgagatttagcatctgacagtgtttttagcaaatggaggagttgtttcggggtattaatcactgctgacggcgtttttgacctttgttctaggtaaagaaggaatgggaagaggcagagcttcaagctaagaacctccccaaagcagagaggcagactctgattcaggtaagatgccttctctggggacatagctttcagcctgaccattggaaaatacggtcagagccccattcccaacgaaattaggattggacaccacctccttttaggtgagggcttacaaggaagttgtaactggcctgtttttctttttcacctcaagtattgctaacctatggtagaaggaaaccaaacccccaccagagcacacctaattcatgccagaaggtaaccttagctcagctgcctttcgttaattctgctttcctggcaaaagtcctctgccattttcagtcttagactgtgacttgtttttcagcagtactgaattttttttaagactaattgaaagtcaaaggatagaaaataaagatctctgatacaattcatctctaactttgtagactataactaaaatcatagcagcaaactgcattccccttcagtagaagagtgttgctaggaatagggatagcaatttccaggactgatttggtttttacaaaactgattttgtaaattttaaatcattttatgtttagctgaaatgcctttcctcctaatgtaacactttaataaagtgttaaaaataatcttaaaaggcttttttattgatcacttagaaaatctaacagttttaattcctacagaagtcagtgcatcttgttcagggaaatgtagttcagcaggcttaaactgtacctgtaaacctggctggatacctcacggataacttgcccttcatgactttattgatagtaatggcaaaaatcacaattacttttgcactaacctaatgacaggaatacttcaacagaacttaccacataactcccattggtcagtggtctcagagtttggaagttagtgccttgctgcaatgtgggaaggacagtgttctttttttatagtgcatattgagaaaccaggccttgggcttgcaggcactagcacttgtagttacacagatactaaggaggccctttgacactgaggtttaacttgctctctttaaagaaggaagtaattctcctgatagaagtagaatgaaggtaggatgaagtagactttggatcttacccttgctccactctccgaacctgttactgtctcgcatgggcactgacaggagaagcactggggtctcagggtgcttgcttaggcttcctctgggtgccacaaatcatgtgtggttcctgctttcttggtttagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacgggtgagtcctgcccctagcactgcctgccctgaggtggtatatgtaggggaccaatgtatgacactcaggtcagtaaaagtgacatttgtatgacaagttctggcaaagctgaagctaaggaaagatgatgagggaggaaaaggtattacattctaatatctgtgtatataagctaagcatgacatcgctttatgcctgcgtataccacctgtgatgtgaaagtgttttacgctggaaaagtataacctcgcgaaattgatgggtaattatccagttattgaacttcctttcaaagaatgaaaacatgctattcatgaagacttttgaacaagttacattataaataagattatgaagaaaggggtaaagtaatttcttctgaaactcttgtgtgagtggtctcaaatgattttgtcccttaacactaacctgccttgctttgggggatggaaagtattgggaggatatttgtgtccttaagtaagccggttaaagtcttctctctttgggtgacacaggagactatctagcttataggtgtcagaggctgagccaggaaaaaggacagatcagaagagaacgggagtgggcaggagattctggaaaatactgtatgttaaggagccagtataactttggaacttagttttgctattttacctagacagtttttttgttacttggtaagctaaaaaagccttccagttacagctttcattcttgtgcctagctgagctttacattcttaagtgaactttttaagcttttgttttcctgcctattttcaattctctagtctctggatattaaaacaactgttctctcttgcagcctcatcgcattctccaggccttacggcgttatgtccgtgctgagaacaaagatcgcttacataccatccgtcattaccagcatgtgttggctgttgacccagaaaaggcggcccagatgaaatcccaggtacagtagatgtagtagaaattgctgccgtgagggcatttccagtggggaacataatgccttgactaatggttgaccagcactgctagttgcatttgctactagtccttagaaaatgagttttgatttccgaagacattcggtacgtgaactggtttttgcaaggtcactgtttttaaaacatctttttaaatacttttttatattaactgctttatacttaaacaatttctgaattttttatatcatttatttctgatttagggtattgccagaaccaatattcaagatccttttctaggtatatttatcaagcagatcttaaaaattggtctcttgttttgtgcagtatagtttttgtttagacagacacttttacattcctaggttttgtccagctttactttcatctacagaggtttgtttctggttcctacttctaatattggtgttgttcatatattaacttgagttttacttttttgtattcataaaaatgagcttgcctacaagactgctagcttccgtttaaaccaggaagtctcctagctcagccttagttttcctagagggccttatagtaacaacgctgatcttacttgatttcctctcatattgtaaatacagtgctgtgctgattgtgagtgtcagggtacatgggctcacttactgcacgggtgctggcctgtcagcccagaaaccctccttccccacagctgctatgagtgtgaagatgaaaaggtaatgtgcctaaaggcctaaaggcctttggagtattggagctgagctgctccatttgtggagctgggggtctgtctcagtgccagactccacactggcattcagtgctgccgggttgactcccttgagtgcccttgagcagctcacacgctagtgtagagataataactgtaaaggtgaagagcaggtgtttttttgtctgtttgtttgagatggagtcccactctgtcactcaggctgggttgcaatggcaccatctcagctcactgcaacttctgcctcccgggttcaaatgattctcttgcttcagcctcccaagtagctgggattacaggtgcccaccacagtacctggttaagttttgtagtttcagtagagacggggtttcaccatattggccaggctggtcttgggctcctggcctcaggtaatccgcccacctctgcctcccaaagttctaggattacaggtgtgagccaccactcccagcctagagcaggtgttcttagatatacagagttcacttcagaagctggttgttttggggaataaaagaactcaggcttctaaagagtgggaagaacgtggaaaggggctgggttggagaccctaaggggcatctggtgtgggcctggagctcaggactttgcttcacgctggatgtagcagaagaggagaaagtccaagaggcctggatggaaaacgcatgcatcttgacagggcctaggctcttggggtctacttgattttttgaaaagacttaatcactttccaaactttctggtttaaaattaaattatcgtgttgtattctagccagttttgtgtgagagtagaagggaaggagagattttgatcagtatattaaattaatagagaattcctgcaagtgagatcaagcttccacaccaagtaatgtgggaagtagaatgctcccatttaaacacctttggggagaaaacccagctctcctgtctgctacttactacctgctcttagctttaattctggcaaagcttaccttctgccttgttccctattctgttatctaaacaccagaaaaatttgcagatattcagcctgttgtaacttgtgccatgtctgcttgtctggatatgagtgagatggtgcttttacccccatactatagccaatggtttgctgtagagacactaatttgcagtctcccgctctgtggttcttgtcctctgtgagtgtatgaaccttcctgtctcacacggctcccggttcctctgggaggtgtagcaggacaacacttgctgaacccgtgggtgttgcattttggcttcatttgcattttttcttcaaggcactcactcttgtgctttccttgattgacagaatggcaaatataaaattaaattgctttcatccttgctttgaaaggtcagagagatgtcagtctacaataaaagcatctttccatttagctttttttttcattttgatccttcatgttaatggcttcaggcccacataattaatccactggtttccagcaccctctttaggaaaagcttggtaattgcaggtctaaccaggcggggatgacttagcttgaaaagcttgtgggagctacagcaacacacctcgccgtgtcattggggtggatgctagcccgtcacctttcacttccatcctggaaaactgtaaaaatagtgaccacttctaatggcctttttttttttttttaaataatgaataaccttagaacttttgcattcagaaaaggcagtgagctacggtagatgagtcttcctttatcacccccttaaaatcaggtttatttatacctcagcatgagtttttcaaaaaatagcaatttagttaaataggaataaactaattctttatttaccacaataatcatttaagcaattgcttcactaagcaaaatccataatggttccctctgttgccaagtctgcttttcagccagtaatttcagtcttttttaatcccatctaatctgaccagtggtagaaatcaactgactcttctttcactcagcaaaaccttactgaacattcggcattgtacaaattagagttcttttttttttttttggctcaatataattagtagtaagtgccttgtatgaaaatccagtagctagtggccatttttaaataaattgtctcttaatttggagcactttccagataaattctcatgtcagctgggggaattatacagtctttttttttttttttaagacaggatcttgctctgttgcctaggttggagtgcagtagcacagtcatagctcactgtagcctaaacctcctgggctccagtgatcctccagccttagcctcccaggtagccgtgactgcaggcacacagtactatgcctggctaatttttgtatttttggtggagacagggtttcatcatgttgaccaggctggtctcaaactccttcgctcaagtgatcctgctgtctcaccctcccaaagtgctggaattacaggtgtgagccaccacgcccaggctgaacacgttcttatactttagcagtcagtaaatatggcgtgaggattaatacatttcccctgaccagttgctttgctagactctgtagagaatatgctttgtaaagtggtttttccagaagttgtgtcgatgttccagctgcaagttccctcctggcctagttgttttcagtcacaacacctctccaccataactctgcttccaggtgatgacacatctccacgtgattgaagaaaggaggaaccaaagcctctctctgctctacaaagtaccttatgtagcccaagaaattcaagaggaaattggtgggtaccagctctttgtgtcaaggtcatacgggacttcttgcagaggctcaggagtgaaagctgggcaagagtagagagagatgagcaagcaaggccggtgaagtggggcattagcacatcctggcttcagaagcctggagtccactggagctttcatggcaaggtgaaggaggaaccaaggacaggtgcactggctgtgagccatggagcctcgggcttcactgaccttcactctgttagcggaagaatatctggggtgtgaaattgcaagagactacgagtttcctgttcccgttttcctccttcgttctgattatttcaagcacctgattttatataaattctcacctcctcctctcccggtctttatcttcttcatttattcaacaagttttattatggctgctgcgtgcgtgtcacagagtaaaatggtccacgagcagatggtacctgctggagttgatgtgttgataagagaaaaacagatagtaaaacaagaaaataagtgtcagctggtgataggtgctgtgcagtgtgaaaactcgggcagagtgctagagagtggccagtcggggcggctgcctctggggacggtggcctgagatccgaatggtaagatcacagcgggagagcacgttggtagcagagggagcggcagctacaaaggccccaggtggaagtcaggcatcacatttgagtagatcagtgtggctacaacatagcaaaggggatgtggccaaagtatgcagggaccagatgaggaagaaatttcagcaaaatcaaggagtttggattttattctaggataatgggaagccgttagaggattttcagctagggaaagactagatctggattatgaatttttaaaagctcacttggctgctgtgtgtagtcgattaaaattagaaaccagccaggaagcgattttagaaattcaggagagagctgttgggagtatgcactgaaggggtgacggggtaggagaaggagcaccccagggacagctggggatggtctgtaggatgtgttctggtgggagtgtgtggggctgcgcccagggctgcgtgtggggttgggggagcggcatcaagaagtgcacttagggttccactgggagcagctcggggatggtggtaccatggctgactgaggtggagaaggaaatccggagctctcttgatacatgttaagatagaaatttctgttggatgttatgtggggatgtaggatttaggtgaggcagaggtcaggcagtaggtccaggattcgggcctgggagtcatggtatatggtcagtatttaaaactggcgtcggggagaagtaggtcagagggtatgaagtggtagttgtagttacgtggggtggatacgtctagagatgggatggacagcatgaggactgtagttagtaatatcgtactatatactaaaaatttgccgagagtagatttgaggtattcttatttttaaaaaaaagtaattctggaaggtgatgtgtgtgtttgcttgactatggaaatcatttcatggtgtatatgtatatcaaagcattatattttagaccttaaatatgtacaattttttaaacccccaaaatctgtggagttgtggataccacttaactggagtgtggaggtggatgcaggggtgcctgggacggcgccctggggtccctggtgttggggctctgtggtgccacagaatcaaggaaggtgtttcaggcaggaactgggagccacagtggggtcttggagctctagagcatcctgtgcctggacaccaggcccttctgaagcctgctttctgtcccctgccctgtcttcatcagatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggtgtgtatgggcgacggtgccacttctgggcagcagggggaggacaaaatgagagaattgaagtcagtttttcgaaaaccaaattgagttgggagatggtgttcctgcgagagtcaggggaagggagactggattcattgagcgcctactgtgtgcaaggaccctgctagatgctttcaaatcattggtgtcaatgtcaccatgaagttaagactaattctcccatttcaagatgggtggcttcaaacccccacttcttccaacttgtgcacttccttacatgggggaggcacttggcagttgaaacagcgccttcctgttatggtgttacctttgcccagccgtcttgggaggtaggtgctggagaggctgaggaggtgacagggctggcgtgggtcatatctctgacatgaggtggggataagaagctgttcctctgggtcctaggcagacgttctttcctctattcccctgctggttctcagtgtctaagaggatctctaaaagctgtgagtctgctccagaaataaacaagttgctgagaccagtgccctgagagccgtccccctcatcagttctgtttgttgctgttgctgctgacagggtaatgataagaatggcccacagctatgccgtagtccttgttatatgccagctttagctaagcatctcagcggatgctctccatcctcacagtaaccctcgcaggtgggtagtcgagtgtccccatgtggggattctgaggtataaagagattaagtaacttgcccgaggtcatgtagcttataagtggagagtcaggggtcgaatccaagctgatctggtcctgcagtcacagacctgactggatatagcactggaacagaggcctcaggaaggcatcaaattaggggtggggggatggaggtacatccagcttagccttcagaccttaatggaaatgctttctaaactagcgatcccagagcagttgactctccagaaataaaacaggatctgaggaagtggcagatagatgaaaaggcgccatgccacccgcaaatctccgtgggtttttggggtggtagatgaagaggcaccatgctatccccaaatctctgtgggtttgtcgggtggccatgcttggacaacttcttatgtgcttgttgggggtcggggcagcttggatatacctgaactaggaccttatctccctgtcagcaaaccacaaccaacacttaacttcaattttcacttttttctaagaaaaataattatgtgggctaagctaaatagtgcaggcatctcccagtttccctaaaaaggcacaagacagacctacttttttctctcttatcaaggataccctccagtgatttgctgtggctcatactgctggtttgtttatgggatatttcaggcagggtgtttttaaggaggaatactttttgttcacattatagagaaattctaagatagaaattttaaaagaagccattttcttttttaatctccttttgtgctattttattttgttttttattgttttcctttctgctagacactcagccggagttgtaccacccaatgaaaaaaggttggtttgtccaagatgttccctttaagaccttcattcctctccactccctagtgtgtccgaagcttcatgttctgtttcatgccatcacctggctttccccacctcattccttctgacacggctgtgagtggggtcagagcagccccacctccatgttgctgacaagctgacctgactccagcactctgaggccagtttccatggtgttggttacctcgtggtcatgctaagctttccctctgggatgtcagagaatgcacagcaaccaaaatagatttcatgacccttttaatctgggtagatttttagaagtatatccaacttaggttggttgtgaactgctgtctccgtataaatatgccttatttacagtcaggtggagagtcgttctcttttccctctttttctctgcaattcccatttacatcttttctttttggctctcctcgccctttgtctgtgccagttgtctcatgtcccctgagttgtatattcctcagaacatcggaagccaatggatcaaacagctggagacaacccagctcactgtactgagtctccagttttcaaaaagagttaacgttccgtaaagcactatgtggaatgctttgcattcttgtccccatcttagtccactgaacgtccctgtaggatgagtagtgtttttagctctattttctagattagacaattgaagaagtttctgagatgacgtgacttgctctaagaagtggaggaaccaggatttgaacccagttctctgttccccaagcccatgtgatttcattacctgagttgtcggtgtcacgggatcccccaggtgggtgggtggcccagtcattgtgaatcatttcaacatttcttgttcataatgtgttgtatgagcccacccttggctttggcagacttcctgttgatgggccaaacggtgttgcccggctaagaaggtggtgttctggtttacgccacaggttattctcagaacacaaaagtgtgatttcaatcttctgaaaatgacttcgtgtagatgctttattttattctacttggatatgcctgttcgtggggatgactgtgccgacattcctttcaacagcacaactgagatgtttatagagaaagatgagttttctagaagtttaactggcttttgcttttgtactgaactgttatgagttgggacaatttaaacattaactttggtgtcttgaagtcacttgtttatgttaagaaacgtgggggctataccaccaaaaatctattataacagtctggactggtggtaggttttttttttttttttttttttttgagatggggtcttgctgttgcccaggctggagtgcagtggtgcggtcttggctcactgcagcctcctcctctggggctcaagcagtcctcctacctcagcctcccaagtaggtgggaccacaggtgcatgccaccaccctcggctaaatttttttttttttttttttttttaacgtagagacagggttttgccatgttgcccaggctggtctcgaactcctggactcaagtgatcctcccaccttggcctcccaaaatgctgggattataggcatgagccactgtatccagtgacagtagacctttagtttgctcagtgccacattgctttttgaataattcctgcctgtgtgacctttaaaattctgggagagagaaacatatatatggaaggagctcagaattacagttgattgggcttggtcataagcatccttgctgaggcaatacccttccagatccctctttctcaaatagttggagtgcagtattgctatttcatgggcactttgagacaaaagctagctctgatttaactagaatctagtcgtgcaagtctttaaagttgaagctttagaaaaattgcatcatttttggctgcattgcatgagctagcctgcatgttcagcagctgtggaagctgttacaagttgctatgtgttaagaacaagtctagttgtgaggcagaagctctgctgtggttgtgccttgtgccattacctgcctttgacaagcccagggacagcagtgctttgcatgtcctcatgttgaagtctcacttgcaggtagttaccttagaatgccagatacgctgtcgggttgatccagttataaaaggctcatatcacagacgtttatattgaactgtatgttattatgaataaggaattcttatgatagctagaaatcacatgctttggaactaaaaatagaggacttcctctcacgttccctccctgggcctgtgctgcgtcgtcgtgctgcgtatttggatactatccttcggagcgccacactcgagtgatgttgctcaggcagtgtctgaccttggtgagaggagagttgctgttcttgctgctctgtttagagaaaggtgccttccatgctgatattagaatgcttcctataggtggaatgcacgcttcctgtttatcttctaatagccacttaggatatgagcatctaggatctcggcacagagggattcagcgtggtgggagatgcgggaagaaatccgtaatgacagactgttgtcattactgttggaacctccccaggaccaactgaaacttgaagggaaaataagagtttaggttggggagggtatttgaggcagaatgaattccctgtgggctaacctactatgtccaaggcaaacgtgcaggttattgtgaggatgggtgctgtggcagccgggtgtgggtagtaggtgctcagtaatttctcctacgatggtgtgtatttcccatgctaggatgcccctcggctccgcttctatgtgtcttacaataaacattttctctgaaggcttgcatttcattttcccaagttggagacaagtaagcactccctcctcctccattatacccattggtctctgcaaatgcctgtctcattcatctttagagagcacagggcaccctcagacttgtgaacatggtggcagatgagtcgcgtggggaggtgcgtgttgaggggctcactggccctcaggagggagtttgctgcttctgtgcaatgggtgtgagatgggccatccttgggaactcagccatgatctctctccacacaggatctggagtgggagagcaggatgggggactgatcggtgccgaagagaaagtgattaacagtaagaataaagtggatgaaaacatggtgagcctgttctttcttctgcccaacacgctttacttttgagactcattagagcgagtgacctgatgtcagatgcttccaggtgcacgtctctgtgttcgttttccgcacagtagaaggttggagggctccaacggctcccacagactggctgtggtgtttagcatctgggtatgaaaaggattaaaaagcccttttcagcagtagctcatctcttgctatagagtaggaaaatatatttacaactaaagatatgaataacctgttagaggccattttcaagtgagtagagagttaataacttggattagagttgggttttgttcttatactgccttaggtttatacccccttttattcacctagtattttctgtcatttatagttctggattatcttcaactgagtttgatatttcaatgtggctttttttttttttttgaaatggagtcttgctttgtcaccgaggctggagtgcagtggcatgatctctgctcactgcaagctccacctcccgggttcacgccattctcctgcctcagcctcccaagtagctgggactacaggcgtccgccaccacgcctggctaattttttgtatttttagtagagacgaggtttcactgtgttagccaggatggtctcgatctcctgaccttgtgatccacctgcctcggcctcccaaagtgctgggattacaggcgtgagccaccgcgcctggtgtaaacggggctttttggcagtctgttctgagatacgtctccacaacggttacttgaaggaaaatgcatacgggaccagctgccataatatagtcttccctccatacctgccccttcattaggggtttggggagtggatttggaaggctgtgacagaactggttggttaatgggggtcccacaggtacctgcttccttccatcaagcagcaggtagcagaggaaggaggcagtaaataccaaactccccgttcacccagttgcttgctgccgacattctcatgactgtttcaggtcattgacgagactctggatgttaaggaaatgattttcaatgccgagagagttggaggcctcgaggaagagcgggtacgtgtttagctccagaacctaaggtttcctgccaatcttaggtatttctcctctggaccttctcagttcaagtagaaaacgggagagatgcctgagctaataagggtccctcatccccagctttccgtacttttggataagaaagctaaaattaaaatctccatggagattgggaagagtgggcgttctccacctgtgggtggttccctgcaaagcaggatcttggtgctactttgggttttaggggctcgaccttccaggagcgtggccctcagtgagttacttgcctcacggctgccagatggtcactgggacttttttccacgtctgctttattacgtaggaatccgtgggcccactgcgggaggacttcagtctgagtagcagtgctctcattggcctgctggtcatcgcagtggccattgccacggtcatcgtcatcagcctggtgatgctgaggaagaggcagtatggcaccatcagccacgggatcgtggaggtgaggagctgggctgctgagggcctgctctgcactgtgggctgggttgggggtgggaacctgtggaattaataggcatcttcactcctcgagtactggacatgctgctgttatcagttcagttactcactggattcctaggtcgtgtttttggaaatcagcccctgccacaaggggctgttgccaactttcaacattagtttgggccttggctatgaatgtcagaaagtcatgtgaacattttatgctacagagggtgaaaactcttttctcagattatttccttagtgttcctttttccaggtatttttttttttaatgggggaaaggagcaacaggaaatttagaaagtgctgaagcagactgtttctgttctgtcttctgctggttactgaacttgtcttgccactcactccttagtgaacagtgggaatgtccagagtcccttgatccccaaatataaatacagtaaggaccttaatgagccctgggaaattagtgcagatgctggtcttagttatttgtgtttttttgtttgttttggttttttggttttttggagacagtctcgctgtgtcgcccaggctggagtgcagtggcgcgatctcagcgcactgcaacctctgtctcccgggttcaggtgattcttgtgcctcagcctcccacctagctgagactacaggtgtgtgccaccacgcccagctagtctttgtatttttattagagataggatttccccatattgaccagggtgatctcaaatcctgacctcaagtgatccacccgcctcagcctcccaaagtgctgggattacaagcatgagctactgcacctggccagttacttggttttatctcctgctggagactggcctagctgtagaatttcagaactgaaaaagaccagagatcccctggtcccaccgtctgcttgctagcctactgctgactggcttgccttggctggcccaggtagtaagcagtggcgccgagccttgcttgtcaccacggtgctaggaaatccagttgactgtcatcttccgtgagggctaagctttcagggctctcgtttcgaaagcattgcctctttgatccccttattttctttctcctgtgtttcaccaccggttctcatttggcctgtccggtgggaacgggctgctggctgcatttggtcctcaggggattgtgcagcaaatggctcaggtctcccagcaccctgtgcaggtctcttcccagacaccacaatgaccctcaggttttgttcttccaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaccgagactgctcgtttcactgactgcggcattgatctgcgtgatggtcctacccccttcctccaggagggtgataacttcgttccacgaaggaccccagctgcacctcacaggcggaaatacgtctgctcaagctgtgactcaaggcttccagcgccgtttcgcatttagaaagcaaagtaagagggaacatctgcacagagcatttgtctggcaaaatttaggctactgatatttattaatatgagacttcttaatgctactgggaacaatgagtagggcttgtggctgaattttcagaggaatgcttgcagcttccatttgcttaaataacctgacactgggaggccctgtcacctcactgatgggggtgtttggtttgttgccttggcaactgcttagagggctttctgcctgggcccagttttatctactgagctaagatctttttaatgcccagctacagggaagagggtcaattcaggggtaaatctcagtccctaccctagtttaatgccagtttaaatatacagagtagttatcaaggtaatgtcatatatagctgtgtgtagatgtacatgtgtgtacatacgtgacgaatcttccctaggatactggactagggagtgttttatgagccaggaaagcattttgtgagccaggtgaacaggttggttctttataatgattaccacttccccatcagcctctcccttctgcctgcattggtcactgaagttgctgccaggaaagccctgaagaagagggaacttttttgttttttgaaaccagtttctgctggagtgctctgaagagtgttatcacctgaccctctgtagtatcagctggaaactgatctcagggtcattctgatttcaaagctaacagaccagcttcattgattttagtgcctgccatgtactagctgcctccaagtcagaggcgcatttttgtctttttttctttttttttgagacagagtctgttgcccaggctggagtgcaggggcgcgatctcagctcactgcaacctctgcctcataggttcaagcaattctgtctcagcctcccgagtagctgggactacaggcgtgcaccaccatgcctggctaatttttttttgtatttttggtagagacagggtttcaccacgttggccaggctggtctcgaactcctgacctcatgatccactcgcctcggcctctcaatgtgctgggattacaggcgtgagccaccatgcccagctccatttagtcttaaccttttgaggcattcccctcttccagaaatgacgctgaggtcttccacggagcagtaaggggtggagcagagatgcaaacccagctcggtgggagttcttcctttattcagtgtacttcagtcctgggggaggcaggggcgggggcatggcagccaatacccatccagctgctcagctctcgagtctcttacctgttactcacattcctgttgctgatgggttagagaggagtttggggctggtgaaagtgcagtggtttctatttacacgttcattacccaaatggggtcattgcagagacagtcggggttagctgagaactggggaggcctgagagatgacgtggaaatgaatgagaggcagggctgccaggcggcctcaccctaggcaggctccactctgctccctggtggctcacccacctcccgggaactgagagaagctcctggtttctgccttggtgactcagccttgacctctggggaatgtggccctgcccaccttgcggccagcctcaggtgctggtgctgacaggtgcgaaggtcctcctacctgcctgtctgctttcagttgcaaatcagagctcagcagctgaggtttgagccaggacatcagatgccctgatctctggtttctgttgctgtgacaactgacaaagctctttaggaggtacagatgaggatgtaatgagtccctaagttttggagaggcccaagggtccactatcataggagcaggtgaaaaagtatttaaaaaaggaacatgctgtcttgcggtactttgaagtcatggacatagacagaatggatacagggaactggaagggaccttatgactcctgattatttcacagctgaaacatggccacagggtcacacgctgttaggggcagagccaaatgctgtggttatgtacaatggactcttttctggggcaaagggtaaagcggtccttataagacaaggaaatgggtgtcagctggtatctttcctgttaccgcctatgaaataaggggaagtcgtgtctgttctgccctctgtggttgcatacttttgacaggcagtagcaaccatggacttggttagtgcatttccactgtggagcagcccagatacccagagaatgtgacaggagacatgagttcccccgcccccggcccccagaatccttgaaatggatgggacatgacttttttttttttttttttgagacagagtctcactctgtcgcccaggctggagtgcagtggcgcaatcttggctcactgcaacctccacctcccgggttcaagcaatttctcctgcttcagcctcctgagtagctgggactacaagcgcgtgccacgacacctgactaattttttgtatttttagtagagatggagtttcaccgtattagccaggatggtctcaatctcctgactttgtgatctgcccgcctcggcatcccaaagtgctgggattacaggtgtgagccaccgcgcctggctgggggcatgacattcttgaggaatctgtcagagatctgtggccaagatacaagataacccagatctgattgattttttttttttttttttgagacggaaccttgctctgttgcccaggctggagtacagtgacggctcactgcaacctcagcctcccgggttcaagtgattctcgtgcctcagcctccagagtagctgggattacaggcgtgcaccaccacacctggctaatttttgtgttttttagtagagacaaggtttcaccatgttggccaggctggtctggaactgctgacctcaagtgatccacccacctcagctttgcaagtgctgggattaaggcataaaccactgtgcccagcttggttgaacttaaaattttgaagtccctgcctctttccgattagagcagtgccctccatcaataaaacatttatagtgtgtactatatatacagttattttaaactatgtatagttattttaaaattatctgcatgtattataaatagaaacttggaaggcataaaaaagatgaaatactttttccaaattttatttaataacagtacaaagccttttgggtccagtcaaatattgctagttttagtgcaggcaaagtgattgctttcattctctccttcctctctcctaatggaagtccatatcgttgattcagattttcttagtgtttacctactgtcttctattttttttttcttttttttctgagacggagtttagctcttgttgccgaggctggagtgcaatggtgcaatctcggctcaccacaacctccgcctcccgggttcaaacgattctcctgcttcagcctcccgagtagctgggattacagacatgcgccaccaggcctggctaattttgtatttttagtagagacggggtttctccatgttggtcaggctggtctacaaagtcctgacctcaggtgatccacctgcctcagcctcccaaagtgctgggattacaggtgtgagccactgcgcccagccctgtcttctgtcttctcccaataaatgacattgtatttaggcttctctggacagtgaagctttctcagactttccttgttttgatgatcttgacagttttgaggagttattggtcaggcatttcgtaggatgtcccactatggggttttgtctgatgtttttctcatggtaatgcatgggttatgtgttattaggaggaagaccacagaggtaaggtgtcctcctattccatcaagggtacacactgtcaacatgacttactgctgtcgatgttgaccttgacccctggctgaggtggtgcttgtcaggttgtctaaagttaatcttcccctcctcgcactgtcacactgcaccacgtgcagcccgaacttaagggatgggagttacgctctcctgtatcttatttttgtaatcgtgttttagtactttgaaataaagcaattagaaaatctggttcgaaggtcagtttgttgcaatactatatttaatggctatcaaaactgaaagagttcttgattgtggtgataatttcacaggtgtagatatgtgtcaaaacttaccagattggacactttcaatatgtgcagtcaattatacctcaatcaagctgcttttagtttagttttgttttctgctgtgtgtgtgtgtgtgtgtgtgacggagtctcgctctgtcgcccaggctggctcactgcagcctccgcctcctgggttcaagagattctcctgcctcagcctccctcgtggctgagactacaggtgcccaccaccacacctggctaatttttgtacttttggtagagatggggtttccgcatgttggccaggctggtctcaaacttctgatctcaagtgatccacttgcctcaacctcccaaagtgctgggactacaggcgtgagccattgctcctggcaagaaaaaaaaatatttgtatttcgtgagcagaaaaatctacgtatattacactatgagtggagctacattagaaacatctgtgctttcatccaaacctcccatactctaaaggtggttttttacttgtttcttcaaatctgtgtatcttctaacagtatttactgacagaagaatggactatagtgttgccatatccttttctgtggtttttgtttgtttgttttgagacggagtctcactctgtcgcccaggctggagtgcagtagcgcgatctcggctcaccgcaacctctgcctcccaggttcaagcaattcttctgcctcagcctcccgagtagctgggacaacaggcacccaccatcacgcctagctaatttttatatttttagtggagacgggggtttcaccatattggccaggctggtctcaaactcctgacctcgtgatctgtctgcctcggcctcccaaagtgctgggattacaggcgtgagccactgtgcccagccttctgtgtattatttcagccacttttcctgtggcaagaaaaagtgattccaccatggtttatggctttttgcttttagcatttaatgaagaaatctcaagctgtgcatttatcatttcttaatgaaactttgtaaattactaaatcgagtattgcatgactttaagcactgaagagattgtagtggcttgtcttcatgtactgggcatttaaagtttaagtctcattaatcacattggcctcataatattagttaatacctcaagacccaacatacatttacagtgaagaatatcactattaatagtaaatgtaaatccatggtcttaataattgaaactgtttggggaatgacttcttagatggtaaatgttttcagctgatgactgagctcagaatgtaaacaagggaatcagcggactttgattttaatgaaacctgtgtataccccacgcgacaccctgggccagggagcaggctgggccagaactacacatattagatggaaggagggatgaacttggatgtgctgatgatgtggacagggcagaggaagtcagagaaacacagagcatcaaacaagtggcccacagtgaaatgcatttccagaacacactcccagactcgactcacatttccgtgcatctgcatttacccagtttagggacactccagtgtctcttgaacaaccctcttagatttggagactttccatcttttgagtcctgcctacctcaggcagaaaccagaactctccttctcagctcccttgtaggtagggcacagacatgtaacttaggatctaatgagatgcactcacaagagacttactcaagaggccacaaagaaaggacgcaggcactgcagtgagcccactttctggtgggatgcaggtggaagcgtcctgctcctgggacggcagcggcactggtgagtgggtctgggctcaggggatgagctctgatggtatcagcttgggcgggagcagtggggctgtccctgcagccttgtggtgtgtctggggccttgtttctggctctgtttcctcctctctcagctctctggccctcctagacattctgtgaaccgcctaacaattttaaaataatttcctttttttcccctcaaattagctattctattgttcgtgagctgcaagttgacaaaaattccactaagggccaactcactgaactctaatgggaaagttgtacctgttgccttcatttgataaaggagacagagttttttttaaaaaaagtgatgtgagaacaagaattatcagtgtgaaaaagaaaatacagatctcagctcgaataagtcagtactctgtggtcctaaattagaattgggagaatcaatatgaacatgatgggtgttttatctctttcacaaagttctggctttgtctaccaaaagccccagaaacaaagaccagctagaaatgaacatccccttagaggatcacttttcactaaaagctattaggttgtcttaaagaaacagctgattgcatgtgtgggcaggaaaagtacaagttgaaactgcaacatcataccagaaaataaacaaaaaatcaaagatgacaagaattgggtcaaaaggactcagagctgacttaaagaaggtcccaatggccaaagagggtacactttgaacatcagtaagaataaaaacagcaatgaacccagacatatcaaatatgtttgataccaagagttcataataatacaaaaacaagcaaaaaacaagtggtttgtgaaagcagtttgtgaaaccccgtctccactaaaaatacaaaaattagccaggcgtgatggtgggtgcctgttgtcccagctactcgggaggctaaggcaggagaatcccttaaacccaggaagtggaggttgcagtgagcagagttagtgccattgcactccaacctgggcgacagagcaagactccatctgaaaatgaataaataaacaaatacatagagactcgggcatttatccttcctttcctatacaaaccttaccactgggtaaccaaatagatgatgagaaatttcactttctagaagtattccagaaagtaaataagcaaggaatgaaacattgaaatcttgccgttaccatttcctcacaaatttagaattcaagcacagaactcacaatatgaaacaaccagacacgtcacctgttgaagaacacaccagcccctgtgaagtcatcttccctcccgaaaaagcaaagctttatctgctggcgcctctggatatgacagtttgcggggaatacaaaggacaaggaacccatgagatagactacactatgagaacacaatcagcaaaatcctgactgcaggaaagtctccagaacaaatgatctggtttcttcagtaaataaactgtaaaggatggtgaaaaagatgaagtgggaacctaaaaattaaaagtgaccagttgggcatggtggctcatgcctgtaatcccagcactttgggaggctgaagcgggtggatcacttgaggtcaggagttcgagaccagcctggccaacatagtgaaacccatctctactaaaatacaaaaattagccaggtgtggtggcatgtgcctgtaataccagctactcaggaggctgaggcaggagaattgcttgaacccagggggcagaggttgcagtgagctgagattgtgccattgcactccagcttgggtgatagagccaaactccatctcaaaataaaataaataaaataaaataaaataaaataaaatttaaatttaaattggccagtcacggtggctcacacctgtaatcccagcactttgggaggcttaggcgggcgaatcacgaggtcagaagttcgagaccagcctggccagcatggtgaaatcccgtctctactaaaaatacaaaaaattagccaggtatggtggcgggcgcatgtaatcccagctacttgggaggctgaggcaggataattgcttgaacccgggaggtggaggttgcagtgagctgaggttgtaccactgcgctccagcctgggtgacagagcgaaactccatcgcaaaaaaaaaaaaaaaaaaaattaaaattaaaatgacctaaaagacattgaaaacaaaaagcaggcagaaagtaaactatggtgcaaagagagtcaagcctggattgtaaaaccatataaagaaaaacaaggagatgggcatggtggctcacacctataatcccagcgctttgagaggctgaggcgagaggattgcttgagcccaggagttcaagaccagcctgggccacatggccagaccccttaccacagggagaaaaaaatctttctatacaagatggccaaaaaaaaccccaaaaagttagctgggcgtggtggcgcacacctgtggtcccagtaactctggaggctgaggtgggagcactgcttgagcctgagaggtcgaggctgcattgagcccgtgactgtgccattgcactccagcctgggcaacagagagagaccatctcaaaaaacaaacaaacagccgggtgcggtggctcatgcctgtaatcccacccagcactttgagaggccgaggtgggccgatcacgaggtcaggagatcgagaccatcctggctaacacggtgaaaccccgtctctactaaaaatacaaaaaattagccatgcgtggtggcaggtgcctgtagtcccagctactcaggaggctgaggcaggagaatggtgtgaacctgggaggcggagcttgcagtgagccgagatcgcgccactgcactcaagcctgggtgacagagcaagactctgtctcaaaacaaacaaacaaacaaagcaaaacaaaaaaccaagaaagtaaccaccatccatgtcagtagagtggtcactcttactggggagaggagggattgttttgggaatgggcccatggagggcttggcatgagggttggcaaggttctatctcttctcacatctggtcttctgttttcttttcttttcttttttttttttgagaaggagtctcgctctgtcgcccaggctggactgcagtggtgcgatctcagctcactgcaacctccgcctcctgggttcaagcaattatctacctcagtctcccgagtagctgggattacaggcactcgccaccacacccagctaattttttgtgtttttagtagttttggtgtgagccactgcgcccagactcacatctggtcttctatggagttgccttataataatccagtaagctgtatatttgttttatgctgatttctatatttccaccacatttaacaataaaaaaatttgtgacaacagtcccggcacggtggcttacgcctgtaatcccagcactttgggaggccgaggtgggtggatcacctgaggtcaggagttcgagaccagcctgaccaacatggagaaaccctgtctctactaaaaacacaaaattagccaggcgtggtggcaggcacctataatcccagctgcttgggaagctgaggcaggagaatcgcttgaacctgggaggcagaagttgcagtgagctgagattgcaccattgcactccagcttgggcaacaagagcgaaactccgtctcaaaaaaaaaaaaattgtgaaaacatttacttgcatttttccttattcatgtggtctttgaataatttaacaaagactggttgagtgcatgctggggatgctaacagacactggtccatgccttcaggagttttgcgcctggagaggaaaccattctctgtaaccacaaggcctagagtggagcagagaggaaggagagcttgcagggctgtgtgtagcccacaggagagatgatggtggcgtggaatagggacacagcaggagggaaaaggagaattagacaggttccaaacatgttttaaaggtagaaccaactgattggtgatttgtttgtgtgtttgttgtttgtgggtgggtgggataaggaaaggagaggtcagtgatgtcttctagaactggttgactaaatggatgaggaagccctttgctaagatagctggatccagagtagcataaacaaatgggtgtttgtggcacacaaacccgctctgctgctgcaaaaggaggggtcatcttctcccctatattcctagaacatcatcttttgtttagagatggggtctcacttatgttgcccaggctggaatacagtggctattcacaggtgtgatcacagctcactgaggcctcgaactccagggctcagagatcttcctgcctcagcctcccgagcagctggaaccacaggtgcctgccacagagcctggcctgctagagcgtcgtctttcatctcagagctgaatgagcatcttgcccacagaagtgctcagtgctggcatttgaatgctatccatatgcaatgcatcagctgcaaattcagatgaagaggaagccacgcagaggccaagcccttccccctaggaccgctgtgccgcaccagctcatggaagtgcaggagccaggaggaagcgtagccatcaactatcacatcagacccatttggtttaatcctcatgaaattatgatatgctggccgggcgtggtgggtcatacctgtaatcccagcactttgggaggccaaggcgggtggatcacctgaggtcaggagttcaagaccagcctggccaacatggagaaaccccatctctactaaaaatacaaaaattatctgggagtggtggcacgcacctgtgatcccagctacttggaaggctgaggcaggagaatcacttgaacctgggtggaggttgcagtgagccgagatccgagattgtgccattacactctagcctgggtgacaagagcaaaactctgtctcaaaaaaaaaaaaaaaaagaaagaaaagaaaataaaataaaaaaaagaaattatggtatgcttttgtttctaaactcggtgaagagacccagtagcagacagcttacttgacggacactgatcagctccacagactgtcctcgctcactgtctccaaacagcattttcagtgctcttatgtgtatcaggaagatcaaaatacactataccataagtcctaagtgacggaagagattagttattaaattctggggaaagttaatcatattcactttgaaactttagctgaatttggatctcactaaggggaaggggccaagtcatcggggatggggtgggaaggaccgtgcaggaaaaagcagcattacctcaaggatactaaacacctggcgtttagaaagtgcattttccccatgaagcatgtttgacagggaagcatgagggctgtgccaagacaaaagcagaagtggttctaggtgtcgaattcatataaaccttgttgtttcagaaggtttaggtacatttatggatgccagctccataaccggttcatttgactttattctgttcattctcaacctctaccacacctctttgctgtttgcacttttcttctttattgaaggagcatgagtcgcctgcaggcctggcacaagctgctctggtctccccgccttggatggtaccagagcactggctgtttcacacttgggctgggcctacctcacatggccctactgtctcccacattgtcaccagcttcagccagtgtcctttagcctgtgggcaggtccacatttgcacaccttctaagtggtcccggccacaaggacataggggcttgttggacatgcccttgagggggtcccagggacacagatgtaactttcccagcaggcagtcctggaaccaggaagaggatggctccctggagaggagcgatgacagctttgcagtgctggggccggggaagggccagtgagggggtggtggagaaggcacagtgggtggtgaaggttgggtcatttggtcatgagtcactctttctatagcagagaaatgacacggacctcaagccaaaatctgggcttgagttggatttgttccttgtgagtgtgagaatctggtcctgttctggaggctgtctgctcttgggttccttcacttaccatttaggaacaaaagcactgacatttcataattttttgaggattaaaccaaatgggattcatggaataacatatggttacactgcctcctccaacccaggagtgcacatagggtgcatgcagcaaggtatccccatgcagccatcctaggggaagggtcttgtcctgcatcgctttctcttcatctgcactagcagtcaatgcattgcattcatacggcatccaaatcacgctgagcgcccagctctacgagataaaagatgaggccctaggaagtggggagacaacgtgagtcactgcgtttgcagcagcacagaaggtctgtgtgtcaggagtaccatctcatttacgtcacattgaatttggcttactttccatcactcacactagttgaagaatgctgtgccattggtaatccaaaggaaaatttatttttatatattttctttttcttttttttcttttctttttttttttttttttttgagagatggagtctcgctccaggctggagtgtagtggcatgatcccggctcactgcaacctccacttcccaggttcaagcaattctcctgcctcagcttcccaagtagctgggaccacaggcatgcaccaccatgtccagctaatttttgtatttttagtagagatggtgtttcactatatgttggctaggctgatttcaaactcctgacctcaggtgatccacccacctcagcctcccaaagtgctggaagccaacgtgccagccttttagaaatattttctgtttagctttggaatgctttatgtgatggaaggcagcagattcattcttctttcaattaaattgacccaatatattgtgttagtcattgtgctaggctttgagggtgcaaaggcagttaagacacagacagaaaatgcaacgaaatggtggtgagctccatgagagaggtacaaacagagctagttctggttgagagggaaggaaactcctggggaggaggtagcatatcagtcaggaagcgtgaggtttgcagcaataacaaacaaccctcagctctcggtggcttaacatcccaaaagctgactgactcctcattcatgctacatatccagtgtgtgtcattgtagccacttagggtcacaggtcacagagttaaacctctcagaagagagcagggcattgtgcagtgcctccttatgctgctatgtacaagtggtgtgtcctctcattggacattttcttggttaccgctagccatactgccatacctaacttcagagaagagagagtaacaccctggcctgtgcccagaaggcagagagctaaaaacattcaatgaacaacactaaaaaaccccatcggtgtcttcgacccaatatgcggaaggagtatgaaggagaagagcttccaggggatgaaaagctttatgaaagctgccaagatcagaacgcctggctggagagaggggctccaaacaggaatgcttggaggcacggtgttaagggaggacagggcagagtgtgaagctgggctaaggaggttggatttgatccgggagacacggaaagtcataaaggagctgtggtttcagatttacctgactgctttgtgtaggagagatcagagggtggcagcccagaggcaggagatctttcttaaccaggcaaagggctctgaggactcgaatagcggtcttctaatgcgcaggaatggaagggctatgcttgtcagcagagtcttgatcagatttggaactaattggatatgagatgtaagcagggtggagaatcaaagatgattccaggatttgagcctgggagaatgctgccattagaattagagaaaacagtggaaaatgggcaagtcagggaaggaagatggggcttgttgatctcaaagcagggatttttattttgttcactcctgtttccctgtacccaggacagtgcttagcgcctagtgtgtgcttggtaatgttcattggctacagaatacagtagaacataaatggagacgtccccaggcgaccgctaaggcagaactggcactccttggtggtgtctgtgctgggagggaggtcttcctgtctgaagtcgtaagatgagacgtgctgccaagagaaaaagcttagagaagaaagggatgaaactgaagggagaactttgggaatcatgacatttaggactagaaaggaggaccggaatccagggaaagggggcatttgaggaagcatcagatgctgcaagtgggcgaggggcgttgggatggctcagagggcatctggtggcacagctcatgtcactgggcctccccagggtagccgggcgcaggccagcaagcgcctcccgcctggagaacaggaggctgcgtagccgacggggagcctgggccaggggcggttctggtttctgtttggttttggggggttcataaatgcgatttagtcctgtagcaaagtgagcaaggtgaaggggagagaccggaggcgcatgagggaggagggaaaagatggttggcatcaaggaggtggataaagggctgccctcccggggcagggcccctggagggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgaggtgagcgcgggccggggacccggggcgctgggaagctcctgcccgcccgaccctgcagcgcggcgctgggctcggccggctcccctggcgtgtccgtcggtggccgagctctgggcgcacaggtggaatttcctgttcagcgggtgccgggccgcgggcgggcggggctggccggacctttggtaccggaccggctgcgccccgccagggggaggcgggaagcccctgggccttcctgcgccctcggtcctttctttccctgagttgaaaaaaggggctccgtctcggcccctccatgactctcgcgctgttagtgaacatctggaagaaaccaggggcttggagtggggttatttgggaggaagtgaaatttcaggagggtttggagtctcagccatccttggcctctgcagaaagtttctttcgtctctctccttccccgtcaaaaggcgctttgggacctcgcagaggacaactgggaggccagggctttggctgccatacgggctggagctaagaactccagagttgggcttgcctgggcttctcgagaggggatggagccctttgggaaggcggctgtatgggaagggatgtgggaacacacatgtcttgagccttttgcgaagtaccgaaacaggaagctcttctttggcagaaagaacaatgaaagacctattgaaagatctcaaaaagattacatgttcctgtatggagttggggatgggtcgctagtcacttcattgacggacccacctaggtggtagtgcccgggcgggaccagcagccaggtctctaccctctctgtccaaggcagacccccaggtttcctggaaggccagggcataccaggtcagggcggcgctgagaggcaggggctgtgtggcagagagttttgctcctctgcaaatgatggcctccctgccctgccaaccctcactttctcccctccttccgggtgcccctgggctccatagtctccgccgttgctccctaagtcaggcctgattttggtgctgtctcagatcaattccttttgtccaagcagcatcccgacctagggagcttgcagaaaatcagacgctggggctttggaggctgcctgcaccacagacaggacctggggctgggctctgctattttctccacttttcaccctcagcaaggaggaaagcttccagtggacctgaaggcttgggcccttcccctggctgtgcctgtgccctgctgtgaggcagattcaccttctcttccttgctgtaattgctatgtttgtgtccttgctaattgcctacttggggttctagactccctgcctcttcagcagagaacctgctgtttggaatttgttatttcagggcagtccggtgcccccaccccaagtttgttctccctgacttccctttctaggactctcctgcccacacggggaaagcagggtcttcctggtcgtgtggtccagcctcctctctgagccatctcaccacctgacaagcagccaggctggggctcaccttccactcacccccaggatcccacattcagcggacttgtcttgtcacctgcaagccctggctttagtttcccccatccctgctcatttcctcctcctctgcgaagctcatttgctctctgcgcccttgggctgttccttccccctctgccattttcattctcttggcttgctctttgtcttttctcctgccgagctttattgaactaactcagtacctagtcccatgggtgaagggaaggctctcagagaccagtaagatgtggttgtttcctttaaagaacatccagtcttgagagcgaaactaagagacgaatgccaaagttagctgtgaggcggagtgtccagaggaaattggccaaagctcatttccatgtcttgcagattcctcccatccctggcctcaccagaaatcccagtccctgggatcaccctgtagtgtgtgtttgcagctaggatgtccatccccggccgggaggtgtggctgctgcccctgggtttattatctgggtcagcagagcctggcccacagggtgctgttgtttctgggttccttgtccccagttgcatccatccgtgcacccttgtttggtggtatttgtatctggctgtccccttcccaaggctggtggtgtggcccctgccccacccctgctgttcccatcaagtgttctgcgtggccttcagagtcctgatgcacgttactgcatctggggatggtgtgagccctgcctgcaagcaagcagggaaacagatgccacttcttatggccattaatgagagccagggagcctgcctccctgagggtcttgattcctgttgagtatttgatggtgaatatgaagctgccttgacatccactggttccttttccgatcacaattgccctaggtaagactcagcatcccttaggcatccagagaccaagtttggaaaaatcggatgttgtgtggccaaaatcagatgtctaggggccagggtgtacacctctggctattcagagggtcacctgcttgttaatttgtcaaccattcaggcattcattcacataacaatatctgctaggtaacccactgactgagcctgtgccaggtgctgggaaatagcagtgaggaagaccctagactcacagcccctgtccttgggaccacccaaggtagtgtggggtacagggaactgaattctgactcatgagtactagcttctcgatatgcactgggtgagcacatggcatctctctaacccaggctggaagggccaggtcagcaaattagggctgcaggcatctgtgatgtggtggcaggaggtaacatgcagccaagacccggggccgccttgtctagccacgtgatctcagagatgttactcaatatctctaagccttggtttctgtggctataaaatggtgatgacatatatgttccaggtttgttgaaaggattaagaggggtactttacatgaaagccctttgtaagttgcagtgtggtgttcaaatgatgcagcttgagtttttgagttgaaagggacttgagacaagcaagaagatcgtatagtatcagtaggtcgcctgtcgagaggctgagaacccaggctgtcagtggggccctgacctcacagaggagccatcctgccctgccaaacacagggaagtgcccccaggattcaaggaactgctcgccagcaacagagacctcttcctaagaccttctgattttcattcccctgctttacccagcttctaggagaaatatctttctatgaaaagaaaatgtgtgccagctgcatatccctttctccttctcatcccctgcccctcccaccatagaaaattaaacttttattttgttttgttttttagacatgggggtcttgctatgttgcccaggctggactcaaactcttgggcccaggtgatcgatcctccttgtctcagacttctaagtagttgggattacaggcgtgagccactgtgcccacataaaactttagagaactgccttttttgttctctagagcatgtgctgggcaggtgtgtgcagtgggtgaggaagagggttgggaaggcagaaagcagcaggaagctaggattgtcctgtaggtggggcttcagctgctggagtggaccggaaatctgccttctccaggggctttctggagccttccctctgccttggtcctgagaacacctggaaattcctcgtttaggagttgagaaaactgaggaagaggagaagatgcccctagtttgatggctgccttcgcctgctagcagtggaaatggtcagagggtggacctgctcgagccgacttgctggcctgttgccacgttgtcaccggctgcggaaggagaacgagtcacagctccctccccctacctgaccctcactctgctccctgggaaccagactaccagactgcctactgctgtggccagtggcttctgtccctcggaacactgtggccctcaagttccctgatgtctgctccttctctggtctgtggttctgccaaggctggtggctcatgtctcttttaaaagagaagttgtctttggaagaggaagggaaacgtgacagagtcccctgggagcccaggtcctgaagatgatgttgcttctgatattgtgcaatgattactggagtgtctagaatactaataatgatgaacactaataatcgttagcatttattgagcatggctggctgcttgtcttttttcctgccaagcttcattgaactaactgtgtacctagtcctgggtcaggcatggctgaagggaagtaagatgtggtcttactagtctttgagaccaagtattacccttctcagagacaagtgttgttattactgtttttttttttttttagacagggtctccctctgtcacccaggctggagtgcaatggtgcaatcatggctcactgccactttgacctcccggctcaagcaatcctcctgcctcagctttctcagtagctgggactacaggtgggcaccagcacgcctgactaatttttgtattttttgtagaggcagggtcttgctatgttgcccaagctggtcttgaactcctgggctcaagtgatctgcccacctcagcctccaaaagtgctgggactacaagtgtgagcccccacacccagccttattattattattattattattattattattattttgagatggagtttcgctctttttgcccagctggagtgcaatggtgtgatctcagctcaccacaacctccgcctcctggattcaagcgattctcctgcctcagcctcccgagtagctgggattacaggcatgcaccaccatgcacggctaatgttgtatttttagtagagatggggtttctccatgttggtcaggctggtctcaaactcctgagatcaggtgatctgcccacctcggcctcccaaagtgctgggattacaggtgtgagccaccacgcccggcccagccttattgttattacctttttataggtgaggaaaatggagcacatggaggctaagtaacttgcctgaggtcgcagagcaaaatagtggcggaatctagattggagcccaggtagtctggccctgtcatatcctatgtgggctgtgacatgcggaacagggctgtcagcccacagggttcaggaggggatggaatactaaaggttgacaattcatcagatttgggtaagaaactggatttctcttctcaggttgtttctgagatgcctgggactaaattatagaaaccatttggtaggatgggaatagaaacttacagaattctcagagttcttagcctggcctggttggcagtggtgagaagtgtgtttggggtttgctcagagctcatgggtagtagttgccctttttgctttgttaagaatctttccagaagcagctccctgctaaaaattctgtctcagatgctcatattttcaaaatttccctattctgcctggacttagcaatattttgggattttcccccgaatcctgtgatagttggctaactgatcaaaatcttggatcctttgactctttttggcccacgttggtgatgctgaggtggtggtggggatgatgatggtggtggcgatgttgaaagggtggagaagaatgtgatgacagttatttctacctttcactaaatatctgcacttcaattcctgacctcactttatcctcacaacagctgtgtgggggaaagaatgcccagttcacagacgagaatactgaggctcaaagggtttgtgtaaaggcagtaagaagtagagtaagaattcaaactcagatctacgcaacttcagagcctgggagctcaccaccatgccattataaaattgtgttcctgagatgatggtgaaggttgcatatccccagcaaactgctagaacatgttattcaccagagagctgtgagcacataagaaggaagtggtgatcacccggtgccagtgctggtgtgctacaaacatcatagaccagcttgtctggtttccccttttgatgaggttccttagctggtggaccaggagcacagctggagttgtgatttcaacatgctttacatagacacagctttatgtattatacatatgattaaaaattatggcggaagttttaaaatgaaaaccaattcacccacctctgccaacaaatcacttttcacgcctctttcccctccttgctgtctatggttcaatgtgtctagttggttgttgtgcacacaccacttgtatcctggacaaggtgttttattggcctcctgtctgctgggtgtggagccctgggtgttggaggatcgaagttctggtaggcttgtgtctgattgaaaggctgtgcctaagggggggtctgttcttgaatccacgtcactttgggtggtgacctcaggctgctcgtcaccccttcctgggttctgtgccatttcttatttagtaacagctcagatgaggacttggggcatttgcctaccagctccacagatgacaccagctgggagggaaaggctgataccttgtatgacttgattatgagtcagagcatctggacagactgtctgataggctgcgctgagcagaatgcatccgtctgggtcaggagtcagtgctttgctcactgaaccacctccctcaaccatggagcagaaaccacgagacccagagttctgagttgacagtgagcccaggagagatcaggcatggaagtgtgactgcccaaagtcgaagtgtgctttcttccccctatgtttttatttggttataccttttaaagttattattaaaagtctaatatatacatatttaaagaaaacttagccaactcagataagtagtaagaatttaaaaatgaggccgggtgcggtggttcatgcctgtaatcccagcactttgagaggccagggccgatggatcacttgaggtcaggagttcaagactagcctggccaacatggtgaaaccccatctccactaaaaatccaaaaattagccaggcatggcggtgggcacctgtaatcctagctactcaggagactgagagaggagaatcacttgaacctgggaggtggaggttgcagtgagccgagatcgtgccattgcactccagcctgggtgacagagcgagactctgtctcaaaaaaaattttttttaataaaaatgacacaaatacccctacaaagacattttaacaatttggtattgcctatgcatgttttctaaaaaaatttttttcctcattaccacatttaggaagcttttctttttgaagtcacacaatatagaaatgtacagtgtaaaatgtgaaacttctgaaattccctctcccagattttagagcctctataaatagttttgtttatattctcccacaagtcttgtgtgtgtgttctgctgtttgtgtgcacacctattctcctccaaatggaatcatcactaattccactctgcagtaaagatatgattttattaatgaacttatcaaacatttattagatatcatacctcatgctagatttgtggagcaagacagacccccttccctcccctatcacaggagtctgggagggaggtgttggagagggatctcccagaattactccaaggagatgcctgagctgaatttcgaagggcaggagtgactattttttttttttctgagatagggtcttgctctgtcgcctaggctggagtgcagtggcgcgatctcggctcactgcaacctctgcctcccgggtttgagcaattctcctgcctcagccttccaagcagctggaattacaggtgtgcgccactgcgccaggctaatttttgtatttttagtagagatggcggtttcaccatatgggccaggctggtcttgaatcctggcctcgagtggtctacctgccttgaactcccaaagtgctgggattgcaggcatgagccaccgtgcccagcctatttttttcatttaacattctatcttagatagcttttccatgtcattatctactttttgaaaaacgatttttgattgccttataagctttcatcgagggaacatatcattctttccatcttcttattttaatcgttttattgtttgggtgtgttacttgaatgcatcattggacaattaatagaaaaagagcaaacagaatgaggaaggtaattggcaagcagaccctgtggaggccacgctagtcagacctcttgtgggttatgctggtgaattctggaaacggtgtcttcaagggaagatgactaagggtgagatggaaccagatggccagggtttagaaaacattttgtttgaatgatcagaggagttgagcatgtttagccagaggaggtgcagactgagagagcacacgagcaccgatgtagagcttccactggagcgtctcctgagtggggaaactaggctggttctgttgcagtgctaattagtgcagaggtgattgcagtgctgatcacacttggtggaaggaagagcttcctaatactcgtactaaggaaaatgctatttcttccaaaaggatggtctcgcgaggatgagaggtgggtgacatgccctgcagaatctgtctcggctctgagaatccaatttcaagggtagatccagcagttctcccctcgcttgtatcctattcccccaggatagagtctggttctaatagaggacacagacttcctggtgccctcccctgggggtggggcccctctgtttgcatagttggtcctttccccaaaacaggtgctcagatttgtagccatggaagcgtgttttagaacttacccagttctagaggctgcaggcaggcttgggtttttcccactagcttctgcagatccctgggtccaccaagtcagaaacagactgtggcacctccatgccatgaaatatgactcagcactgaaaaggaacaagctgatggatgcaacaacttgaaagacctccagggaattttgtgcagttaaaaaaaaagccaacagtcccatacataccatattatttatttatataatataatgggttttttttttttttttttttttgagacagagtcctgctctgtcccaggctggagtacagcggtgtgatctgggctcactgcaacctccgcctccctggttcaagcgattctcctgcctcagcctcccgagtagctgggactacaggtgtgtgccaccacacccagctaatttttgtatttttagtagagacagggtttcgccatgttggccagactggtcttgaaatcctgacctcaggtgatccacccgccttggccttccaaagtgctgggattacaggcatgagccaccacgcctggcctatataacataatttttgaaatgacaccatgttagtagtagaggacagattagcgattgtggagctgaaggggtgggggacaggagggaggtggctgtggttacagaaggccatgggcatcctcgtgttggagctgttcagaatgttgactgtgatgccagagacaggggactacgctagcgatgacatagatggaacttaatacttaacgtgagtagcggtgaaacgggaagtctgaataagatccgcggatgatactgctgttgtggtattatgatacagttttatgaggtgtgactattgggagaaactgggcaaggatctcagtatgatttcctacaactgtatgggaatctacaagtatctccataaaaatgtcagtaatgaaaggcacactagctcgtgaaatcagaatgtggatttaataaaaagtcaagaaaacgaatgaaaagaagttactaggtgctggctgcacctcttgtttctcttgtcgggttttgggggatctgcctgtttgtgctgctgcaggcagatgcttctgctctgagtccggtgacttggggcaggaggaaggtggggcagctgggccgggaagtaggtctttggcacataaggagagggctggtgcaaactaaatgggatcgaagaggcagagatggaattttccggctagaattggcaaaagaggttatgtcctggtgtgtgtgttttgggggcgacacactgaactgaggaccaggagagatccggcaaagtcgaactttaaatggggcctgaggacagtgggtggccaggccaggtctgaccccagagagcctgggggactgtcagcagagccctgaggtgtggactgagtattttttccccttcttggttgagggcacttggcaactggcagattattccagcctgccctggggaggctgcctaagtctggctatggggagagaagaccttccatcaacccatcaattagtcaatcaagtgctaactctgggcaaggttgagggtggagggggagggagagaggcagtaggaagaggaaaccggggcactgtgaccagccaggacttcctggtccacccagcatggtgcaggttggggaagaggtgaggccccagggagaaagtacggtggcttgttgtggtcccgggaggattcctggcaaggctcagctttggcctgtgtgctggagggcaggcaggttcggtaggcggtaggggagcccagccattccgagcaggcagatgggttcctaaccgagaggttaggaacctcttggttcctaacaggcttgggggcctttctggctagagccaacgtcagagttgagggagccagtgcccttagaccaatgttaaaggagtgacgacccatatacagtggtgggcacagcaggggcccgtctcttgggcccaagaagtgggttttgtagtagatagagttttgcagagtgttccttttttttttgtttttgaaatcaacactgtatttattgatttagactactttattgaggtatgattgatatgcaaaaagctgtacctttttgtgacattacagacaggggcctgtgctagcaatgacatagaatggaacttaatattcacatgagtagcagtgaaacgggaaatctgaataagatccacagatgatactgctgttgtgcttatcacgaatgacagcaagatagtgtcaattaagacagccatttcaagctactgacatcctgctcttttctcttgttttttgtttcttttgtttctatttaatgtgtacaacctgatgagtgtggatgtatggaaacaccagtgataccatcccataagttaggctgcaaaatatccatcaccttccaaagtttcctcctgccctctttatctattattctatttatttataataataattactattttgtgataagaacacttaatacaagatctcttattgaaggtatggaccaccttttgtgtatccattcatttgctaaggaaaatgcttagtttgttcccacatcttggcttctgtgaacagtgctgcagtgagcataggatgcagctctctcttcagatcctggtttcaattccttcctttggataaatactcagaagtgggctcgctggatctgcagagcatgatctctctgggcttcagttcgcttttctgcaatattgggggggtctcttgagtggtgcaagatcaaagataaccaggtccccgcacgtttgtgtctttccacaaggtcagacttttattgatgcaatttcaatcataaacaccactagccacatggagttcccaaaaagacaattctccttagtacttcctgttcactcaggaggcagagcctcgggcacacaggctgaagccactccacaagtcagtcaacattgcaagccatacataatcatatacttaatatataaatgtatagattaaacatcccacatcaaagtaacatttatcatcaagagaaaggggttaggaaaaagggttaatgaaccagtccagggagagccacgaagacaacaagaccctcctgccctggcctgggcagtctgtcggtttcgtggggaagagtttctgatgttggcagaggcttcgctggcagatgctaggtgcttatcatgagtgacagcaagatagtgtcaattaagacagccatttcaagctgctgaagtcttgctcttttctcttgttttgtttttttgtttcttttggttgcttttttttttgagacagggtctcgctctgttgcccaagctggagtgcagtggcgtgatcacagctcactgcagccttgacatcccaggctcaagtgatcctcccacctcagcccgctgagtagctgtgccaccatgctaagctaatttttttaaaaaatttttgtagagatgggggtctctctgcattgcccaggcttgtctcaaactccagggctcaagcaatcctcccacctcagcctgccaaagtgctgggattccaggcatgagccactgtgcctggctgtcttcttttttttttttttttttttttttgagacagagtctcagtctgccacccaggctggagtgcagtggtgcgatctcggctcactgcaagctctgcctcccaggttcacgcctttctcctgcctcagcctccccagtagctgggactacaggtgcccaccaccatacccggctaattttttgtatttttagtagagacggggtttcaccgtgttagccaggatggtcttgatctcctaatctcgtgatccgcccgcctcagcctcccaaagtgctgggactacaggcgtgaaccaccgcgcccggccattgctgtcctcttcctatggccacagagtcctctactgaggacagacagtggaggagtgtgtatgtccttgtctggctggatgccgtgtttatttatttgcaaaacatcttgtccctgttgacaaagtgaaacataagatgaggtctttttctaggatggagttatttatgtcaagggtgctgtgtacgagcctcacgcatctgcagtgggaccctataggagggcaaagaaccagcttcagtgaggactgcctgacacaactctcttctttcctttctggggagctggtgcaggggagggtgtggcgtcaccacgcgagtggtcaggactgagagccctgagctgctggggcaaatacttttctctgtgcctcagttttccccctcttaaaagtgggttaataaccacttacggccttccaaatagaacataattagctaattcctgctaatgactgaggcctacctactgtctctctttgattttaatttctccacccactgtttatccatctgccaaaagccaggcagcccaattcctccctctggtctggtggagcagctgaagttcagattcaaacttcaaaacaaactgaaaggctgggcgcggtggctcatgcctgtaatcccagtactttgggaggccgaggagagcagatcacctgaggtcaggagtcgagaccagcctggccaaatggcgaaatcctgtctctgctaaaaatacaaaaattagccaggtgtggtggcgggcgcctgtagtcccagctactcgggaggctgaggcaggagaatcactagaacctgggaggcggaggttgtggtgagctaagatggtgccactgcactccagactgcgtgacagagcgagactctgtctcaaaaaaaaaaaaaaaatcaaacaccctccaacaaaaaaaatgaaagaccttaacagcacaagtctgtagtgtgggccttagtgaggagcgacctggcaggtctttccaggatcccaggagccaatccttggctggcccacatctacccgcccttgtcactctgtcccgacccatggctccaggagggctctgctgctgtcccgcttctctgtaacccctctgtccactttctctgggagagagcagaaggccagccagggtgtccctacccacttgcacccatgggtggtttaccccacaagaccagagagtgctggccaggtcgcagcatgctctgggcctcagcttacacataaagcttctggtagtttccaaaaacattttttaagacaatgaaaaccttgtttcaaatactttttttgcagagcctgaaaataatgaaacaattggcttgaagcaggagcaggacacagagggcctctggatcattctttaagacaagttagggattcaaaaccacggacagacccacagcagcaggaggagggagtctgcccacaggctgcagccccaggagctgcttttccacctctgaggtctcccaagggattgtcccatccctcctcctgggggcccacagccaggtgagggaggcggtggccacagcaaatacactcattatttttggacatctttgtgccatgtaggtgtcttcaagaaatatcacgtccaattcttacagccgctaggcttcattttcagatgaaaaaagggttaagagaggaaaatttatcaaaaacccagatagctgaaagtgtggcagagctgaattttgaacccaaatctatctgactccaaatccagtgttgctctcctgggccctctgctgcttctcctgggggtgaggtgtgtgggtgtggggtgggggtgggggtggcagttattaccaactccccgtatagagccacccttgacataagtaactccatcttagaaaaagacttcatcttccatttcatagggcactttgcccacaaggacaaggtgttttgcttgataaatttaaagactgcaaacaaacagacaagcatcctcctccactgtcagtcctcaccagaggactctgtggccataaaaagagcaggactttggcagttcaccctctgctgtcactggtgataagcacccaacatccactgccaaaggctctgcccacattacagactcttccctgaaagactgatgaaccagccagcctagcccagcccagactttttttgtcttcgtggctctccctggactggttcattagccctttttcctatcccctttctcttggtatgtttttcaggttttgccataaatgttaccttatgggtacctgataattacgcgtctagtatatcttgcatggctctgcatgccgagagagcattcatgtaggagaactgcaggttaggtggtactcctaacagaagtgttctctgaatttcatttatgactggaatttcaagcggaatggcaaattcattatatctatcacgtgccatccctaagatagctgattttcttggattcgtttgtccttgtgttagattttttcaagtccgtctccagattttgttgggtctgaatatgggtggacagatctccaggctgatgtgatccagtcccagagggctagaacatatcttggctgattggtgggtttttttttgtttttttgtttttgaaatggaatatcactcttttcttttcttttcctctctctctttctctctctctctttctttttgtttttgagatggagttttgttcttgttgcccaggctggagtgcaatggcgcaatctcggctcatcccaacctccgtctcccaggttcaagtgattctcccacctcagcctcccgagtagctgggattacaggcatgtgccaccatgcccggctaattttttgtatttttagtagagacggggtttctccatgttggtcaggctggtctcaaactcctgacctcaggtgatctgcccaccttggcctcccaaaatgctggtgggattacaggcgtgagccaccacacctggcctggagtctcactctttcttgcccaggctggagtgcaatggtgcgatctcggctcactgcaacctccaccccctgggttcaagcgattctcctgtctcagcctcccgagtagctgggactacaggcgtgtgccaccacatccagctaattttgtatttttagtagagacggagtttcatcatgttggccaggctggtttcaaactcctgacctcaggtgatccacctgcctcagcctcccaaagtactgaaattacaggcgtgagccaccacatccagccttggctgatttgtggttctaatggtttatggtttggtagttttataatagctcatgacagtttcctgctcgtgtagggatgcaatgcgtttctgtgcctgatagtgccgtggtgtctgctgcattctcccacagatgtaggggccagtctgcatctgtgctctgtctttggcaaaaatctgttctcagtttcagtaactctgctgtggtgtagtctccgtcctcactggtgtcctgaggactgtgattctcatagttatcattggtacctctttttctagttattataggtcttgctgtatatacccaccccaagggtcattgtaatgtcctaagttctctgcagggggttcccttggtcccaggggttcctccttaaaagttacccctgacagggatttacttttccttttttttttttctttttcttttctttttcttttttcagacagagtctcgctgtgttgcccaggctggagtgccgtggcgcaatctcggctcactgcaagctccacttcccgggttcacaccgttctcctgcctcagcctcccgagtagctgggactacaggtgcccaccaccacacccagctaattttttgtatttttagtagagatggggtttcaccctgttagccaggatagtctcgatctcctgacctcatgatccgcctgcctcggcctcccaaagtgctgggattacaggcttgagccaccgcacccgacctacttttccttaaaattccttgagctggctctttgcctgtctggcgatctgtgagatactttgcattaaaagtacagggattttttcttttagggcttaacttttttttttttttttttttttttttttgagacggagtctcactctgtcacccaggctggagtgcagtggcatgatctcggttcactgcaacctctgcctcctgggttctagtgattctcctgcttcagcctcctgagtagctgggactacaggcccatactaccgcacctggctaattttttgtatttttagtagggatgggatttcaccgtgttagccaagatgatctcgatctcctgacctcgtgatccacctgccttggcctcccagagtgctgggattacaggcatgagccaccgtgcctggcggggcttaacatttttagggtcctcaagtctgactgtacatcctcagggggtcatacagggagtctttctgacttccaactctatttgggcaatggttcgatttcccaccttagccaaccggatgagtaggggttatgcaataattggcttcctcttctttcagccgagttaaaaatttgtttttaggccgggcgcggtggctcacgcctgtaatcccagcactttgggaggctgaggtgggcagatcacgagttcaagagatcaagaccatcctggcaaacatggtgaaaccctgtctgtactaaaaatacaaaaattagccaggtgcggtggcaggtgcctgtaatcccagctactcgggaggctgaggcaggagaaccgcttgaacctgggaggtggaggttgtggtgagccgatatggcgccattgcactccagcctgggcgacaagagcgaaactccgtctcaaaaacaaaaaatttttttgttttgccaactgccatctcctaagttgagaccatgcttgctatgagcctttctggccccactagcttcctagcctggcatcagccgagaccttgtcagctcttggagctacaggacctgggtaaagaacctcatcacctgaggttttcctcagggagctagactttcaaggtgaagtgagatgacgtctctttttgaagagggtggcagtttgttttttcaaacggcttgatttctaatttaagttttagtggaggctttcgccttagcatcgactataccacctatgcccagtaagctgactgtgccaattctcatgagcggtgcgaggtcctaaccgggtccatgcacctttgtgtctttccacaaggtcagacttattgatgtgacttcaatcacacaaggcgcgagccgcatggagttcccaaagagacagctctccttagtacttcctgttcactccgtagtcagagcctcaggcacacaggctcaaaccactccagtcaatattgcaaactatacataataatattcttaaccaatatataaaagtataaacattccacatcaaagtaacatttaacatcaagagaaaggggataggaaaaagggtttaacaaaccagtccaggaagagccacgaagataaaaagagtctcctggtgtgagctgggtcatttgtcggtcttgccgggaagagtttctgatgttggcagagccttcgttggcagatgctgggtgcttatcacgaatgacagcaaaatggtgtcagtgaagagggcatcttgaggtgccgaagtcctgctctttttaagatgaagtctttttctaagatggcgttacttatgtcaagggtgctctgtacaaggctcctggtcccttgggctgcgtggggagggccctgggcagtgctgggagttgggacgggacttgaaacctgcaggagctggctgctccctggcagagaaccgctgggtttctgtgttgacaacgtcctcacagctgggctgagtcaggtcctgggggactttccttcaggctgtaaccaggtgtggggacttgtggtttacttccttcagtgggagttcttggccgtgggtcagctttgtgttcccctgatgggctggggttacagatctacagatatttctggatcttccttggggccctgcagccccacctgttttccagcagctccttctggcggggcggctgagggcggcgacgggtcaaagggaaaggtgggcgggccggggttttggggtgtctgccagcagctggctgggtctgcagctggccctgtgctctcccaggaggagctggagtgtgtatttctgggaaaagtgatagcctcagggacttctgggatgatgcttataaccaattgtgggagggtccccagggcgtggaagcaaagttcgacctggcacagcagcttcccttcatcccaggtggttgctcaaaatagaccagctgagactctaagccagcttctcctcctggtgacaggaaggggtgagcctcctggaaatggtgggtggagtttctccaactttcaggttcccaagaatgacctggagcacttgaataaaaacttccacatccgaggccctgctcctgatgcatgacatcagcacctccagggagaggggcttgggaatctggatgtggaacaaacactgcatttgtttcagttgattgttattgttctttttcatgaccagacaagtccaggaaatgctgggggttgcgatcaatgggaaccataggcttttgcaggtttcgtgaaaattggcttctagagagatcgattacccctggttggggagtgggtgggaggattccagtgtggcctttcttttcctttctcatttgcccatcggtcatccccagataagcactcaagtgtcctcttttatgaggccccgtgctgggccctggactgccatggtggcaggtggggtgaagtcccgccctcaggagcctgctgaccgcctgctctgtgcacagctgctggagcttccccggggctgctgatttaactggggagggcctgtctatgtggggtccctcctagccggagacaggtcccttttatgaacagcagcctgatgaagaggccttcctgcaacatgcctctggtatcattctcagctcagcattgcccaggggacaaacacagagtttgttcttggcagtcattccctgctgtcatctcaggtgggcttgagccgtgctgggtttccgggaaatctggccaggatccagcacaacctttagccagtccggcagggagcggccacgaggttgtgctggctcggtctttcccttgcaaaggaaggcatcttcgacctgccacagaatgctttcttccccggggaaacccttgcaggtgctcgggctctactttcctttctcgcttgaacaattacagggatagtttatggttctcatgaccctggtgggggtgatgacatcatgggattgaaatccgtcccaccttggagtcaccgagcgtgtcagtcaagagccttggccacaaatcagtggcacttggcagcagcacacaaatccagccaccctgtccttgtctcaggtctgggcagcacagctgtgtccctagctggtggcatcgcccctgccccttgaccttgatcttcagcctcagaagcaggctacccattgtcatgtgactgcccttcacggtccctccccaggattccaaggggcctcttgaggtttccaggttcagccgcttccttcccagcagatcacacccaaccttagccacatgaggaacgatctttagaaagggtctggcccgaagcttcatttttccctgtctgctttggttggaatcttgtgtggctttgtgtgcagttggtagtatttttgttgttggtaagtgtaggggcccttccccattgcttttctctaaggataaccatgctctgagcagcccatggcaaattctggctttggacttgttggtccccagagccagtggggtcgtgggccctggagagtttgcactcagtggcaggtcttagtgtgtgtttgaggaaccaggagagcgttcctctcagagggaggattctctggttgactcacacagagttttgttggctcagcatttagctttcagccctggtgagtttctctgacttaatgggagtaggctggctgcaagaatctttcctatattatcaaataaaataggtctcttttttggccctctagaaatcagtgttttttttcttttcgttttggagagcccggccttggggaggatatgcatcagttgctctagtgtgcctcagacaatgagataagatgaaatagggcgtgctctaggacctctccacttccccttcccgggtttctggatctgacccttcgctccctgcagaaagttgggtgagatggcaatggtccgatctcatccctgctgggtgggatggcagtggtccctcttgggtgagatggtggtggtctgatcttgtccctgctggatgggatggcggtggtctgattttgtccctgctgggtgggatggcggtggtccctgctgggtgggatggtggtgatctgatctcgtccctgctgggtgggatggtggtctgatctcgcccctgctgggtgagatagtggtggtccctgttagatcctggccctttagggtctgtaccctgcttgtcctgagccctttatccccaacctcccgcctggaagtcattcctcgttcccttgtctgagtggcctggagccgagctgtgtttctgggtcctttggccaggatctaactacagtgggccagcaggaagaggctgtgatatttacatggcctctatctgtgtttatggtaagcagacacacctggcttcatagcaccgttttatgtgtgcacctgcaaagatgtttacttttaagaaagagagacaggagaagtgaaagcaggcgcaggcataggatctctcctgtcggctgtggcccagtagagaggtgttatgcctacagttgtctaagtgtctaagtggatgggagttccctgagacctccccctcccacctcccccacccaggagttaaaagagctttgctgcttcactgactttattaactttgtgaccttggacaggccactccctctctttcatcctcagtgttcttatcaataaaacgatgggattatgcaacagtatctctgttacacctgaaaatggagccaagagctaaggttataaaaggaagcagcccagttactgattagacagcacttttaggctgggtggagccacagaactcacactgcagggaggacagaggacccaccattgagctagcgccactgctgacagcctcgctccgtggcagagtctggggtgacccctgagtcaatgccctcagccaccttaccccttctcatgggagtctctgtcttctgtttccctgaatccttgctcccagaattctggaacctaaccacactgggaggcagtaaaccaggaccagattctggatctgccaccaagtactgggtgaccttgcaaaatcagcattcttccctgccttctttatataacacgggtgatagcaccagccagtcttgaatgagtcacaggactgtcatgaagatccagtaagaaaatggttgtgaaattaccctgtgaattggatatacatctaaacatgataaattattatttcattacatttctttttttctttgtttctttctttcctttttttttttgagatgaggttttgctgtctctgtctcgcccaggcaggagggcagtggcatgactatggctcactgcagcctcagcctccctgggttcagatcatcctcctgcctcaacctcccgagtagccaggactacaggtgcatgctgccatgtctggctagttttttgtatttctgtctttcttatcattcactgagccctttgaattgggtttagccgtgttggccatgctggtctcgaactcctgggctcaagtgatctgtccaccttggcctttcacagtgcaagtgtgagccaccatgcctggcccttttgttaaatatctttttttttttttttgagaccgagtctcactctgttgcccaggctggagtgcagtggtgtgatctcggctcactgcaatctccgcctcccaggttcaagcaactcttgtacttcagcctcccgaatagctgggataacaggtgtccgccaccacacctggctaattttttatgttttttgtagagatggagtttccccatgttggccaggctggtctcgaactcctgacctaggtgatccacccaccttggcctccaaaaatgctgggattacaggcatgagccaccgcgcccagccacttttgttactttttttttttttgaaatggagtttcgctcttgttgcccaggctggagtgtaatggcacgattttggctcaccgcaacctctgcctcctgggttcaagcgactctcctgcctcagccccccgagtagctgggattacaggcgtccacgaccacgcctggctaattttttttgtatttttagtagagatggggtttcaccacattggccaggctggtcttgacctcctgacctcaggtgatctgcctgcctcggcctcccaaagtgctgggattacaggcgtgagccaccacacccggcctacatttcttatacatatatacacatacatggtctgttcagagtgtagccgaaatctgtgttttctcattcttaaatatgattagactaccagaggccaccagatgtctaaagaaaacccagcctgaaaggcgaagttccaaagataacataaaaatgtctagttgcagctgggtgcagtggtgcaccctgtagtcccagctactcaggaggctgatgcaggaggattgcttgagccaagaattcaagaccagcctgggcaacatagcaagaccctgtatcttaaaaaaaaaaaaaaaaaaagattgcattgcatctatagctaattttgagaatagacaccttaatattgaatcatctaatccatgaacagcgtatattgctcaactaatttaggtcttttagaatttctcccagcagtattttacatctttcagtgtacaggttttgtgcattttttgtcagatttacctctaagtatttcatatttttgaagctattgtaaatggtgtcttttagttttagtttccagtttttcattgctgatatgccagtacaaagacagctacgggagtgtttctagcagctctgtttgtaatggcctgaaattggagacaccccaaatgtccatcaataggtgaacaggtaaacacatgttgtgtgtccaaacgatgggataaatgcagcaacaaccaaaaggtatgcactgctgggcacacaggaacctgcgtgagtctcagaggaatcgtgcggagtgaaagaagccagatggaagagtgcatactgcagaattccatttacataaagctctgggaaaagcagcctgaagcagatgagtggtttcttggggacaggaaatggattcagggaggaacatgtgggaggggccaggaggagattttgaaggagacggacacgggcatcatcttagctgtggatggtttcatgggtgcatatggatgcccaaaattgtacacttaaatatatacactttattttatgcaataatacctcaatgaagctgctttttaaatttaatggaaggtttgcaagagcaagtcaaagaaattcccaaagtagaaccaaacgctgaagaaacgcaaaatacgggagagaaaagatgacagctagaggcgtagaggatccattcttatccgtgatcttctgaaatgtcatcacaatacaatctgtttggctatatgtgctgtttcatttgtctttctcaccattcactgagccctttgaattggaagatttacaactctcttcagctcttggaaacatcctttcagtatttctttggtaatggtctcttctctgccaggctcagaaaagattgggctcaagtattctagaagacagaggtgagacaagaaaggacattgttagaaatacccaaatctccaccttggccccaagcaaaaagacaaaggccccagcagactcccacagtggatgggaaaaatagtctggagagattgaatcaaagaatatgtgggcttgagaaccccaggtacagaggaaggctgtagagagaggtgaaaagaaggggaatgagtctcttctcctacgtgttcctgaatgctagtggctgggtttaaatcactccagccaggagattagaaaattattctctggagcaatggaaccatccacaggaagatgtatatagtctaaccattgggagtgcccagaaaaaaaatctgtttagccactcacttgtgtccccgccagtgaagccagttgtggcaaggcatgcacacagagcttccaaacagccgccaggagcttgtttctaaataaaaataaccaccaaggatcccccagcatttgaggaaagtcttcaacatggaagaaaaagtcaaaaacagagaaaagatactcaatggaaatataaagatgagaaggttttgcattcatggaacaaatacaagatgccatgaaagaggaaaattcaaagaaacagaaagctcttagaaattaaaattttgataccaaaaatgaaaaactcaattgaaaggttaaaaataatgagatggataatacagagaaaggataaatagaggataaatataataaggattaaggaatggtagaccagaggaaatgaaagggagacataatctaaaaaataagacaggaaaatcactttgggaggctgagatggaaggatagcttgaagccaggagttcgagataagcctgggcaacatagtaagaccttgcctctacaaaaaattagaaaaaaattaactggacacggtggtgtacagctatagtcctacctactcaggaggctgatgtgggaggattgcctgagctcaggagttcaagattacagtgagctatgatcagaccactgcactccagcctgggcaacacagcaagaccctgtctcaagaaaacaaaaagacccaattcaaagcacattctcaaggctttcaaagaaagacaatgaagtcataagtaaaagataatgagtttataacattatcatatttctcaaaagcaaattagaagctaaaaaacagtggaaccctcaaaattctttcttttttttttgtttttgagacagagttttaccctgtcacccaggccggagttcagtggcgcaatctcagctcactgcaacctctgcctcctgaattcaagcgattctcctgcctcggcctcccaagtagctgggattacatgcacgtgccaccgcgcctggctaatttttgtattgttagtagagacagggtatcaccatgttggctgggctggtctcgaactcccgacctcagatgatccacctgcctcggcctcccaaagtgctgggattataggcgtgagccactgcacccagcttgagccctcaaaattctaagtgaaaattatttgaaacctatagttctatacccagccaaagttccataaatgtgtgagtgtagaattaaggtattttcagaaacatgcaaagtatcaaaaaatattcttctcagaaagtatatgttcatctcttctgggtctttgtggttagaaaaaaatttttaaaaagtatgtgttccaccacaatgaagtgtaaaccaagaaagatgaagaaaatgatccaggaaataggagttttaacgcagaaggagattaaggaaaatcccagggcaatggtgaaggaagttccagacaactgctatgagaaaggacaggcggctccaggactgtggccctcaggaagaacatgaaataagttatttaacagatgttacatgtagaagattgagaagagtattgcagagctctcagattgtatgtaaagatttgggtacaagttaaaaagaaaccccagtcaatgaaaattcacagcaggaaaaacaaagacatatacaaagaaaggaaatataatagtgaacaatattttcacaggctaataatgaaaacctagagtatggatataattttttttaaactctgggcctgtaactattgggaggatggggagagaaagggtggaaggacactaaaatccacattgtcataatagaaagtcagccgatgtctagatagatgaatcaagagattatggcgttggcatattatttagaaatatagagacagactccagaacaagcattttgaacacattttaagtggccgtctggggtgtgtttctgtgtgtgatattagatcaagtcacaaatatggccaattaggaaactaaaattggagttacaagtatcctatcccagtaaggcaggagtgaggagaatctttcatgcagtgagttgataatgggtaaatgtgacaaaccaagacatatcagcttaaatttacactgtcgaattacgagatcaccaccagaagaatgacatcaggaaactgtcaaaagggccaacacctgtgggtgtgggatgggctgttgcttttgttgtgagccgtattgagtgggcgtgaggtagttaaactgagagtgccacagtgccaggccatggtgcatccccaggattcagggcgggcagacggcatgtgctatcggcagaagccttcgccggtccgtcactgggtgcagcagacaccccacctgcccctccgtattctggcccctcatcatggatacccttggcagggaggaacccggggaagttgccatcctgtcttttgggcgtttggtttgcttgcttttccctctgttggggctgcgcgtgggtgtggattcccacagtgggcctctcactgtgccttgaggtcctggactggggctcccaaggttaaacacagagcagttttttccatgacagcaccacctttttacttttggctggttcaccattggcagggcaaggccgctgggtagggtgtgcagttgagtgctggccacaggctcctgggccaggtgatggggggattgaatctggtaggggctgtgtccgagggagcagggcctgctcctagaagtctgcacaggggtaccagttgccagtcatgggcctgggctggggccactctccggggcacccacctacgtcaaaggtgattcactgaaggggagacctggatgaccgggttcgacagcccttcattgcgttttaatttaaatgaacaattcgtaagcaatgatcgcctggtgctgtccagaccctgagatgcgtggttgggaaggccgacctcatgttcctcccagagcatgcccagggttcatgtcccggggtctgcgctctgggcagtggtccccatgcctctgggggaagcccccttcttctcacccaagcccctgctttcttctccaagctggacctcacaaaatgtgaacatcttccccagcggggtgcaggggaagagcgggtgagagggtctgagtggtggcgcctctctccctgcagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtgtgagtaaagctggggctggctccggggaggacgacaaggggtggctgtccctcttccctcagcggacagacccagggccacctactgagtacacgaggatctcttggcctctctggaaccctgatggggagtgatgggaagcagtcagggctgacccatggccccctcctggcattcattccccattgtggacggcgagggacaggcgggggtggtaccacctcccctgactgagcgccttctggtctcacacagaccgggacgtgcgtgtccagaaggtcttcaatggctacatgaggatcacaaatgagaattttgtggatgcctacgagaactccaactccactgagtttgtaagcctggccagcaaggtgaaggacgcggtgagtgcagcctgcccagagtcctgctgggctgtgtgcgctggtgtcccacctgctgggcaggagggacatgcctcgcctgtgctcccagggccctgggatgggggtgatctgcaaaggggacccgggccctggaggggagggagcagcccgggcttggggcagggtcatcgccgcatggggctcaccttgagtctctgcccttcctcagctgaagctgctgtacagcggagtcccattcctgggcccctaccacaaggagtcggctgtgacggccttcaggtgggtgtggagagaaggctcagtgggatgcaccccagactggctgggagtaggatcggggtacagtgtgtggggcaggaagcgggagatggtgctggaggtcctggcctggagagccaaggagggtcctcgctgtgtcctcctgtgcgttacttggcagcctgactcttctgcccccatggcaaaggtgcctgtagctgttgctgtgatgagctgcccaaaggcctgtgacgtgcttggcatgatgccaggaacggctgtgattctttgttgtttttccaaatttgggtatgggggagttggggtactcaggcagccttcaatgagcccccacattttctgtgcttgagcagtttttcacgcatacttttgtaaaaaaatagactttattctcaaagtgctttttattttgctagttcgtttgaaccctggggaatgctgtgtggcaggtggcattcccagttcctttctcaggtcagaaaacaggctcaggaaggtgacactcggtgtgtcctcgcttgtggccaaactccaatgggtttcccctcctcattcctacccctgagcagcccccagaatcggtctggttggggatgagactgtgagagcagagggcaaagggcaaggcctcttgctttggggtggaaagagggatgacacaagaggagctggggaagggcctctgcagatggcaggcccaggtgtgccccgagccgcccatgtgtcctggagtcgctctgggcgcacgtgggggaaatggggcccagagctccgcctcaggctcccgctctctccccagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccgtgagtccgagggccaggggtgggcgtgggactggccagccttccatggagtggggctgggccctggaccattgcaggggaccggcactcccagggcccagtgccccagagagaagactacgtgctggccgggcacctccctttagataataaggaagcaggaataaggaaatggattgtatcaggaaatgctttattctccttcttattcttcagccacggactccaaaacagtacagaggacccaggacagtaagtatcgtgcccgcctcctcttctgggtggggaagaggcgggatgtggccagatgcccttgagccagtggggtccccagaagcatgtccctctgaatgaagtatattatgacgatctttccaggcccttcctcttccaggcccttctgagaagcccccttcctgatttcccgaggcccagggcagcctggggcgtctcgaaggggcgaggcctgaggtccacacccacggggtctcagggtcctcccccagctctgcccagccctgcccccacacgtgccctccttcttgtctcctgcgcagacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagtgagtaccccggggggcgggtagggctgtgggagcttggcggctgccctgtagggggccagcttcttcaacgattgggatacagtttatgactcttggccgcaggccactgctaaacatccaggcagcaggaggcacgtgtggtgtgatcctcagctgcagctccaggggagtctgggaggtgatttttctcagccttggcaaagcagaggaaggctctatagtccccagataccaaatccagcctgtgcggcctgtgccctgaaccgccggagagaaggcactgcccacggttgtaaaatgtaggctttattattcagggatatgaaggccaacagatcaggagatgactgctcttgaaaagacaattttgttggcgggcacggtagctcatgcctgtaatctcagcgctttgggaggctgaggcgggaggatctcttgaggccaggagtttgagactagcctgggcaacaagactctgcctctataaaaaataaaaagcttagctgggtgtggtggcgcatgcctactcaggaggctgatgcaggaggatctccagcccaggaggtcgaggctgcagtgagcggtgattgcaccactgcactccagcctgggcaacagagaaagaacctgcctcaggccacatgaggaaacaccaggttggtcaaggggtaacaggaatgaggggaaaatgtaagcaagagccttttatgggccgggcatggtggctcacgcctgtaagcccagcactttgggaggccaaggcggctggatcacttgcggtcaggagtttgagaccagtcaagccaacctggtgaaaccctgtctctactaaaaatacaaaaatcagctgggtgtggtggcgggcgcctgtaatcccagctactcgggaggccaaggcgggagaatcacttgaacctgggaggcagaggttgcagtgagccgagatcgtaccactacactccagcctgggcaacagagcgagactctgtctcaaaaaaaaaaaaaaaaaaaaagagcctttatatggtttacacagaaaaggcaagacaaatcagggtgagaggtttagaactggcttgtttgaataatttcagtaggctccggggcataggagctgtccctagttctctgatacttgggcctggggtggttagggcaaagaatagtggccctgagtgtgagatcctttcggaggaggtggggctgggcccccataggtgggtttgcatagggaaggtttgcttgcaggtgagtcctttcctatctctaagcattggccagccttccacagtcagcagggcctcagatgtcaaagcacctgcattacagaaaacggaaaggcgtggttaatgcacctgtgggataccccacgtcagggtggggcgtacctcgcagaggtgctgtgcgtggtgggtgagccgcctctcctgcactcgctgggccagagccttccgtggctgtctagggaaatgagctcggcggacgtttcctgattaataatgggctaaaattcaggccaagaacaacctagaaccatctgccgccacagcttcgtaaccaggacttcttttccatctctctaatttattaattgtacaacaaagaagtacatgttcccagtgggagaaggaaatcggcaagcaaaaggaagactaaagtcactcgtcatcttactgtctagaaataaccactgttaattctttttctttgagatggaatctcgctctgtcgcccaggctggagtgcagtggcaagatctcggctcaccgcaacctccgcctcctgggttcatgcgattctcctgcttcatcctctcgagcagctgggattacaggcatgcgccacaacactcagctaattttttttgtatttttagtagagatggggttttaccatgttggtcaggctggtctcgaactcctgacctcaggcaatctgcctgccttggcctcccaaagtactgggattacaggcgtgagccacagcacccggccaaatttttgatgtctattttcccagccttttttgctgtgtgtgtgttaagaaataggattatcccgtgcattcagtctcatta

SEQ ID NO: 898 - DNA, 5851 bp, Homo sapiens
tctagacattgcctgtagtagttaatttggggaacagatatcttttttgcatttgagtgtaagaaaaggaaaaagacagtttggatatggaagttctgttgtgttctctctcctcctcctcctcaaagatgagtcatttaaagttgattcaggtgccagacaatgaaaaagaggggtgcaatgtctgccatatgaattgaaatgttttgatgagagggcatctgcaggagaattatctggtggttgttctatctttctttctctgtctctttttctctcctggatgctcagcttcctttaaaaaaaaatctttgcctggctccatcagatctcctgggtcctgagccaagtcagatgctgccatttccatgatgaccactgggttagtaccagattccttccccagcctggctgaggtggggaaaatcccttccactgtggttcagctaaaaggggaaaaatagtcttccaaaaaagtttacaaggctactaagaggagaattatgtttatagaaaggcatatataaggctgagcatgctgactcacacctacaatcccagcactttgggaggccaaggcaggaagattgcttgagcccaggaatttgagaccagcctgagccacagagcgagactccatctttacaaaaaagttaaaaaaattagctgggcatggtggcatgagtctgtaatctcagctagttgagaggctgaggtgggagggtctctagagcccaggaggtggaggttgcagtgagctgagattgtgccactgtactccagcctgggtgacagagtgagaccttgtctcaaaaaaaaaaaaaaaaaaaaaaaaaaaaccaaacggggggcatatatgcgtaatgtctggatctattaattacggcaccagaaagataattattcagcacctactgtgtgtcaggctgtattatcagtgtttgtgtgagctttgggtcctacaagaagcagatatcaacatgggactaaatatgtcagaagttaattgggggaaatgcctctgaagaataaagggggaggaagcaggtggagtccaggagactgtacactactatgctgatctgacacctgtgaaagtggagcaggaaggcatgattgggcatgaagagcatcagatcacagcacagtcctgagaaagtctcagctaggccattggagagggacctagtccgagctgcccactgaatggacaagcactaacacacccactatgctcattcaccagttgagacaagactggtgaaagtgtgtcctcagcactcacagggcggcagctggaggctatcagccagccagactccctactgtgggctgtctttaagggtgatctgagtgggtcatctccatggctaacattttgcttcacgaaaaatattgtttgctctttgtagcactttgaggtagatattatcaattctatgccagacctagaccctgttaatcccaataacaaaatatcagtcccaagtatctgttccctctgatattactctctaactttccagcttgccaccttccagtaccctgactctagggattctttgttccaaatcaacgtccattgccgggcgcggtggctcatgcttgtaatcccagcactttgggaggctgaggcaggtggatcacgaggtcaggagtttgagaccagcttggccaacatagtgaaaccttgtctctattaaaaatataaaaaattagcctggcgtggtggcaggcacctgtaatcctagctactcaggaggctgaggcaggagaattgcctgaacccaggaggtggaggcagcagtaagccaagatcgtgccactgcactccagcctgggtgacagagtgagactctgtctcaaaaaacaaacaaacaaacaaacaaacaaaatcaaaaatccatttgttgaccctccatccactaaccctccagccattgactctacttccttttgcctgaccacactttcctcagtacttggcttagagttcgtggttcatcaatatgatcatttccttagatcattcaccagatatcctcaactctttgtctttctttcacctaagaaaaccctctgcctgactgagtacgactcttaacctactctgtgcttgagcctgagaactgaaacagtatgactggcttacccaaagttagtgatcaaacacttcaggtggacctcagtactttccatgtatcccttttctctagccaattcactcttatacttatggaaaattgtcttgtaccttctctttcttcaaatttccaacatctcttcccactcattctcaactataactttgttgagaaaaggtgtctttcaagaacatgccataggagttggagctcaaggatatgtggtcaaaccccagcttcaaggaaatgtaatcaagcttagagaaagatgaactccccgagcttagtcaatatgtcaagacagagattgtcacaagaaacaaagctggagccaagttcctagaattagatgcacacagagctccccagggttttctgagagttgacttcatccacatgatccactatggctccctaccattttggtaacattccagcaagtggggagggcaaaggggaaaaagagtggcacaccttccctttaaaggaataatcctgaagtggtatgcacaacttcacagagttccccagagttttctgagtctgggtcagaattgaaacctgttgaggcaagtggtgtggttctagccgtgaagacacaaaagcttccaaaaccaaagtcaggcagttacaccttggggctcccatgatttctggctgccacatattgctggagcctctctgtcacaaatcagctacctccaacagaagcaattgtcttattcctttgttttatttatttatttatttatttatttattttgagacagagtctcactctgtcgcccaggctggagtgcagtgaccgtgatctcggctcactgcaacctccgcctcctgggttcaagcgattctcctgcctcagcctcccaagtagctgggactaccggggcgtgcccccatgcttggctaattttttgtatttttagtagagacggggttttaccatgttagccaggatggtctcgatctcctgacctcatgattcgcccgccttggcctcccaaagtgctgggattacaggcttgagccaccgcacccggccctgttcctctttttattatattaagcactttataaacacttgttttttgcctgaagaatacttatgagctgagtgcggtggctcacacctgtaatcccagccctttgggaggccgaggcgggtggatcatgaggtcaggagattgagaccatcctggctaacatggtgaaaccccgtctctactaaaaatataaaaaattagccgggcatggtggcacgcacctgtagtcccagctagtcaggaggctgaggctggagaattgcttgaacccggaaggcggaggtttcagtgagccaagattgcaccactgcactccagcctgggcaacagagcaagactccatctcaattaaaaaaaaaaaaaaaagaatacctctgatgatcagttgtagggtagagatgatttgcatcccctaaaccttcagaacaggcaaggctttctgactcatgtcatctctcatcagaatatctcctcatatttctcagggtggtggctcattagcctccctcctctcacttgatgagacacttagcttcgaatcttatcattttcatttgactctgcctgtagggcaactatccggtagcaatggaagatcatttccattaggacctgtatttgtttatttgtttacttttttttaacaagcttttattgagtacttctatgggataggtacactggcggtacaaagatgaataagataaagtcataatcctcaaggacttcatcttctaggggaaatatatttgaaaagaattaatcacaatagatttcatgcataatttaagttagaggtttggctgctgtaacagagacaaaaaataaagagtgcttaaacaagatggaaatgtatttctatcttatactagtctgggcatgaggagaatgggactgatagggaatcttcatagtgtccctctgtgtcatagttctatccatacagatggatgtcatgctcatccatccacagagagttgacttcatcttcttggtccagtatggctccccaccattttggtaaaaacacattccaggccgggcacagtggctcacacctgtaatcccagcacttcgggaggccaacgtgggcagatcacgaggtcacaagattgagaccatcctggctaacacagtgaaaccccatccctactaaaaatacaaaaaattagccgggcatggtggcatgtgccggtagtcccagctactctgaaggctgaggcaggagaatccctggaacctgggaggcagaggttgtaatgagcacagatagtgccactgcactccagcctgggcaacagagtgagactccatctcaaaaacaagcaaacaaacaaaaacacattccagcaagtagggagggcaaaggggaaaaagaatggcacaccttccctgtaagtgaataatcctgaagtgttacacataacttctactggcattccattggcaagaacttaacttcttcatcacaccttgagacaagagacctgtaaagagaactactaatgcaataactgggtgagaaatgatgagggtcttgctggttagaatgcatataatcaaaaagaaaaaaatcttccatgtaatttcataagtttcagaacttgtgatacctcaagtttcagaaaagctaaagaatgaagttttccagaatatgatctgtataaataaatatgcatgtttctagtttataataagatactttctccaaatatcaaccatatattgtgacaataaaaaccatccaaactcacatgctgctgcatattttatctataatgttttcatttattaatatttatgaatttccttctcccagtgggttttcagaacattgcctcttccacacaacacataaaaacctgatctcgcaagatgacctttcagactaactttttattcttatgctaatacaatcattcttatttctattatacatttaattccagagtaacataatgctcaaagttactctgtttatgcctatgcaactctttaaagaatatgatgtgaaatctcttttcttgttcttcaaattcatactcttttgtttgctgttattaaatcccaatcacatacacaaagataactgtctctgagatgcttttaatgagaattagagtatttatgttaattgaggctttagaacgtatatctgatataatttgtgcttgagttgtttctatacaattctagtgcatcattgattttattcctaatgtaccattacttacaaactaggggtttaagttggaattgttaataaaaataggaataatcatagtatataaaatattatagactgaaataggtttgctaacactgaatgagtttatattttgttttgttttgattttttttgagacaaagtttcattcttatcgtccaggctagagtgcaatggcacgatctgggcttactgcaacctccgcctcctgggttcaggcaattctccagcctcagcctcctgagaagctggggttacaggcgacaggcaacatgtccggttaattttttgtatttttagtagagatggagtttcaccatgttggccaggctggtcttaaactcctaagctcaggtgatctttccgcctcagcctcccaaagtgctgggattacaggtgtgagccaccgcgcctggcccaagtttacattttaa

SEQ ID NO: 899 - DNA, 489022 bp, Homo sapiens
gccagatactaattgaggtaggattcataaagcactttttgtaatccttcttctttgtggatagcttgacaatttgttcaaaaaaataaactcatagtggtggtatgcaactttgttaaaaataaaactgtaaatcaaaaagtgaatttcattgtatgtaaatttaaaagtatgttagaaaacatcaatatggcaggagaacaagtttgacttttttccgcaactagtgtctactaccacctttctggatactttaaaaagttgtcagcttttaaaattgttggtataaaacatttgggaagtttttaattggtatttgtgcttcaaaatttaagacttttctaagtattcagaaatattcaaaggaagagatgaattttggaaaacttgtttgcctttatgtgcttaatctgactttaagttgaaatttgaacagtgaataataattttgtttacataaagttttttgacttctatattaggaaaaaaactagcttgaggccaagtgcagtggctcttgcctgtataatcagcactttgggaggctgagtcccgactgcttgagctcaggagtttgagaccagcctgggcaacatgctgaaacatcatctatacaaaaaaagtacaaaaattaactgggaatggtagcatgtacctgtagtaccttacagctactcatgaggctgaggtgggaggatcacctgagcctggggaggtcaaagctacagtgagctgtgttagggtcactgcattccagcctgggcaacagagtgatactccctcaaaaaaaacaacaaaacagactgggcacactggctcacgcctgtaatcccagcactttaggaggctgaggcaggtgaatcatttgaggtgaggagttcaagaccagcccggccaacataatgaaaccctgtctctactaaaaacacaaaaattagccaggtggtagtggtgcatgcctgtaatccgagctacacgggaggctgacgcaagagaattgcttgagcctaggaggcagaggttgctggtggggaggttgccagtgagccaagatggcgccactgcacttcagtctgggtgacagcccgagaccctgtcttaaaaaaaaaaaaagggccaggtgcggtggctcacgcctgtaatcccaacacttagggaggccaaggagggcggattacctgaggtcaggagtttgagaccagcctgaccaacatggtgaaaccctgtctctactaaaaatacaaaaattagccgggtgtggtggcgggcacctgtaatcccagctactcaggaggctgaggcaggagaatcgcttgaacccaggaggcagaggttgcagtgagccgagatggtgccattgcactccagcctgggtaacaagagcgagactccctctcaaaagaaaaaaaaacaaccagaaaccccgaaaaagaggtggaggggatgtatccttttttgttcatgtcaaaggagtaagctgggttgattacttcagattttgtgttagccatactttaagattttgtaagttattttgctgtgaagagtaccttttatttatgatattaaaggctttaacttaaattatccttcaaaactttggaggcaacaaagatgtctaccatggtttcttggatcaggtattagtcacttgtggaagtggtcacatagttttgtcttagagaaagttttgattataaagagaaggcataggcagggcatggtggctcacaactataatcccagaactttgggaggccgaggcgggtggatcacctgaggtcaggagttcgagatcagcctggccaacatggcgaaaccctgtctctactaaaaatacaaaaattagcctggcatggttgtaggcgcgtgtaatcccagctactcggggagactaaggcaggagaatcacttgaacccaggaggcggaggttgcagtgagttgtgattacaccactgcactccagcatgggcaacagtgcaagactccatctctaaaaaaaaaagagagaaggcataaaactaaaggaagaaaggaagaagagaaaaggaaatatttagttttttttttttttttgtgatggagtttcactcttgtgcgatcatggctcacggcaacctctggcctcacgggttcaagcgattctcctgcctctgcctcctgagtagctgggattacaggcatgcgccaccacgcctggctaattttgtatttttagtagagacggggtttctccatgtgggccaggctggtctcgaactcccgacctcatctgcccacctcggcggcctcccaaagtgctgggattacaggcgtaaaccaccgcgcttggccagaaatatgtagattttaaagtgaatgaaaataagaatctttaaattatcaaccaaaatttgtaagttaagtcactaaaaatgaaattagaggatctattgtaattttgatgcaatttttttgaagatactttccaaatagtattttttcccctctggttcattttaagagctgtatgttgatcatgaccttgggatgactgtttattatttctaagttttcctgtgtgtgacattttccttttcacttttgatcacatttgtttgcctgaaaattcttcttggcccctgtcgttgtatcctcaattttcttcatagtttctctttgcctttggtgccctttttctcctcctcatcccacccaatcacttggtatattctttgttttcttcttatttaatatgcttggatagtattctctggaagtattaacattgcaaggatgagtaaattaggtttcttttattgagtgttgcccttaccactttcctgtttctattgccttctcaaaaatctggcctttgtgtagaattcttaggcaaaagatgatagtaatggaagtgaaaagtgtggagcaggactggggttggcagatcatcaaaagtttgacttcattgttctgaaagtttgtgtgtcttacagctgtgtggtaatctctttcagaagacaaactaagttgagtctttatagccattctctttccaatgcttttcagaggttatatgatttgtcatatcacaaaggatttttcagaaaaatcagctaattacacctttttttgcaatatgacactaaatttgagacagaataatctttgctttagttctccctatgttatgtattataaatacatgtatcttacaatctactataaaaccataaactggctgggcgtggtggctcacacctgtaatcccagcactctgggaggctgaggtgggcggatcacccgaggtcaggaggttgagaccagcctgggcaacatggtgaaaccctgtctccagcaaaaaatacaaaagttagctgggcatggtggtgggcgcctgtagttcccagctactcaggaggctgaggcagaggaaccgcttgaacccgggaggcagaggttgcagtgagccgagattgtgccactgcactccagcctgggtgacgaagtgagactctgtctcaaaaaaaaaaaaacccaaaaaaatagggcccagcgtggtggctcacgcctataatcccagcactttgggaggctgaggcaggtggatcatgaggtcaggagttcaagaccagcctgtccaagatggtgaaaccccgtgtctattaaaaatacaacaaaattagccgggcgtggtggccggtgcctgtaatcccagctactcgggaggctgaggcaggagaattgcttgaacctgggcagcagagattgcagtgagccgagattgcaccactgcaccccagcctgggcaacagtgagactctgtctcaaaaaaaaaaaaaaaacgccaggcacggtggctcacccctgtaatcccagcagtttgggaggcgggtggattgcctggggtcaggagtttgagaccagcttggccaacatggtgaaaccccgtttctactaaaaatacaaaaattagctgggcgtggtggcaggtgcctgtaaatcccagctactctggaggctgaggcaggagaattgcttgaacccgggaggcggaggttgcagtgagccaagatcacaccattgcactccagcctgggtgacaagagtgagacttagtctcaaaaaaaaaaaaaaaagccataaactaattaaccctgcaagctcagcttgtcctttaaatactgtttaccttctagatatagtccagtcatgtatggctgttgaaattactgttaaaaaagtattcgcttttttttttttgagacagagtattgctgtgttgcccaggctggagtgcagtggcgctgtctcggctaactgcaagctctgcctcctggggtcacaccattctcctgcctcagcctcccaagtagctggaactacaggtgcctgccaccacgcccagctaatttttttgtatttttagtagagacggggttttactgtgttagccaggatggtcttgatctcctgacctcgtgatccgcctgcctcggcctcccaaagtgctgggattacaggcatgagccacccgtgcccggccaagtattcactttttatcatagatggcctaccgattaagtcatatgttattgttgataatgtgatattgttgataatgtgatatgtgcatatatccctgagtaaactgaatgtagaaatatgtagtactctttggttttacaactatagagatgaatgtatatttaaaataaacttgtggcctgatgcagtggctcacacctgtgatctcagtgctttgcgaggctgaggcaggaggattgcttgaggccagctagtaagacctggtctctacaaaaaaaaaagtagccaggcgtggtggtgcatgcctgtagtcttagctacttaggaatctgaggcaggaggattgcttgagcccagaagtttgaggctgcagtaagctataattaggccactgtagtccagcctggacaacagagcaagaccctgtctctcaaaataagaattaaaaataataaacctgcattgagaaatggtattgcctgtattagggatctcaaatattttggtcttaggacacttttacactcttaaaaattgagaatcctggcctgtaatctcagtgttttggcagtctgaggtgggaggatcacttgagcccagcaatttgagactagcctaggcaatatggtgagacctcatctctacaaaaaaaaactacaaagaaaaaaaaaattagctgagtgtgatggtgcgtgcctgtagtcccagctacttggaggttgaggcaggaggatggcttgagtccaagaggcagaagttgcaggggactgagattgcactgctgtactccagcctgggtgaaaaagctgtctcaaaaaaaaaaaaaaaaaaaaaaagagaatcccaagaactttatgtttgtactgtcgatatttactctattagaaattaaaacaatttttaaaaaatactcacgtaaaataacaatgataaacccattacaagttaacaaataatttaggaaaataactattttccaaaacaaaattaagagaagcatggcattgcaatagaggcctgtaatgaatggctatttaatagaagacagctggagtcttttgtctgcttctgtatttaacctgttggaatatattattttggttgaaataaacgaagaaggctgggtgtggtggctcatgcctgtaattccagcactttgggaggtggaggtgggacgattgcctgagggctggatttctagacctgcctgggcaacatagtgagaccctgtctataaaaaaatccacggccaggcgcggtggctcacgcctgtaatcccagcactttgggaggctgaggcggatggatcacctgaggtcaggagttcaagaccagcctggccaacgtggtgaaaccccgtttctactaaaaatacaaaaattacctgcgtgtggtggtatgtgcctgtaggcccagctacttgggaggctgaggcaggagaatcacttgaactcgggaggtggaggttgcagtgagccaagatagcaccactgcactccagcctgggtgacagagtcagactccgtctcaaaaaaaaaaaaaaaaaaaaaacaacaacaacaaaaaacactaaaactaaaaattagcaaggcatggtggtgcacacctgcagtctgtagttacttgggaggatctcacttgagcccagtatttcaaggctgcagtgagctatgatcatgccagtgcactccagcttgggtgacagagtgagacaccccatctcttaagaaaaaaagaaaagaaaaggaaatacacaaaaatctaggcttacacagatatgtagttggtaaaggaaggaatattatttaaatagccttttcaggtaatttaatctttttttttttttttttttttttcctgaggcaaggtctctctctgttgcccaggctggagtgcagtggtgctatctcggctcactgcagcctctgcctcctgggctcaagggattctcatacctcagcctcccgagtagttgggactacaggcgcatgccaccatggctggctaatttttttggtattttttttgtagaggtggagttttgctatgttgcccgtactggtcgtgaactcctgaggtcaagcggtccactctctgcagccttccagagtgttaggattacaggcgtgagccactgctcccagcctgaatcttcttgtgatactatacaaaaactcagcaagtgctagtttctttgttggagtatggaatctgaaattgtttatgaacctgttggtctttcgtgaacttcaaatggatcttttacccatgcctgatttgtaacatgcattagtgacttgaaatagtattcactgtgttttgcagatctccaaatattgacacatttcattatacagtactcctttcccctcagaaaatcctcacattcattaatatcactgcccatctcatcataaaagtctttaattaatgggaagctgtcaggctcataaatatcaaatgttttccaaaattctaatttttacataaaacccagccttttcattagcaagagatactgtcaattgttttctttgaagtagcaagctcattttttttccccagaaaatgtcaggtagctaagtctgaatagccatagtttatcatttgttctttcagaaggtaaaaatggtgttccatgaaaaaaagcagctggtttaacttgccgctcttcacttaagtgctttttctccagacaacatctgccggtatgcagaagtgctttgtgcgtactgcctattttgtcacgcaatatattaaaaaactgtacacaggctcaagacttaataaaatgaataatttttactgctgcatcaagaacattcttaagtgaaaccggtactccaaccccaatttgggtggtgatgaagaatacaattcagcgcttcttacagctttgctcgatccctcctaaggcttcagcagtgtctacacaccattgcttttacaccattggtacaaatgttgacatggtgcaaaaagcaagtaacatcttagtgtcattacgaaaatagttttgatctcacagatgccctgaaagagggacatccaggtttctgcccaccacattgtgaaaattgatgattctagataatacaaaatggcttctgttactgttctggtggtttaaaaacaacaaaaaacctcatttagttctctacctagaagagtgaattgcaactctcatcttgtgcttttacctgtgattttaaaaattgtaatcttgcctttgaaacaaaaatatgccaattcataataaagtctacatgagagtacatgtttggatttatatttctgtgcttctttcttttatataacataccatttcatatttgtgggcccagagtaaagagctcattctgttacagacactgaatagccttgtttttgtcagtagtcagctctgttttaaaacaattgcttgggtcctgctggctcaacttgcagttgtcctagtcctgagtcttgtcttagccaaagactgttgttggaaagcccacacaaaggccttgtgtataggatgccctactattaaaggagcatgttctagtctcagtggattaaatttgctttggtgtgcattcccttaccaaatttctcactactttgtttggctggttatttcagtgaaaaatcattttaacgtgaaggcagatttcttctaattattacatagtcctagtggtgacggttattggagtaaaataattttttttttttctggtaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaaaaaaaaaaaaaatatatatatatatatacacacacacacacacatatgtacacatacatatatatacatatatatgtatatatagaacacatggcaagagcaggaaatgggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaaaaaaaaaatatatatatatatatatatatatatatatatatatatatatatatatatatatatagttttactaggttttcatggataagtttttaaatgtaagacaggaaagggatctatttgatgtctatcttcagatatattggcagttttccttaagctatttagttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgctttgtagtttggtaattcttagattttactattggtttctttgcttagaatgagtttctaaatgtgaactacaaaaaccactctacttcaagcatgatcattagaagaaggttagggatgtccccaagcatcattttatcccttaaaactacagatagtttaggtttctgcctgaactaatctaagttagctttttcttcacatctcataaactaatggtgggaggacacaaagagctttatgaaaacatttttgatggcagataaggacggagtcataaagctgtatccatgcagatgtgttatgctgacattattgttattattgagatggagtttcactcttgttgcccaggctggtatgcaatggcgtgatctcggctcaccacaacctccgcctctggggttcaagtgattctcctgcctcagcctcccgagtagctgggattacaggtatgcaccaccacacctagctaatttttgtatttttagtagagacggagtttcaccatgttggtcaggctggtctcaaactcccgagctcaggtgatccaccagcctcggcttcccaaaatgctgggattacaggcatgaggcactacgcccagcctatgctgacattattaaagccaacagatagctaatctgaaaagttcatgtgcatttttttctttttttcttttgtttttttttttgagacggagtctcgctctgtcacccaggctggagtgcaatggcgccatcttggctcactgcaagctccgcctcctcatgtgcatttttcttgaattggttctgtgtactgcatttgttctgtggagcacctcagtgaatagaagattttgccctttccactctccagaggcttttgaccccaagttgtgctctttgacaatggagagttattgcgtaaaaagtgacaataaaatcttgacatttcatatctgcaaaatttcacttaaaaaaaggtaaatttcataggagtaagtcgcaaaggaaaatccataatgtcagtgctaataattgataagattagatctggaggggaaattgtaagtgcacagcattcattaaaatatttgattcaatcaactaattaatagcaaattcaaaacaaaattggaaatagttatataaaaattaatacaatttgtttgatcaaatgttttctttagaaagtgatctctcaaaaattgatgagtgttggtttacttctaaatatggaattgaaatgactttcagaatcacagcaaggtctcgattttcagcacctgattactgatttggtagcctagcacggtggctcatgcatgtaatcccagcactttgggaggccgagatgggtggatcacttgaggtcaggagtttgagaccagcctggccaacatggtgaaactcaatctttactaaaaatacaaaaattagccgggcatggtggtgtgcgcctgtaatcccacctgcttaggaggctgaggcaagagaatagcctaaacctgggaggcagaggttgctgagagccaagatcacaccactacacaccagtctgggtgacagagtaagactccatctcaaaagaaaaaaaaaaaaaatcactcatttggatttgtaaagtaaatgaaatttcaaaaaaaaaatctgtcttgagaaggtatgatgcctttgaggttgtaagtcaaatttatgtgtatagttttgctagttattaaagggatgctttataattaagcttctttttgtgtgtcctaggtatgtttctataaaacctgataaccgaaaattggccaacggaacaaatgtcctcggcttactgattgacactttattaaaggaaggctttcatttggtcagcactagaacagtatcttctgaagacaaaactgaatgctatagctttgaaaggataaaaagccctgaagtgctcatcacgaatgaaacaccaaaaccagagactatcatcataccagagcaatctcagataaagaaatgaagttgtctatcctcttttaaagagaaattgccatttttcttgtttcattacgtatttagggcatacatgttagccaaatctacactcagcctaactcttggcttcatctgctgccatgccgtctctgggcaaccaggccccaactgtgcttaagccataatgcctgctgctctctagacaactccatgtacttggtgctttggtatatgttctaccttcaatacatctttccctttctcttcttcatgaatgcttatgagccgagattgcgccactgcacactagcttgggtgacagaggaagactgtctcaaaaaaaaaaaaattgatcaaactgatggataccctaagtaccctgacttgatcattacaccttctatgcatgcaacaaaatgccacgtgtaccccataaatatgtagaaatattatatgtaaataaatagttgggccttccgtattttcccacttatgtttgtttcagcatttatttatttatttatttttttagacggagtttcgctcttgttgcccaagctggagtgcaaaggtgcgatctcggctcactgcaacccccacctcctgggtacaagtgattctcctacctcagcctcccgagtagctgggattacaggcaggcgaaaccgcgcccagctaatttttgtatttttagtagagatggggtttcatcatgttggccaggatggtctcaatctcttgacctcgtgatcagcccgcctcggcctcccaaagtgctgagattacaggcgtgagccaccgtgcctggccccagcatgtttttatcaatcacagtttcatttctgacaaggcaccaaatattttatttatttatttaatactctttatataatactctgtcaccaggctggagtgcaggagttggaagctgtagtgaattctggtgtaatcataactcatgcagcctcaaactcttgggctcaagtgatcctcccacctcagtctcccaagtagctgggactacaggcgcataccaccatgccagggtaattgttttttattttttgtagagacgaggtctcacatgttgtccaggctggtctcgaactcctggccttaagtgattctcccactttggcctcccagagcactgggattacaagtgtgagccaccatgcctagccaaggcaccaagattttagcttatgattcttgaacctcaataatttaccttataagtgattagaagttctccctacaaatcttttctgaaaaacagctctaatgcttaattttactcttggatttaatatacaagttgtaattacaaagagttcttagggtatggtaaagtcaagattaatttaggctgcttttttttttttttgagacagggtctcactctgttacccaggttggagtgcagtggtgcgatttcagctcactgcaacctccatctcccaggctcaagcgatcctcccatctcagcctcctgagtagctgggactacaggcatgtgccatcacgcccacctaattttttgtatttttggtagagatggtgtttcaccatgttgcctaggctggcctcgaactcctgacctcaggtgatccgcccgcctcagtctcccaaagtgctgggattacaggtgtgagccactatgcctggcctatttaggtgctttaaaaatgtatttgaaatcaggagcctgaagtagtataaaatggtcacaagaaagcagcttgagaaatacatggtttaggaaatcaaaatctgtttctaatttgtcctttataccatttacaagtgacaaacttcagctttgctttataaacttttgtactgattctctatcataagtaatagaaatgttcacatcaatagagaattacaccactagagactatgctggggtaataaaagatttgctaagagcactcaatctcttatattctactgctatttttcctctgtgctagggaagttgactgtaatggcaagtttagcaacgtagaagctaccgtgaggaaatcttcaaaaataaatttatgaaattgtattaccttcctggaaccaaaggacccatgggagacagcaatgtggcatcagacttagcatttttaaacaaatgctcagaaataaagataggacattttaaaattactaaaaatacttagctttctggaatatcaatgacctagtaaaaaacgtaagtactgggctggcctggtggttataatcccagcattttgagaggtcaaggcggaaggatccttgagcccaggagttcgagatcagcctgagcaacagtgagacccccatctgtctatgatttaaaaacaacatcaacaacaaaaaaccccaaaaatcacaattaccggctttgctgtagaactatatacctcaagacttactaggatttctggctgggtgaggtggctcacgtctgtaatcctagcactctgggaggctgcggtaggcggatcacctgaggtcaggagaccagcctggccaacatggtgaaaccccgtctccaccaaaaattacaaaaattggctgggcatggtggcacgtgcctgtagtccccagttacttggaaggctgaggcaggagaactgcttgagtctggaaggcggaggttgcagcctccgccgagatcatgccattgcactccagcctaggtgacagagtgggactctgtctcaaaaaaaaaaaaaaaaaaaaaaggatttcttttgggcctattataaatgaaaagtacaaattttatcaaaacacttcatcatcgaaaataccttaatatttaactaaactatgagatccaatcacaaaaatattttcatggataaaaagctaaaatcttacatgggtgaaaatggaaaatgatattacgcatggcacagaataaaaacagaactaaacatgtagcaaaataaataggaccttgctcccaaaactaaaatgtgtttaagacttgcctaaccacacaaggcttttaggtaggtagtcttctgtaccttcagatttcacaccaacacctcaaaatccagaaatcattaaagcaaatggctttttattaaacaaatggctttttatcagtagggtaaaacataccaaataagtgtttcatttcatattattcttcatcatctcacaacacttctggaaagaatgtgaatttcttcaggttcatgagtatgaggccaaataggagagatttgttttaccctttttttttttttaagcaggatttcaccctgtcacccagctagagtgcagtggtgctaccatggctcactgtaacctcaaaatccagagcccaagctatcctctagcctcagcctcctgagtacctgggactgcaagtgcatgccaccatgcctggctaatttttaattttttttgtaaagatgaagtcttactatgttgcccaggctggtcttaaacttctgggctcaagcaatccttccacctcaccctcccaaagtgttgggattacaggcgtgtgccactgcacatggtctacgctttctgtaataagagacctccaaggaaatctggctgcaatgtttaaggttccatgagttcttttaagatgaggactgagactgctatagtggtctatgtcatactcccccatagtgctgggcatctaacaagctcaagtgaactgaactgaaacatttggaaactatagtctcagtgaatagatgcttggaaaaacaagatttatagtagattcaaagatggaagaggataatttaaataatacaatctgaaagagttgactcaagttacagattacagaaactaccccagagtattttcaattagtttacttggggccaggcgcagtggctcgcgcctgtaatcccagcactttgggaggccgaggtgggaggatcacttgaggtcaagagttcgagaccaacctgaccaacatggtgaaaccccgtctctactaaaaatacaaaaattagccaggtttggtgggaggcacctgcaatttcagctactggggaggctgaggcaggagaatcgcttgaatctgggaggcagaggttgtagtaagctgagattgcaccattgccctccagcctgggcaaagaagtgagactccattaaagaaaaaaaagaagtttatttgggtaatgccatatggaaaggagatgaaaatatagatgtatatggggatataaacttgttgcagattacacaaaattatatgtttaagcagagaatagtccagttaaaattgggatatacttaatttgctaagaacaatgtaatgctaccagcatgcttaaaattaaaaaaactaagagaatgtaagttcaaaatgagtgtcacatgactataattgatagtaaatcttcacttacctccataacttaggagtcatgaaaagaaagaagttagcagaccaggcatgtaaatcagatgtaagtaggatggaatacagaaatattcctagttctgggtaacccaatttgaggtcattttaagtttactgaatttggattaatcaattggttcaataatcaaggtaaaatggtccaaaagatcctgatatatccagaagacatattactgaggttttacaaggctaatttgaaatgcagattaacattctaggtttccttacatatcattaaaatagaccatattaaaaatcaatttcagaagctgctttatgactggaataaaaaacaattaaagatgtagagtaacattgtatttctgtctgatgctgggaggctattttttcatggcaagtaataactgggtaaacagagagatactttaactttacaaataggaatcctagaaaacaaggttttgctcctagaaaacaaaaatagttcctttcaattaattttctaaaaatggttgcattggtcactttttaaactcctacaatctaagcagcactgaattcctatttgatttttttttttgctaatagttttcttcagaagcaaacctgctttagggtgaaaaaaagtttcagaccttagacagaaccttcatttcctcttaagtatgtttctccatcaaaaacaagtattcaaataaagaatctcaattatctaaacctatttttggccatcttccggaatttcttgttaaatctcctttgaaatgccacagttgcactcttggaaaacttgtcttcctggttttcaaatttctgtttattattacagctcttcagctagaatgccaggtctttgtgctgtactgtttcttgaaactggagactagcacacttcccccaattcaattacttgctttccatttgagaaattaaagccaggtcaattttataaagttttaactgactgaattatttggactttaagttctcaatttcattcccttagcctaatactgggaaagatcttggttttattgagagaaggtaaggtttaagagtattaacacatttcagtcattgactcttataattgatataagcgtagggattttctaacaggcacacgcttgagatatgacactctaaggaaaaaagggagagttcttattcaattctagaaatgtttaagattacatactaatgatatagtttatttacataaatgtgtgttcatattttttctaaaagaaagggaccgactgtccttcataaagagcttcagtcagcttttctacccttatcagccttatgtaactgccaaatttacctctccagcctgacttttacatagaattccagttctgtatatccagccaccttaaatgaagacatttcaagctgaacgcctaaatatcaccttaaatacattgcagaaatggaacatattttccccctcttaaactagtttcttttcttttttttttgacagagtcactctgtcacccaggctggagtgcagtggcatgatctcggctcactgcagcctccactgcccaggttcaagcgattctcctgcctcagcctcctgagtagctgggattacaggcatgagccaccacgtctgactgatttttgtatttttagtagaggtggggtttcaccatgtttgccaggctggtctcgaactcctgacctcaagggatccacccacctctgcttcccaaagtgttaagattacaggcatgagccatcgcacccggccttaaactagtttcttaactatctcctttctttcattggtaactccattgtcttccagtatagaaaatgtataatcttttacacctcccttttatccaacccatcatgatattcaacaactttttcctttgaaatatcttaaatttattctttcacctccattctcctgccactattgctgttcaggtttcttcacccctagattactacagtagtcacatgcccagtttccttgctaccatattttatttcttagacatttctatatatagtattgccacatttaattccaaacaaatcaataggctataatgcctccctattccctgctatatcaagaccaaaatcctctaattggttttctaggcaaaggctcaatagcctagttctaacctagtaatacaaattcatgtaacctttgccttaggttttatggcacagatcccaggttacttctgggggaatgttgcattcaattttggcttaaattcctacctacaaaccagacaagtccattacttgacaactcaatgcattttaatttacaagcatgcaggccacaaattataaaatgaagactttttactgagtcagcagaaacaactgttcaattctcctgtaagtccccagttacttacagttttctgctgaggtgatcatctcatgtggcatttattgccctctactaaaatgagctattatctgacactctgctctgtacagacgtgtttctgtttccattttcagttccttctccacatggtctaagtaccagtagtttagtcagttctcaccttttttgaggggaaggcggcaatggtggtatcaaaatttacacctggaaaacaggtcataaagaaaatcaatatagaagggaaagtgctttaccacaggaattattatttaattgctggttgaattcttgacttttggttaaaaggtagatataacaaatatgtaaaccaccctcaaagccaaaccaaaaccaacagcaacaggcttttcaatcaatgtaatttatacattgggttctggaaaacagaaatgtcctataaattttatataaatgctatataagggtacataaaaatgaatccttattataaatatgacttaaatgtcatagcagtaaacaaatggtacttatttgatccacaaatttctttgccttcttagatttttttgaaagttttggtgtggcttggtttctttttgaagggccgagctgggagaaggaggaaaggcatttggtctcctataaaattgtccaagaaagtttatgagaaagcctatatcactcaataaggtggctccagtaagtttaggcattcaaaaacattccattaattttagagttaccttaaagaattacagcagatcctcaatgcttttgtttctgtgattacggtaatggcatttcttgaaaagtatttttaaatgtaaggattctttattctactaccacctcctatctcctcagagatacacaaataaaggcccaaaaataacagttaaactttatagaatttcacacttcattggaaaggttagaaatgatcatttagatcactaatgaccccccaaaagataacaaaatttcacaggcctgattattcatacccctacccacactttgctggttttgctgaaaaaaaaaaaaaaatgacattttaaggtacctgagacctgaggaatgaatgttaatagctcacacagaatgagaagagctctgatcagtgaagtagtaaaaggtagagggcactcctaaattatcagaaaataacctgcatatttctgtatttatctagcaggtatgcagcctttctaccactttaccataaaggtattactcctgattttcagcaatcaatggtcacttattttacacctactatgtttaagacactagactaggcttgcagaatatacgataaagaataagatggccccttcccataagacagcatgcatttgttctaagtcaggtatggaagcttaaatgagagaaatggtatttttggctgaggaggaaaagtgaactggaaaaatttcatgtagggggtaaatagcttaagttttagacaattgaagatgaaggaaaggacattctaggagtaaataacttgagttaaggcttggatgaaaatctgagtgaggtttgaaaaagtattatttctctttggcttaacaacagttattatggtattcattgacaattactcccatagtggtaaagtcaatcttacttaaggcaaaaaatatcctagatatagcattttgcctaggcaactctttcctctcaagatttctcacctgatttgctgagttaaaagccacagactcccaattatttagggtaaacttatttatgcctaggtttccttccagtatttcttacaagttttttgtttttttttcttcaaagcaacacaccatggctcttgaagggctgcaggcaatctgaatacccttgttttctttgattagaaatgagggtaaattatgcaaaggaaggaaaacaatctcaaacatgattatactcatttccctaccaattccctagtatctactctttgccttcattatactgtatctactttactccttgctacttcatcatgtcttggttcatgttgttttctgcactcgcaagttatcattccttcatttcacataatcaatcttaaccactttttcagcccagctcacctttcatatcctcttataagtcttctctgataagtttaagtccacatttccttcaagcttctaccacacttaagttagcaagccagagtttacattccattattctctacttgtttcttgtatgttagtataatattctcatacaggttacagttctttgctgacagggaccatcttttataaactatagtgaagtaccgcacctagagtaggcccttaataataaagataatgtcactttaaaaatgcaagcaggaaacgcttcaggcatttaaaagtagtattttaacaataactatttttgattaaataaaactatattcattcttcttttcagaacttgaagcctcaaattatcacctcagatcatcatgctattaaaaagtagatgtgcatatgaataaaactgtccaactctatcacttatacacaacacagccatgaacaaaagcagcagccattcttgataatccaatcccctctgaaacaaacaatttctggcagtaggagacatttacaaatacatagccttgctaacaaccactaggttataacggaaaaggtttgtaatttgaatcctttagagtgtgcatctttcaaatgtgtagtgaaatcataaatacaatgtaattttgttcagtttggaatgaagtgaaattttgcttaaaggaaatgaagattattcaagttgaagctttagttaacctgcattagtcactagcattctacttccaaaaaaaaaaaaaaaagtcaatcttaggaaaaattgcaatcaaacatcaaacatccttggcttaaaacacattcagcacaatttttaaaacctctatacctacattacagaatatagtagttcacccttattcacaggagataccttccaagacccctagtaaatgcctgaaactgtggatagtatgtaactttatatatatatactatgtgctttcctaaaaatatatatgataaagttttatttgtaaattaggtacagtaagattaacaagaataatagtaaaataaaacaatttaacaaaatgcaagcatcactactcttgtggtttggggccattatgaattaaataaggattatgaattaaataaggattatatgaacacaagcactgtaatcctggggcagtgggtctgataaccatgatggctactaagtaactaacaggcagatagtatctacggcatagaaacaatggacaaagggatgactgcgatcctaggcaagatggtgcaagatttcatcatgctactcagaatgacacacaatttgaaacttaaacgttgtttatttctggagttttccatttaatatttccagacttcagttgactgtgtgtaactacatggaaaatgggagacactactgtattacataagacttgataataaggtatgtctttatttataaaatgtaatgatattcagcatatactttattaaggcaagaaaatatattgaaatattaccatttttattaatgttttagaaaatattcaaacaaggtttaaaatgattatactccagaagctttacaggtgttaaataaaatttttttaaaaactaggccaggtgcagtggctgatgcctgtaatcccagcactttggagggccgaggcgggcgggtcacctgaggtcaggagttcgagaccagcctggccaacatggtgaaaccccgtctctataaaaataacaaaaaaacggccgggcgcggtggttcatgcctgtaatcccagcactttgggaggttgagacgggcagatcacaaggtcaggatggtctcaaggtcaggagattgagaccatcttggctaacacggtgaaaccccgtctctactaaaaatacaaaaaattagccaggtgtggtaatgggtgcctgtagttccaggtactcgggaggctgaagcaggagaatggcgtgaacccaggagacggagcttgcagtgagccaagatcacgccactgcactccagcctgggcgacagagcaagactctgtctcaaaaagaaaaaaaaaaaaaaaatcagctgggtgtggtggtgcacgcatgtaatcccagctactcaggaagctgagacatgagaatcgcttggtccagggaggcggaggttgcagtaagctgagatcgcgccactgcattccagcctggtaacagagtgagactctgtctcaaaataagtaaataaataaaaataaaataaaagtgattgtaaacttcaattaacagaatcatccagaactccagattgccccattgattcaattaaatttttgtctgataaaacttttagaaattctttttcttttttttcatttgcattgcctttcctttaacaacttccagtgggggtagttttcctttttgttaatcacgtctcacacagtcaaggtgtcgatctgacaaagagtaagagaaatgaaatctaacatagtttctataaatggtaaagttaaacacaatttccagaactctaagatgatgttgaattttccacataaatctatgagattatatttaatttttcccatctgctattttaagtaatatgtcagtatactaaatatctctaaaatgaatatattgaaggctgactctcttctaggattataaaaatttgggacaagacagagccaagttcaatatcttatttaaaatttaaaggcttagagaaagacagtaacttaaggtctttcaactaagcaatgacagagccaattctcaagtatttgaatatgaccacaattaacttctctgggacaggaacagtttaagcttctgtttacactgtcatttctcgggcaaagttaccaagctacctaaatacttctttagcataatcacaaatatgaattttattataacacattataatcttttattctgtttcatttcatggccttctaaacgtgtgggtaagctttagcttcttgtacatgctcaactgttatcttaataaaatgcatcctgatgaaactgaagagactagcaacagaggcaagtgcctctgaacaaagagacatgttggatgaatgaatagctatacacacataattgaccagtttgagactttaaaaatgagggcaatgcagaaaataacttatagattctcaacataagaatcatcaaattaatctaatgaacattttcacttctaatttatatttttactttttgcatattattcttaattcttgtatgaattcttcaatgaattctaagttatttctttagacattcctatggttaaagcattttcccccataacagcaagtaagataattgaaagattagaaaaaggattatttaatctaaaaaattcactttactatttctatgagaacttttatcttttcaactgagagaagctaaatacaaaaatactgaatatgaaaagtaaatactttgaaaaacagagaaggccctaagattaagattgtttattggaaataggattcttaagatttatcttttaaaactgccatgctaaataagtcagattgaatcattattaattcaaatagatatcatctactgtgtcagatgttttcattttgttttctttatatatggaagaaaactgtttagctaaaatatagtagataccacaaattgtaaaattatacattctaaatgaatacattaaaatgaaaaataagcagcacaattttatataaaagattataatactaggctgggcacagtggctcatgcctgtaatcccagcactttgggaggccgaggcaggtggatcacaaggtcaggagttcgaggccagcctggccaacatggcgaaacccgtctctactaaatgtacaaaaattagctgggcgcggtggtgtgtgtctgtaatcccagctacttgggaggctgacgcaggagaattgtttgaacccgggaggcagagattgcagcgagccaagatcaggccactgcactctagcctgagtgacagagcaagactgtctaaaaaaaaaaaaaaaaaaaaaaaagggaattctcaactacttttttaaaaaggagttctctctatggaaggcctaatttggaaatgtacttgggtccctatacaaagtcgtccagaagccagatgatttcccagtgtagtccaaaagccagatgatttcagggcaaagcatttgaatgctatggatttaggtaggcaagatccagaagcagagtactgtgggtctgggtgggcaggtagaattcagatgctgggaaaaacacaaacgcaatgctaggaaaaagggtcatgccttacaattcaggtgggacagatacaaatgaaatagtttcttaatgaggtagaaagaggaagttattaattcctgttcttgttggattctaacatacaagctaatttgaattcatcagcctaagcaaggttgccttggattttgaagttttcttaaggaataaactgtagagaaaccatagggccaaccagatggatgatgaaatggaaaaaacagcaattaaatacttttagaaagtattacaaattaataccttaaaaaccctgtatcttgagctagtagcaaaactaactggaattcctgacctctgcagtgccttcttgcaacatctcagaaaaaacatctgggaatccattttagtctgctaagagacttaagatttacatcagatatattgtcaaggtttctcttgtccttgttaccaaggaggtaaaagaagtgttgtaaaatttattcctcagctggcacattatctcagtgagaaatagagcccttacaaagacttatcttagacacaaaactacattattgtacttggcaagtaccatttcatgcttctcatttttttcctctgatcctttaatgaaactgtgatgttgatgatctataaatttgatctaattgaggctagaattctactgaaaagataatttctgagtagccataccaatactgatatcaatgtattttttaatcagagaattaacatattactgaatgtatatgaggttaccagcctatttactagtcaccaaatgacctgagttcaataagacagcctctgggctcaagcttattagccttacaggctaatagcagggaaatatagaagcatgtaaatcatgtgatgatttaacataagcaataatgagactgttttaagggtgatagtacagaaaaggcagttatttatttattttttttgagatggacttccgctcttgttgcccaggtgaagtgcaatggcatggtttcagctcactgcaacctccgcctcctgggttcaagtgattctcatgcctcagcctcccaagtagctgggattacaggcatgcaccaccatgcctggctaatttttgtatttttagtagagatggggtttcaccatgttggccaggctggtctcgaactccagacctcaggtgatcctcctgccttggcctcccaaagggctgcgattacaggcgtgagccactgtgcccagccagcagttattaatttttaacacaagtgtatatatgtgggagatggggttgcccttttgaggtaatacctaaaaaactgaaggatgaataggaatttgctacactaccattattgctctagaagagatagaatgaaattagtgattgttattaagccttgtcataagtccagatctttaaattgacatgaaatattaagaaaattctatgtctagaatttggattatttagtttgcagccttttagttgcaaaaggtgtattttctcttctagattttggtaaacatccagagggacagtgtccttaagtgacatttggtgtgcgcatatatatatatacacgtatatatatgtgtatatatatacgtgtatatatacacgtatatatacgtgtatatatatacgtgtatatatacacgtatatatatacatatatatacgtgtatatatacacgtatatatatatatattttttttttgagacagattcccactctgttgccaaggctggagtgcggtggcatgatcttggctcactgcaacctctacctccccagttcaagcgattctctggcctcagcctcctgagtagctgggattacaggcatgcaccaccataaccggctaatttttttatttttagtggagacagggtttcaccatgttggtcaggctagtctcgaactcccaacctcagatgatccacccacctcagactcccaaagtgctgggattacaggtgtgagccacggtgtctggcctggtgctttaatgctttaaaaacgaccaagtatgacctgtacattgtgtagacttactctggacagtagggtgaaggtagttttctcagggaactatgccattacattaaggactctaattaaattcatttgtctgtatgtatatccatgtaccacaaatacacacatgacatgaacacatatacacctcatctccaatgttactcaaatatatttctcattgcatgactccctggcggtgggaccagtggagaatgagaagataacttgtacttagtattttcacatacaaacctatctttaagacattacaaaaaataagttgtaaaaatgtcagtgtgttattagtctctaattttttttcccttctaaaacaagttctcaaaagcctatcatactatctctgatttctatttcaatggaagcagtcagtacaatgtgtgaagacctgggcataaaagcagcattaaactagtattaaacaagacaccagcattaaacgagacaataaagtaagactaaaagtactttggaaactaaaagtactacctaaaaggaaggtatcactatcattttgagcatttatttatgtagttttgtctcctctgcctcttgttggctataggatagaagctgtagatataattcctaaaagcgtaaacttcaaagtcaaaccatctgagcttgaatctggactcgctggcctgctggttacgtgacatgaggcatgctatttctctgtgacttggtttccttacccatatggataacaacggacctctctgagggtggctgtgaggactaaatgagtttataaatgtgaaagttgctggcaaaggataaacactaaatgtgttagcagttactatttctaccgctaataatagcatgtaaaccttgagttttccatatacactttagaaaaatcaacaaccctttcaggtaactattaaaatgtttttatttgatggtttgggtccttttcactataataatcacataaaataataaaaatttactggcctatgttccagaggggcaaataaatattaacaaatgtgtcagggctgatgttcatttacaattctttctcatatcaataatcttataatttggaagagaaccagggtagtctaaaaagtacttgaaaactgaagagcctgcattaaaggatgaattaaaaacaatcttttcaaccaagtgatattgtttaatcaactctcaacaataatttaggttcaaaagactggcaaagacagtacagaatgagtattttctgcatatatgatgccagaatcaactgacccactgccaatttcagagaagactgaagaaattaaagacatttcttttaatcaataactgaacacctattatgtgcctggtagtgggaaacacacacacacacacacacctctaattgaagctaaattcctatttactacagaacaagaattccaagggtagtatttctaaacctaagctatggctccgtagtctcattaatgtctaagcgtcctagaatataaacatcaaaaaatcctcctttgatactactaactcaattctccccaaaagtatatggttatatatccttgtggaattgattccttcctgtttatccagattcttcacctttatttgcttttatggtcttaaaagggaaatgactacttaataatccagttctacactgggtttcctactgcctccaagaaatcttcttaagacaagcgctaacttacaaaagctttaaatatctctaaagatatttaaaaattatgtctctactcctagtattttcattgcatatatatatttgagacagtctcgctctgtcacccaggctggagtgcagtggcgcgatctctgctcactgcaacctccgcctcctgggttcaagctattctcctgtctcagcctcctgattacctgggattataggcgtgagccaccacacccggctaattttttgtatttttagtagagactgagtttcactatgttggtcaggctggtctcaaactcctgacctcctgatccgcccctcggcctcccaaaatgctgatattacaggcgtttgagccaccgtgcgtggctctgccttacatttttaaagctaggatttgttcaagctgatatggtgatttgcttcacttcaaaaaatgccttattatcttgattaagagtgtttttcccattttacccattttaaggtcctgtaaggcagtcatttctataatgtacacatccactactagtagaaaacccttgctttggagtttatatttgcctccctgaaacttgatttgcccagttttgtcctcttgtgcaataaagaataaacaagtctcaagattattattttttttctttttcaagcaggcttctcagtacctctagccactcctcatgacattcaaacacctcatatggtttccattctctgagttcactctagttggttcacattcatctacatactctacatgtggcctgatatgagctacataccaagactgccaattaacaatggtctgggggaacaaatgtttatcagcaaataacagtttagccaaaataaataatttgcatgctagctttgaaatttgctgaacccttacctataaactcttaattaaattctccaacttgagtatacagacaccaagaccatctggtatcattgaaaataaagaaacatcaaagggatttggtttcttaatgaatagaatatagggagtattttaaaagcattacaatttcttcctgaagttatacctatgtagaactttctagaaagaacaagttacccattcttaaagctccaaattcaggccaggcatggtgcctcatgccgtaatctcagcaccttgggagactgaggcgggaggactgcttgaacccagaagcagacatgcctgggcgacaaagtgagaccatatcactaacaaaaaattctaaaaattagccgggtgtgggtggtgcatgcctgtagtcccaactactcaggaggctgggtggggaaaatcacttgagcccaggagatcgaggctgtagtgagccatgattgtgccactgcactcccaatacagcaagaccctgtcacaaaacaaaacaaaaaaccaaaacaaaacccaaaaccgaaacaaacaaacaaacaaaaagctccaaattcctccggttttggaggttatctaaacacatctaaaaatcattaattcaaaaatggcacaacagcttaactactatggacctgaggctttgagtcattttattttgagacggagtttcgcttttgcccagcacccattaaaatgctgacaaaagtggtcataacagagggtttgacttcaaatctgaaccataggcctgttttggcagcaaacatccttcttccaaaatagccagacttttagacttccaaaataatatagtttattctgttagcccagctgtttctctggttctaaactttttttttttttttttttttttttgaaacggagtctcactctgtcgcgcaggctggagtgcagtggtgggatctcgattcactgcaacctccgccccccgggttcaagcgattctcctgtctcagcctcccaagtagatgggattacacgcgcctgccacgtttgtatttttagtagagacggggtttcaccaccttggccaggctggtcttgaactcctgacctcaggtgatccaaaatgctgggattatgggtgtgagccactgcacctggccttaaacctgtctttctgaatgaaactactattgctcttttaaattataaaattagtgtgtgagacaaatggattaagacatatcatttttgcttacatcataaatgggtcaaattctgacaaaaacatatttattatactagacaggccaaacatttattgagcttattagtgtcatgtttacattttataaccatgtttaaaatgaaatatccataactattggttgtcattaatagtaagaaatgtttttgaatatccaatgtgaattccacaattttacaacagctcagctttttgataaatgtaactattgaggtacaaaagaagaaacaaactcaaaatttgatatacaggtcttagattttttttttttttttttctgaggcagggtcttgctctctcacccaggctggagtgcagtggtgccatcttagcccactgcaacctccacctcccaggttcaagcaattctcctgcctcagccccccaccacgtagcagggactacaggcgtgcaccaccatgcacggctaatttttgtatttttagtagagatggggtctcgccatgttgcccaggctggtcttgaactcttgaactctggtgattcgccagcctcagcctcccaaagtgctgggattacaggtgtgagccaccacggccagatttctctctttaagcaaattctgaccagtacacgtatttcagaagttatttttcttactctcctgctcagaatacttcatgacctcccttgcctcaaattgttttcactatgaaaaggtatccttggggatgacatgcggatatggtagaggaggaatccagagtaaacaagatgcatcttcctgtatcctcaatcttgaggaaaaattctaatcctaggcatttttacattacaatactatggaatagatataaagttagtggtaatttttagataaaactcaaatctaaagaaaatatttctgagccagaagcatagcactaaacctcttctctagaggaaatataatctttctagtccctggcacagtaacgaattggattgagaaataaattcactaatccaaatatgcaactagaagggtgtatatataaggctaataacaactgcttttggatgataaaaatgatttttaaataatttttttttgctcttcctgaggtttctatgtctatatagtacttttatgctacgaaaaattaaacttaacagaaaaatgcttaatttttgtatatggaagtttcattgcattatcaaatctttatcactataaaataaaccagatttgtatttctttagtttgtttactaatatagtttcaaattaaaagagatttaaatatcccttttcttacacttacctttttttgaggtctgggggggcttgaagagtggggaaatgacagtgaaatctctcaaccacgaactcaagaagtaattcttgaattccttttcaatattactttgagaacttaaagcacgctgttcctctgaagctgattttaaacttatctgattttgaaatttttcttccatgacagttaattcattatcatgtctaaagttcctcaacacagtaggattcccttttataggtttccaaaagtaaatcattatatggatgtaaggttgcttcaaataatcacttttatttttcaaggatttctctctctccttttcaaaaaacaaagtttgcccatcacagaaatcatacatgcttatttataatcaagaagattcctcccacccctataagatttatctctcacccagagtaaaccagtaaaacagtttagcatatgaattattctggtgaatctattcaactatttgataatcttttacttattcaataatgaacagctttttagctcattaaatattcacttgctattttaagtagctgcacagtatcctactgaacatgttatttcatcagccttttattattgaatgctttataaacaataccataacaaacatatggattacttctttaaaaagtgtatctgttaattgcttttacaatattggaaaactgagataattattcttttaatgtttataaatcttaaggatatattgtaactggttcatacataactatttgaagaatttaaaaagtcaactatataacttgtcagcataaaattaatatctgaaccttgggacctgatgtttaggctactgttttgaagtttcttaaatttaacttttttttcatattgctaatacatttaaaaggttaacctatatgaataaatgagaaacaatgatagaaacgttatatacctcaggtgtgcgaaagtagagaaaaaggttatgagctacaggtatcatatgttcattccattggaaggatggttaatattagactgttaaggtcaagaaacagtgcacatgagaaattctgccttactaaaaaaaatgtacaggcattagttgggggagaactggagtgatgaaatggcataaataaaggcaaagagaaagaaaaatggattaggactagttcatttgaagaaaaattaaacaacatagaaaatgttgggacaagaccacaagacatcaaagaaagaaatttaaattgtatactataggaaaaaaaaagttaggaagattaaaaaagtagtgtatactatatagaagatgaaattgttagtttaaaacagctagaggtgacccgggcacggtggctcacgcctgtaatcccagcagtttgggagccgaggtgggtggatcacgaggtcaggagtttgagatcagcctggctaacacagtgaaacaccgtctctactaaaaatacaaaaattagctgggtgtggtggcagatgcctgtaatcccagctatgcaggagactgaggcaggagaatcgcttgaacccgggaggcagaggttgcggtgagctgagatggtaccactgcactccagtttgagcaaccgagtgagactctcaaaaacaacaacaaaaacagctagaggcaaagaactagttaaaatgctgctaaatagaaataagtgaaaaacaacgaagtacttaattatagtagaaatttcaaggatgaagtaatcaaaaacactgtggttcatttgggtatatgacaaacatgagcaaattcagtgtttcttggagtcattagttttggatccacctaaattgatcacgcagaaaacactttcaaagccatcaatgcaaaatttgcaaagtcctgatcatcacacaatacctattaaccccccacttaaacactgtttgtattctaagttggtctgatggggggtctaatctcaaatcagattcataaaaatattctgtcctatctgccgacatcaaataggctaaggcacatatacctgtcaaaactatcttaaagaagtatgaaaaactgggccgggcttggtggctcacacatgtaattccagcactttgggaggccgaggtgggcgaatcacgaggtcaggagttctagagaccagcctggccaatatggcgaaaccccatctctactaaaaatacaaaaaaattagctggacatggtggtgggtgcctgcaatcccagctactcgggagggtgaagcaggagaattgcttggacccaggaggcggaggttgcagtgagccgagaatcatgccattgcactctagcacgggcaacagagcgacactcactcaaaacaaagtatgaaaaactgaatctgtagctcagatatcttgtagcttaaacagctacaagatatggcccctatcaactctctgatcctataagctactattcttcctgtttatatttgatcacagctacatgtgcctctttgctgttccatgtacacacaaaaaatgcttcagcctcagggtctttgtatttgctatttcatctgctcagaagggtcttctcccaggtacctacatggtttgctcccttattgtttctaggtctttgttcaaatgtcctctctgtagggtagttcctgaccatactatttaaaaatatctctcttctgccttacaaacacctttatcacatcattctcactttccctgctttattttctccacagaacttgtcactctctgacataccaaatatagtacctaccagcttttttgtccattcattccatcactcactcctctacccccaagattaataagcttcaagggggctgggatatatattttttattaagtgataatcttcagtacctaaacagtaaataaatgtgtacctctctatatataaatgtttcaaatctatttttaatgttgcttgttgaacattaacattttcacacttccagaaatgacattaataaaaatataaacaaattgatataaaaatctgtgtagactaagctagaatttacaaactcttaataaaaggtgtatttaagctttctcaattatgggacaacaaataatagacttcattgcttcatactaaaatggtatttttgactaatcacaaggaaacttaaactaccatatagttataattataggtattcagtccaaagaggaagaaagttttagtgttactataagaagctgtatctctgaaaatgttagctccataagtgtaagcactcccgaagattataagataataaaatatggaaacaggcaaactctggggcgatttaaagtttctaccacttcctaatgattttctttaatagaatcattcgtgctaagtggataaaagttacaaattacaaaagaaagatacagaatacatccaataacaaattaatcagactgaggaacatttagtgtaaaactggcttaaaattttttgtcagcagaatttctcaacatctaaccctatagcaaataatacaaataacaaggagattcttcaagcagttggcatttcttcaaaacacaagggtccaattataagaaaaatatcacattattcaaagtcctacagaattagaggagaatctgtactactcatatttttgcataaattccatgatttatacataaacccaaaatataaattataaacatttaatttcagtataacgtagacaaaaacagcactaacttttcatctttcaaagtaattttaacgtaaaaggtttaaacatttattttgccaatatatttttcatttcatataggcttagaaaaaaaaaagacatccgaaatacctgagatgtattttataagtaaacaaagtaagaacataaacttaaatttctggtggaggagttaggtcttcattaaaagggttcaagctattagtaataaaatggaagttataagtaatcccttgacatgtgtaaaataaatttttttagtagatgggaatgtactgatgatagtctcttatttcttctcccagatatgcaagtgatataactaaatacttactagagccaaatctatctcaaaagtttaggtcatttttttttcctttttgatagtattcaatgagaaataacactttaaataaaactttttccatgaggaaggtacagtaattatccacctgcaaaaggaaaaaaacacaatttgatttagaatgtcaacttctaaatatataaatatattaatttagagaaagaatagtttatgaaagcataatcttgctaatccaagtagggctaactgatgcatgtaacagtaatgacacttagtggcttaaaaacacctataactctatattaaccaaaaagatacataactgactgaagaaaatctttaatgttaaatacggaatttagtctacagctaggctaagttttcaaatctactatcacatattaatgtgtgatcttgagagatttgtacttgaatataagatgcaaatagaatgactgaaatacatttcttgctacttcctggatactctcctgtagtcctctgagtaagctccaaactcaatccgtaatccaagtaacagacttaagatgttcaatattggaactctttggcatcaattaaaaaagaaacctaaatgaaaaagattagtatttttttccaaacaagaaaaaatgaaaacttaatatatacccctatataactatgtgcagtttgttttgcaaaacaaaaagccaaaataagattaacactaaaaggtataaactttcattttactgctggctccttatgtgtttcaaaattataactctacaaataaaacatccagcactgttgagagtttcctaaatgttatttttcattagatatcgacaggccacctcctcttctctaagaagagactggaatgtacatactataagttttaatgcaacacttttcctatattttcttacttctcaaatatttcaattttcctttaattcattgtcaggattaaaaataagaaaagtcttcatttagctataaaagctgcaaatgatccttcatcacacttaagagcacttaaagatataaagaatcatctggtaaatgtaaaatgcaaattttttcttgtcatttagaagacagattgaatataattttctaaaacctgacttcagatacatttaggaatacaaagaaaaagaaacaaaaaacacctaactcctgggttgttctaaaaaatattagacagtattgggtaaactttgtaattcattcaataaatattctaagcatttgtgttaagtcctggaatatttttagtggaatcaaaaattatatatttggtgaagtctttcatgcaatggttgaaaggaaataaaacaagttaagagattgataaatgatttttaaaagcaccaagacagtgtttccatgcaaacgctggcatttagttctatccactatgtatggtatattgggaacaaaatattgctggataaaaaatgagaactttaatataatatttgatcttcaaattagaatttaaacaaaaaggtccttaagcttttgaatacaatttcttttttgttgttgttgagacagtctcactgtgtcgcctagtctggagtgcagtggcatgatctcggctcattacaacctctgcctccagggttaaggcgattctgctgcctcagcctcccatgtagctgggattacaggccccggccaccatgcctggctaatttttgcatttttagtggagacggggttttgccatgttcgccaagctggtctagaactcctgacctcagaggatccacccgcctcggcctcccaaagtgctgggattacaggcgtgagccaccgtgcccagcctcgaatacaatcccctttccctttccctttcccctttcctttccctttcccctcctttccaggctggagtgcagtggcgtgatctcggctcactgcaacctccacctcctagattcaagtaattctcctgactcagcctcctgagtagctgggattacaggcgcgcgccaccacgcccagctaagttttgtatttttagttgagatggggtttcaccatgttggtcaggctggtctcgaactcttgaccttgtgatccacctgcctcaggctcctaaagtgctgggataacaggtgtgagccaccacgcttggctcaaatacaatttcttaaattacatctgaagtacttcataaatttccaaaatagacaattctgattgtaaaggactaattaacaactgcttttattttgtagattttctgcatggttacaactgaaaaccctaacacactccttgtacaaaataataccagagttatgacagactatgcaaatacactcatcttctcctgaacatcatttttaagtttaatgactttaaaacactacagataaggaaaagaacgtaaatagagcatttctgttcagatttttgttgttgttgccgttaagatggagtctcgctctgttgcccagactggaattcaagtgattctcccgggttcaagtgattctcctgccccagcctcccaagtagctgggattacagacgcccgccaccacacctggctaattttttatttttagtagagacagggtttcaccacattgcccaggctggtctcgaactcctgacctcacatgatccacctgccttggcctgagattacaggcataagccaccaccgtgcccggccttttgttcagattttaattaaattaggccaggggtggtggctcatgcctataatcccagcacagtggaaggctaaggcaagactgcttgagcccaggagtttgaaaccagcctgggcagcatagtgagaccctgtctctatttttatttatttatttagttttaatttttacattttaatttatttttttgagatggagtttcactcttgttgtccaggctggattgcaatggcgcgatctgggctcattacaacctccgcctccccggttcaaacaattctcctgctttagtctcccgagtagctgggactacaggcatgtgccaccacgcccggctaattttttgtatttttagtagagatggggtttcaccatgtcggtcaggttggtctcgaactcctgacctcacgtcatccaccctcctcggcctcccaaagtgctgggattacaggcttgagccactgtgcccagctctacttttcttttctttttttttttttgttgagacagagtctccctctgtcacccaggctggagtgcagtggtgcgatctcagctcactggaagctccgcctcccaggttcatgccattctcctgcctcagcctcccgagtagctgggactacaggcgcccgccaccacgcctggctattttttttgtatttttaatagagatggggtttcaccgtgttagccaggatggtcttgatctcctgacctggtgatccgcctgcctcggcttcccaaagtgcgtgagccaccgcacctggctgtctacttttatttttaataaaaaattttaaaaatacaaaaaagtaaaaaaaaaaattaaattatgttgacattttatatcaataaaactacaatgataatttggtcttactctgagttaaatcttgaatacaaaaaagtaaacaaagtaaacaagaccttatttttgacttatcaaacaaaaatctttggctaaggatttaagaaaacattttaataaaaacatgaaaaaaatagtataccattataaagttagaagacataagactaagaccccaatctgtgatgtgtagcaaattatttgagttttgtgtttccttagctatccaatgagtgggttggtcacttgtaagggtttttctacctttaaagttatggttaagtgtgacgttttgacaaccagaattttaggtatttaattcacatattttgatggcttttccccttcagatataaagaaatattcagaaacagtactaaatattgtcttctaagctctgttcaaaatgcttaatatattttatatttatctgtaaagacatattttaaaagtaatttcaaaacaaagggaaaactagaatttgttttatcccaagtaaaaatctgaattaatgtctatgttgaatataaatgtgcattaaaataaattcctctaatgctgcataagctttttaaaaaaacttgatggcattcaatacaattattaaattgcaattacagtattttaagagatgatacatctgaaaaattagtattaattcatttttacagaatcatactaaaaataacaagattatcaataatactgaaaagactatcaataaaactgaaaacacattagtaacattaatatacattaaaacacaactgtagagtatggtcaaccttacttcagcagcacagttaatactggagataattttagaatcttaacgccaatatttacgtgctgctaaggcactgctgacattgctatcataagagctatgaataaaaagaaatatattttcttcagaagatcagatccttgtatttttgaggcagcacaatatggcctgcaccttttcaaaatccacaaaccattatgtgctgctactttactccaaggttttattttttttaaacacacattcgcgcctaaagaatataaaaaatattttctttcaggaaaaaaagaatgcatgtaaaaaaatctatgtttaaacattataacattgatgtaatatgcataattatttttaaggagattttaagtagaataataaaacatttctacatcaaaaacttaactgaagtccattctgtgcccagcacagtgctataggttaggaaacacaaagaataaaatgaggaaaagaaaagcatttatttgctatgccaacttaacagggcaatacaactaaatgcttaaacttttgaatatattcaatatatgaagttatttttccttgtataaacaaacaagtaaatttataaaatttgatctttaccttggtaaaaggagaatttacaaacattttgttccttgcagtacacctttcaaaagacatcttcatcaaataggtaagacttcacatcaagggaaaaacatgaaatgacatacaagagctcagtttcaataaacttaagctagcaaaatgcaaatatacttttaaagaaaaatactttaattctaaatgttaattttattaaatatctaattaagacattttaattccaaatatagttaagaaaaaaagctctaaacaaactaattctcccttaaataatttgttattaataatctaaatattttactttcaacattgatcttcatactagaagttctcttagagttggatatcatttgatacagtaattctaaaatatgaatccttaagtaattctaaaatatgaatccttgggatgatgagttaatttggtaccctgagatgagaaataaaacaaatcccatagctcttaatcttcctattccctgtttctggcccatttaccaggtaaggaagaaactcctagtttccactttctcagatgtagaaatgaaattccttttctctaaaagatatcagaaaattgccaccactctagtggtgccaccattcaagcctggacaatcttttttgccccatgttctcatcattaaaatgactatgctaaagttacatctattacagaatagtaaggtgatgtacacaaccaaagcactaaaatttgctcttccattctaatatctaattacttatacaaagcacagggtcacattccatatgaaatttttctgagtatttttcccattaataaaaaatatatgtagctaatctcctatctaagcaacctggatttcacatataactctgctccttattgtctcaagtttctgcacaacgttttttaaatttttattttttctttttttaagagagtagtttccgtatcttttagagaaaaagaaattcatttctacatctgagtaagtggaaactttaggagtatacttccttacctggtaaatggaccggaaataggtagggaataggaagatcaagagctacaggatttgttttacttctcatctcagggtactctgttgcccaggatggggtacagtgccatgatcgtagctcactgcagccttgacctcctgggcttaagtgatcagtccaccttagcctcccaagtagctgggactacaagtgcacacaccaccatgcacagctctttacatttttattttattgtagagacaaggtcttgctatgttgcctaggatgtcttgaactcctggcctcaagcaatcctcctgccttggcctcccaaagtcctaaaattacaggcaagagccaccatgcctgacctgcactttttttttattttttgagacggacagggtttcaccatgttagtcaggctggtcttgaactcctgacctcaggtgatccacctgccttggcctcccaaagtgctgagattacaggggtgagccactgcgcccatcctgacctgcacaatttttaacatgtaaccaagataaatccgtttgcattcacttgagaaatatataacatatatttgtatttatcaattatattaaggaattgtccttcagggtccccctcatcacatacattttccagataaaaacttaaacataatttttttcaaatataaaaggtgcctgtaaattatttaacaaatattttattgaatatctactatgtgccaggcactgtcccagttattacactagttggtagtataccagatagacagtctcttttcagaaagagtaaagtcattttaagacaacttaaagtgaaggatcttaagctgaagaatttagtgccagcaaaggatggtttgagtttcagaaagacgtttggttttaaaaatgtcaagataacaggagaagcggctttgaggcagcagatgagttcccagacaccattaagaaaatcgctggggagaaaggacaggttttttttttttttttttttgagatggagtcttgctctgtcgcccaggctggagtgcagtggtgccatctaggctcactgcaagctccgcctcctgggttcatgccattctcctgtcttagcctcccgagaagctgagactacaggcgcctgccaccacgcctggcgaattttttgtatttttagtagagacggggtttcaccatgttagccaggatggtctcaatctcctgacctcgtgatccgcctgcctcggcctcccaaagtgctgggattacaggtgtgagccaccatgcccagcccaggatgggtttttaatgctgataaatatgccctattctggaagaaaatgccacaaaggacatttattagtaaggaagaaaagcaagcaccaggatttaaggcaggaagagataggcaaactctactgttctgtgcaaatgcagtcggtttgctgcccttagccataaagctgctaatccctgagcctcaaagggaaaaaacaccagcagccagtcttttggttgtacaacaagaaggtatgaacgagaatgctttttctggattggttccatcaatgctttgttcccaaagtcaggaagtaccttgccaataagggactgccttttaaagttcttttgatattggacaatactcccggccacccagaaccacaagttcaacaccaaaagcactgaggtggtctacgtgcccccacacaatgtctttatttcatcctctgtattagggtcataaggacctttacagctcattatacattgtactctgtgggaatgactatcaacgctgtggaagagaaccctgatagaataacatgaaagtctggaagaattacaccactgattatgccactgttgttacagaaaaagctgtgaatgccatcaagtcttaaacacattcctggagaaaactgtgtccagatgatgtgtatgacttcacaggatttatgacagagacaatcgaggaaatcatgaaagagactgtggttatgacaaaaaaaggtatggttggggaaggccgaagggtttcaagatatggatctttgagaaattcaacagctaacagacaccacaccatagaaattaacagacaacttgatcgagatgatcggttctgcactagtgccagatgatgaggaagacaacatagaagcagtgccagacatatactgctggcactgacattagagagtctggcagaagggttgcaattattcaagactacttttgatttcttttatgacatggactcttctataatatgggcactgaaactaaagcaaaaggtggacagacgattgttaatatataaaaacactttttagaaaaataaaaaaagcaaaaaagtcaggcagaaattacgattatttctgtaaagttacaccaactgtgcctggcctttcctgcctcctctcccacctcctccacctcttccactccagagacagcaaaaccaaccccttttcttcctcagcctgctcaatgtgaaaacagtgaagatgaaggcctgtatgatgatccacttccatttaatcaatagtaaatatattttctttagcttactttaatatggtatatgatatgcataacatacagaatatgttattgactttatgttattggtaaggcttctggtcaacagtaggctatctgtagttgagttttagggaagccaaaagttatacatagattttcaactgcatggggattggcgcctctaatcctcacattgttcaagggtcaattgtatttttaaaattgtggttcaatatacataaaagtcaccattttaaccagtcttaagtgcatgcttctgtggtataaatatgtttgccctgttgtgcaaccctccatctccagaactttttcatcttccccaagtgatactgcttaaacactaactgtccatctcctctgcccctcagcctcaggaaatcaccattctactttctgtctctatgaatttgcctattctagttatctcatgtaagtggaatcatacagtatttgtccttttgtgtctggcttacttcacttagcataactttttcaagattcatccatgttgtagcatgcaacaaaattttcctctttacagttgaatagttttccattgtgtgtgtatacattttgtttgtccattcatgtgatgatgggcatttaggttgtttctgtctttggactattatgaataatgctgccatgaacatggtgtacaaatatctttgaaatccttctttcaattattttgggtatatgtccaagtggaattgctggatcttacagtaattctatttttcatttttttgagaaactgccatactgtgttctacagtggctacagcattttacattctcaccagcaatttacaacttctcccatcgttgccaacatgttattttctgtttttgtttttgataatagccattctaatgaaaatgaagtggtatctcattgtggttttcacttccattttcctaatgaatagtgatgttgagcatcttgtgtttgctggccaattgtatatcttctttggagaaatgtctatttaagtcctttgcccattttttgactgggttgtttactttttattgagtttatacattctggatattaatctcttattagatacatgatttgcaaatattttctctgattctgtggactgacttttcacggtaatagtgtcctttgatgcacagaagtttaatttttttttttttgagatggagtcccattctgttgcccggggtggagtgcagtggcacaatctcggctcactgcaatctccgcctcccaggttcaagcaattctcctgcctcagcctcccgagtagctgggactacaggttcccgccaccatgcccggccaatttttgtgttgtttcaccacgttggccaggctggtctcaaactcctaacttggtgattcacatgcctcggcctcccaaagtgctgggattacaggtgtgagccacggtgcctggccagaagttttaaattttgatgaagtccaattgatctacttgttttgtctgtgcttttggtgtcatatctgagaaatcactgccaaatccaatgtcttgaagcttttgccctttgttttcttctaagagttttgtattttttaactcttatgcttaggtctttgagttagaaattaatttttagttactttttgtatatggtgtatggtaaggatccaactttgttcttttctggtgtggatatccaattttcccaataccgtttgttgaagagtcctttctttactgaatgaggatctttggtacttcttggcacctttggtgaaaatcacttgaaaatatatgcaagggtttatttgtgggccctcgggtctattttcatgaatctctatgtctagctttatgctttgtaggaggttttgaaatcaggtagtgagacctccgactttctttttaaaatttgttttggttatttcatgtcctttgagattccatatgaatgtgagaataaatttttcccatttctgttaaacaaaatttaggattttgataggaattgcattcactttgtagatcattttgggtagtactgtcattttaacaatattaagtcttccaatccataaatgtgggatgcctttccatttatttattgtctttaatttctttcagcaatttttttttgtagttgctgtacataagtcttttacctccttggttacgtttatccccaaatattttattctttttgatgttttataaatggaattgttttaatttcctttttgaattgtacattgttagtgaacagacacacgattgatttttgtgtgattttgtatcatacaactttgttaaattcattagttctaaccgtttttggtggaatcttaagggttttccagatacatgattgtgtcatctgtgaagagataatttttctttactattatcttttgtaactaaaattggtttaagggctttctggcaatctcggtccattcattctctaattctcctagaaacacatcagacagctgtgtcccctctcttctttcaaacttccaacactttccctttcatttttactttcactgagaaaacagaaactatcagaaatttcctcagttcccaccaaatctaacatgtatctgtgtgcatacaactcttacttctttctagtatcaatgaaccctcactgttcataagacaaattccttctctttgatcttcacttacttacttaaggatattcctttagatattctcctgcatctttaatcttcctctctgttgcatgattcttatcagcaaaagtgctacaatttatctcagcataattttatctcttaaagactgttgctatctgtaataacactgcaattttatcactgatgttttagtaaaccaccatggaggaagactttttccttgtctattttccttttatttctaactatctgatttatatttgaaagcctgaaacatttgaactattaaaatatttattataattctccagaaaaaaatatgaaaattcttgatttaaatgtattaacaaattgaaagattcagtggaacaattccaagcacatagagaggatatatctctttcttttcttgtgttcgataataataatctcctcccagtgtggtatggtttgatttttcctttccacttatcttcgccttaggggctgccaaagtaggttttatactatgccttcaaaaagggactattttaaatttaaaatttccttgagtctataagtttagactatttctactcacatgatagggatattcagatactaatacatgccatcaatatggttttgctagtttgttgtttagacatgtccttgtatggcactatgttactttaggttttctgaacatttaattttactttcaatccagcatcaacacaatctgtaatggtaattacttcctccaaatatgccttacttctattctgcacttgaagctctaaggaactgtgtatatacagtgcctcggccacagaatgactatccttgctcaatgacagtggaataatacacagtatgtcagtattataccagacagaaaatttataaatagctattcttcaatacctttacgtaaaggcctgagttatggggtctaaaataaatgcatgacaatttcactaaacatggtaattttttttttttttttaagacagagtcttcttttgtcacctaggctggagtacagtagcgtgatctcagctcactgcaacctccttctcccaggctcaagctatccttccacctcagcctcccaagtagctgggactacaggcctgtgccaccacgcccagctaaggtttgtattttttttttttttacagacgtggtttcatcatgttggccaggttggtctcaaactcctggcctcaaatgatcctcccgccttggtgtcgcaaagtgctgggattacaggtatgagccaccatgcctggcgaaacatggtaatttttttattaccctactatgaagtcttataaagtgtccaaatatataacatttacaggaaagattaaaatgtgcttttgcttgattcttgtttctggaatataaatacttaaaaacaaaaaggctctattaactagagaagatagctttaaaattcagtgttaggaatacgcattcaataaaataataatcagatttaatccaacatgactgttttataatataaaaaacctagttgttgagtttaggcaaatataaagttttactgtttctaaactgccttgatttcttctgatgaaaaaatgactgaaagattgcttaaaaactgtgtatgaagtagatttcaatctggaaaatttattccagaaagtcagactatatatataagccccccaaatgttattttaatattagattctcttataatcatttccttatacaaaaagttaaacttcttagaaatcaaacattcatattttatttgatgactttacttcctaaatactaagtatgactaaattacaaatatatcatgttagtcaagaaatgcaatataaaaaggtttgataaatatgctatttacattttttcttacattcttcttttgctcccttttatgtcctaatcattcatacttgcccattgttattctttcttaacactcaattttcatcttgtgtcaatcatcccttgtattcagctagtcaataaaatgaattgattctttaagacctcagttcattgatttcttcgccattcttgatttcataccttaaatctggatttaagtaccttataaatccaattgcattttagctggacctcctagtccttaatcaattaataaatcttcccaaagttacatattcaagaatgtatctaggctggacgaggtagctcatgcctgtaatcccagcacttttggaggctgaggtcggaggattgcttgagcccaggaatttgagagaccagcctgggcaccatagcaacaccccatctctacaaaaaaaaattattattattattttttaacttttattttaagttcagtggtacaactgcaggtttgttatgtaggtaaacttttatcatgggagtttttttttttgtttgcttttttttttttgagacagagttgcactctgttgcccaggctggggtgctgtggctcaatctcggctctctgtgacctccacctcccaggttcaagtgattctcctgcctcagcctcccgagtagctgggattacaggccagcgccaccaagtcgggctaacttttttgtatttttagtagagatggggttttgccatgttggccaggctggtcttaaactcctgacctcaagtgatacacccacctcagcctcccaaagtgctgggactacaggcgtgagccaccatgccaggcctgtcatgggagtttgttgcacagattatttcgttacccaggtattaagcctagtacccattagttatttttcttggtcctctccatcctcccaccctctatcctccaaaaggccacagtgtgcgttgttcccctctatgtgtccatgtgctctcatcatttagccacccccacacaaaaaatttaaaaatcagctgggcatctgtaataccagctactcaggagctgaagtgggaggaatcacttgagcccaggagtttgatgcagcactgagccataatcatgccactgcactgaactccactccagcccaggtgacagagcaaaaccttgtttcaaaaaaaaaaaaaaaaaaagtaatttctagtttcctaagtagaatctctactttctgcctaagtatcaaggtctgtataattaagatctatccaatgtttcctgcttttctccaaagaaaacacttccattccagttaaatggtctcttttaagacattaacaaccactaagaacctttgaatacagaaaattattctcattattaggtactgtgttgggcagataactggttccctattccatacttatctctccattcaaaatggactagctgtgaggaaatctttactagtatagaccatgccatttcttcaatcctttatcttagtccactggaaatatcatcatgactccatcccttaaatctctgcttttacgtttgctggctgaaagaaaagccactttgcctaaccagatacagaaagagccctaatggctagatgtagagccaaagaaaagagcttctaaaaaaaaaaatacaaaaatattctgaagacagaatcattcagtccttatcctttacacaacaaccatagttccaagtctggtggtttatattctgggctgtgggcctttgatataccagaactctccattcttataatcttccaacaaaaaaaaagtagttatattgaaaggtgagacaaaataagtaaattaaatgtcttgcttaataattcaacttgaatataataaatctgagtagatgggaatctttaaatctcttaagttggttttctatgttagaatttaatatattttaagaaatatggaaaaaataaattgtatataagttaatgttttttccttgttaatgatttacagctctaattttatttccaataacattttttagacattttcttacatgtgctctattatcagttcatctgtagtttacataaagttgttattgcatttaacaaaatcatttagaaattctttttatttatttatttctgtccttacaatctgttctcattgaaattctagtcatgtctcctaaactacagaatcatcctcagtacaataaatctactggtcaatttctacattttaaacttactatcagtaaaataaacagcagaaatttatacaagcacatctagtagtgaacaggtgttcaacaaatgcctactgaatctaaatttacaggatttgaaattctaacacacttaagtgtttcagtgaactgcagctcaacatgacccgatagtattgatgaaaaaaaaagctagtgcaatcagactgcactatagaactttattcatagatgcagtgtgttttgtacctatactacattaagtatattgcaattaattctaaatacaattatttaaaaaggaatactaacaaaatgtaacagatccaaagtagggtatccagaaaatattggtctagaaattaatatggtctagaaaaaatatggtctagaaattaatgctatatggcaacagtggaaggacctcagaatgtacagcttagagaaaagacataaaaacaatttttagacagtagatctagggccagagaacaaagttataaacagatcttcaaatgatgtttcattcaacattgtttcatttttaatactgaagaggaaaaatatagagatttctgtctggggccacagtgtgtggagtttccacgttctccccatgtctgcatgggttttctcccacatcccaaagatgtgcatgttatgttagttagcacatctaaattgtctcagtatggctgagtgtcggggtaggaggacaccctgtgatagaatggcatcctatccagggttggttcccacctcgcatcctgagcttctaggataggctccagccacctgcaaccccaaagtggagtaagtgggttggaaaatgaatgaatgtaaattactgcaaaataaaaacttgtcaaatatacaatcatcatacaaatgcacaacaacaaatgatgtagtatgaaagtgctcagcaagcatgccatatttgttattgcttgtttttgaacaacatggtagtagaaggtgctccttacaatttctgctttacaaacatttattccttattttaactcaccaccactatgaccatcatcgctgactcatcaaaaattgggtaaatgatgatcttgtttctattaaactttcttaaatgtatgtttaactcacatttatttcacaatgtttaataccagaaatgtgttggatctttatttagaaggtgatgttctttgtgaccagaaataggctataggaacttaactcttgtttatatcaattagcctatggtgaaactggttttattctatgtcatttagcttaaagctgcagtttccaagaatctattcattactttaagtgaggacttactgtactaagttgaaacctgccctctgatgagaaacttattttatgttaattaacataaatgtaatttataacgtaaaggaaaacatttgtttactatgattctaattctaatattctagggtcaaaataaaattaataaagttcaatttaaaataaaattgacttagaaaaatttagtgtactttacttattttgtcttgttaaggatttggaggacagattgccagttttaagttccgactacagggcaccaaatactagaggcataaagaaacagctgaactaaggatataaaaactaaaagtaataatttaaaactgaggtgtactgaattttaattcagatattgtttccctaaacactttatttatttttttgagatggagtctcgtgctgttgcccaggctggagtgcagtggtgggatctcggctcactgcagcctccacctcccaggttcaaactattctctcacctcagcctcccaagtagctgggattacaggcacttgccaccatgactggctaatttctgtatttttagtagagacgaggtttcaccatgttggccagactggtcttgaactcctgacctgaagtgatccacccgtctcgacctcccaaagtgctgggattacaagtgtgagccaccatgcccaactgtttccctaaacatactttttgagatggagtctcgctcttagttgcctaggctggagtgcagtggcttgattttggctcactgcaacctctaccagcatacatgctattctcctgcctcagcctccccagtagctgagattacaggcacccgccaccatgcctggctaatttttctatttttagtagagactgggtttcaccatgttggccaggctggtcttgaactcctgacctcaagtaatccacctgcctcagcctcccaaagtgctgggattacaggcatgagccaccatatctggcctccccaaaaattttaaactgaggttctgaaatttgaccagtggtagagtacttgaaaggatggcattcttagtggtaatactgttaaatgtatcaaaacttcattttcattagctacaaatagttttactataagaaacagattttataagacattttaaagtaacttgtttttttctttttattttctttttgagatggagtcttgctctgtcacccaggctggagtgcaatggtgcaatctcagctcactgcaacctctgccttccaggtttaagcagttctcctgcctcagcctcctgagtagctgggattacaggtgcacgccaccatgcctggctaatttttgttatttatttatttatttatttatttatttatttatttatttatttatttttgagacagagtttcactctttcgcccaggcaggagtgcagtgacgcgatctcggttcacagcaacctctgccttctggtttcaagcaattctcctgcctcagcctcccaagcaactgggactacaggtgccggccaccatgcccggctaatttttgtatttttagtagagacaggttttcaccatgttggacaggctggtctcgaactcctgacctcatgatctgcccacctcagcctcccaaagtgctaggattacaggcgggagtcactgcacccagccaaagtaacttgttttaatggaaaaacaagcataaattaatttagtggatataacaggaaaaatgaagcttatagtctaggcaaaaaggtgtgataattgacaacatatattttaattatgcattcaatttattcctcttttacatagagattaaatttaaaaactcaagtttcagactaataggtagtagattagggcaaaagtacatagaataagtcaggggatgttacttattgcatttataacttgaaatccccatgacagcagagttgattatatctgtacatttattttctatttaaatcaggccccatgctgttaaattctaccttttgttttcctaagaaaacaaccaagtaacttcatactaagaaattccctattattcctctttgaatcatccatcttgaaggtaagaagttgttcaggttgaggaaacaagcccaacccctttttataattttggcactaaaaatcaaattttatggtgcaattttattaagagcgaaaacacagccatcgcttaagcataaaagctcatatttaactcaattattttgctaaacatatataagacaaatatggaagaatgaggacaaggaacacctggcatttttattaaatgtctaattctcaaaaatagcaattatttgaacaatgaaaaacagctgcagcatattgtgaactttctctatattcataaattatagaatacataagagcctagattttatatatttactaaattaatggcacttcatcatatcaataggtttataagacattctctttactaccaaatgctgacaatagctggtacctttatgaattttttgggttataacactctttcaccactaatccaactgccaaaagagcaatttattttttctcttttggggaattcctttctcccagaaacattcccatttttaaaactattcaagataattagaatttcctcatcagtgacacaggtatacagcaatttacacaagagtaaatttctatcacaataattaaaaataagagaaactttggctatgtctagtgcataatataattacatcattatggttttattgaaagcacaacagattttatatcatttgccatatatcaattacttactgctccactgataaaaacattgattttttttgcagtattttcagtcagtcctacgtttgtacattttataatttacaattgacaatattttctaggctgatgattacataccattgcttttattgctaacctgataatacttctaaaaacttatattgataactagtcatatgtgagaaatagtttttgttatttctttttactaggcttgctcttgatagcagccaaatttaataagtctttggaattaggaagtaatttatctctatcatttttgtttatggaactaacattgacagcactggtgaatattctgcttcatcttttctttccctatttataaagtcaatgttttaagatttttattgtagattattaaaaagagagatgtaatattcttaactgctgacaatgttttgagatttttttaagcaccaaatatatatttaaatttacataacagatgtcaacatgtatttacatttgcaggtaaacatatgtttacatttacaaacagaaatatataatttaagtgtctgtattcgaaaatgcaatgtgaaaaataaaaataattcaaaaaagaaaaagaaataaagacatataattatttctgaattttttgttaagcagcgaaagtttaagatctctaaattgaaaaataaacttgaaaaatactccatctctatatttaatttgtaaaaatgaaccccaaactgccattgtttgacaggattgtatacatgaacatcactgttctacaacttctagaacatccacattccacaaatgaacagctttaaaaaaaatcccatcttaggcagggcaaggtggctcacgcctgtaatcccagcactttgggaggctgaggcgggcagatcacctgaggtcaggagttcgagaccagcctgaccaacacagagaaaccctgtctacacaaaaacaaaaaacaaaaaacaaaattagccaggcgtggtggtgcatgcctgtaaccccagctactcaggaggctgaggcaggagaatcacttgaacttgggaggtggaggttgtggtgggccgagatcatgccattgcactctagcctgggcaacaagagcgaaactccatctcaaaaaaaaaaaaaaaagaaaatacatctatctatctagatatctaaaatcgatctatatatagatatctaaaatatatctatatatgtaaatatatattatatataaaatatatgtaaatatatattatatgtaatatatattatatataatatatgtaaatatatattatatatatgtaaatatatattatatataaaatatatattatatatatgtaaatatatattatatataacatatgtaaatatatattatatatgtaaatatatattatatataacatatgtaaatatatattatatatgtaaatatatattatatataacatatgtaaatatatattatatatatgtaaatatatattatatataaaatatatgtgtgtatatatatatatatcccatctttttttttttttttttttttttttttttttttttttttgagatggagtctcactcggtcgcccaggctggagtgcagtggtgtgatctcggttcactgcaagctctgccctccgggttcacggcattcccctgcctcagcctcctgagtagctgggactacaggcacccgccacgacgcccagctaattaaaatatatatcccatcttaaaaaataaatggcattaaacaaacattaaaaaaatgatagaaggggaacacacaatcacacacagcatcactgactattgccagtcactatgtacctattattctgggtattgtttaattggaaacatcaccattttagaatctaagattaaggggaatctacctagaacagacaacagaaagcattccaactatgaaatatgataaatggcctatgtttaaaagatgctggagagtatccaagaaagactgctagcttagaaatttataaaggagatgaaatgaagaatgtgatattatctgtgcttatgtatctgttagaattcaatgatacctatttcttgttgaaaagtggactgccctccattctgagtgtagtacgaattaaaaagacttctttttttaaagagttaagttgaagaagggctgagctggcttccaaggcactaattaaggaatccaagcctgtactatataggattctttagggatctgcagatatttccattctaattttccagagacaaaaatgtaaccgggagaaaattagaaaaagaaagtgacctgtggcatttgactactactttgcaaactggcttattattaacagttttcaacatttaattgatcccccacttaaaaattctcaccttattgagttcaatggctgatcgtctatgatcataaggccatccccaacatatacacattatttgagtcactgtgagataatgtaataaaagcatctgaagcactagtttcatttaaacagagacatgccctcaacatcaagaatagaaagtcttgcgcttgagtttttctttagagatgcagaattagctcaaggaatggatggaaatgacattttttggtaactgattttaaggtctcgaatacttttatggaaataagtatcctgcgcattttatatgcccttgatcttgtgagtttttctagaggcataatattaatttcagttaacttgttaaaattattctttcagaatttctaagtgtctcaaaagttaaatgaattggggaaaaatgtttcttattctaaaaaagaggtatgcatgtatatatataaaaggaaggaaaaaggagaaaaatcctctttttgatatttgcaggaaatatctgaggtttagcttgggaggcgatggggcaatccagggcgagaaatgatgtcttgaataattaaggtgactactcctgaccttcaactaaacagactaccttcctgtctaccctgaaggtatcactttggtgttgctatccactgattcacttctgcaaacttccctgacagaagaaaggaggacttgcagctggacactgctccctggctcttcggagcggtttctttacactatgcatggaccacagatcatctgctgccatcctactcagggagagcttgctaaagatgcatggtcctggcccccacccaaaacctctgactttgaatccatgtcagaaatcgtttaatttatgtacttacttgtttatctgttttgttcactgctatatctttggctcctagaaaagtactaggaacatggtagatactcaataaatatgtactgaataaatgaaaaaaaaaaaaaccaacaaaagaaagggaaggaaaagggattgccttcatgtttctcccacctcctcaagttgttttttttttttttttgagacggagtctcgctctgtctcccaggctggagtgcagtggcgtgatctcggctcactgcaagctccgcctcccgggttcatgccattctcctgcctcagcctcccgagtagctgggactacaggcgcccgctaccacgcccggctaatttttttattttcagtagagacgtggtttcaccgtgctagccaggatggtctcgacctcctgacctcgtgatccgcccacctcggcctcccaaagtgctgggattacaaggcgtgagccaccgcgcccggccacctcctcaagttttaacagctaaatgttaagctcttcacaaagaagtctcaagtgtaacctaatgaaattaaaaacagactttacaaaatcatttctcaagtggagagaatactctcaatttataaaaccataagaccaataaacctgaataatgagtactaaaaaagacaattacctatttgttaattcctttgaaggaaaagggctcaaaattgtgattctcagacttggagattatagggcctgggtataaaatacttccctaaataacttaccaaggcaatggcattattcttgctctaaactattaattaacatcaaatctcaacgtgtagaggggctaggagaggttagaaagttaccataataggataagcagggaaaaaaatcagaaataaaccagaacatgacaccaaacagtaatagggagactcagagttaatacttacaaggtaagaattgctgagctaagtagaggtctcttttattgtggtcttcattctatcattattaaacctaggaaaaagagggaagactttaaaaatttcagcacattatataagttagaacatttcaactgaggttgccaccgctgtattctgatccttatacagcacagaacaatcagattataaacacccagcagcatttgtatgtttcagcccagtgcagcattcttgttagtttttttgttaagacatggggtcttgctctatcacccaggctggagtgcaatggtgtgatcctaactcactgcaacctcaaactcttgagtttaagctatcctcctgcctcagcctcgcaagtagctgggattacaggcctgcatgccactacatcctgcttatcactggcttttaaaatttgctattctattacaattgccctcttgaagtttaagtcaaaaattttagtcaaagctaaaactctaacttggagcccaatgagcttctggaggacatcatatatttgcagatattttaagataaattcaagatcatattccaagactgattaatctctctcacacacataaaattgcatcatctataatccatgtattgtatattgcacaattccaagtacacaaaggaaggaatatatgacatttttaaagatatgctagtaatctgagttggttagcatgtttggcttctgtgggtcatgattctaagttgtagttgttacatcaactaatagttaagcacttactataagatacagaatagaaaggatatgacaaattcatccatgttcttaacagagcactgcaagtatacgctttattgtagactaatcttaacagaaaaagaacagcatgtttttaaaaatttcaaaatcatttgcttcaaaattcacagaaaaatcaagggaataccaaaatgaacctccatatcctatctctggactcccaatccagctgtactgaaatctaaaactatgccatacttacttccctttgttttttatgaaaattgattacacatacagatgatgtcctttgtgagctataccctgattccattccattctttccaaagatgcaagcataatcttgaatttgatatttatttcctatgtttttacactattactaccaattcaagaatttaaactttatcattgctttcaagcttttgataaatggtataatatcatacatattttatatacgttactctgtatataacctttatgcaacttatttgtttgctgaagtaggatattcacccatgatgataaacacagctctcattttagtagctttacagttcatcacatgactatgtcacaatttgccattctcttcttgcttaacatttacattgctttcatttttttcctattaaaaataaccaagacttttttctacatgtcttgagtttacctagagcatctaggaataaaattgttgggttcaagcctattgtatcttcaactttacaaagatattgctaaatgctcccacaagcagcatatgaagagttcctcattttatatttcctccaacatttggaagcatatttaagaaaaacagccactatctatatgaaaatttaaaaattcataagtgatcaattcctttggttttcatcaagtattggtttaacataggtatactaatgttccaaacaaagagaatagactgaaatttggcccaaggcacttacatgaaaacaaagctctgataacacagattttcctcatgtgactgaggaaataccaagacttaatctattttttaatcagccgaatttaagattcaagaacttaatctagaaatgataagattcctaattaaatattaagcttagatccaagatgaccaaagaggggaaaaaaagatgcaggaaaagtagatagtttgtgggtatgaacaatccctcctccaagttcattttgggcagtgcttctcacaaatgtggtgctcctaagaaaaatctcttaaagcttgtaaaaaaatgcaaattccaggtctggaaaaatgtttttattttattttttaaattctaggttattctcatacaggtggtttgcaggcaactaagcagtaagtaatgattaaaaatgaggtgctttcaatagagaggattatgtaactcatgttttagttaggggaggtaacagtaattaatatgttatctgttaaattacataaacttttttttaaaaacctctagcattagtcaacaacaacaaaaaagtaacctcaatttatggctgaatatgcttgacttcacaatgccaagaaaggttgtgggctcatttattttttcagataactagacacatactatgacaaagctttttttagtaatattaccagggaactaatattctgaatttactgtgattggcacaggaaaatattaagagtgagagtgatcaggagtgattttaatgaaggtgaccagaaagcaactatatgattaccttttaaatagaatgctattgcaaatgtcaaactttaaatgggacatttggctttatacactaaaaaaaaaaaaaaaaaaaaaaaaaaaggcattagtagtttcccaccaagaccgctacaaataaattcagaacatttatagaaatccaacattcacacttccctgtaactctaacctattgaaattagatgtaaaaggaagaaaaaaaatagaatatttaggttataaaaatcggcgcaaattcaaattataaaaataaaaacattcttctatattatttgaaattacaaagtcctgtttccaaaagatttagaataatctaagctttctagataaaaagttcagataaaagatatttcagtgagaaatggtaaatagaaaaagtaagcagtttagtagtaagaaaaaagacataagttttcatctgttgcctgcttttagttatttacaacactaagttaatatagaatgttgttttctttcttttattatagtgaaatcaacaagaattcggtcttgttagactgggcttttataaaacaaagataatgtagtccaaaagtgaaagaaacactcctgtgtggccatagccagcttttcttttctatcctcaatatattacctaacttgtgatatcagcaactaattataatttttttcagtctacctgcttaaaagtgaaaacatgaaacataccatatatacatgaaacatactatatatacctccagaagcaagacaggttttccattctaatggatggaattaactgaataaaaattaaatgaactaaagccacagagaaatagtaaaaaataatagagtctaagaactacaagcatctactgttctctttatgctgcaacctttctgctaaagaatgtattctctatactgtgtatgtggtacagtgacagttgggctcttcccacctgggtttgtaaaaacggatgggtgcaggctcctttggccaccattattgcatattgatgttattctgcacaacagctgacaagcagcatcgatctcccagcctctgctcccagctgtaaggggtaagaacaagggctgtggtgataacttgtttattcactgctgttgctgttgctgctgctgcttcttaaacagcaagctgagaaaagaatatcaaactgacacacagaggaaaaatggttcagacatcaatctacctctcaaggtctgcttatatcactatatgataaaattatttttaaaataatttttctttaaaaagtggggtggggagagaaaaaagacaaaattggtgttttgattataaagggaacctataatgtatgcaaggaaaaggaaattaatgacatatataataatcttccccttgtaagtctagatttaaccgctcaattatcaaaattctctgaagagttttaaccaatgttggggtaaattcattgagagtaacttccctacctattctcctggaaaataagaaagtgtaaaactccaatcaagaaatgacactttattttgcttacaaaatgcctctagctcccaagtgccccatatctaatcaccaccatatgtttgactttagacactattagcaaagaaataagattttagtccatactgtttttgcataaatcccattaaaaaaacttccatatgcaatttacctattttaaatgtgcaatacaaagttaaaaacttagtaagtacatagtattaattgatgagtaacagaaatagaaatattcactgttcaattacctttaaatgtaatgtgatgctatttatagacttacagctttaactgtaaatgcaactcatcttttagaaccttaagcaacttgtgattcagaaaaatataaaaagtcagaaaaatttggagatctataaactattaaaaagaaaaacccacataggctagaactggcaagtaagtttaaataataatacctaatcaagaaggctaagtttgagacattttaaaataaaagtatgaaacagtaacaatattttaaatttagatattttgtaacaaatcaaaacccaaccccaatcttctatttttatcacaattgaaaaaattttctgcttagcaactcaatgaggaacaaaaaatgttaataataataaaaataattctgaagaccagaggataacaagatactttaaatatatttgttttgtatgaaggctataaaataaaaaagactaacagcaaatcctcaagcaagatttttaaaaattcagacacttagaaacagtaatggattaataaactattaaccagtgggattaatcagtctcagcagccacatgtgaaacatgcttcacatttctcctctaagattctaaccatgaaaataggaaagtaaaactaagtcaaataatatgttaatgaagtatcaaaagtgtggtttgtggtgctgtgaatagaaatttcacttcaaaatgtatttaattttaaaccttcacattaattaaatattaccctttgaaaaatgcttatcagaaaatataattctgatacattagatctcatttgaagaaaaactgaaagaggttaaggatgttatttgctagtttaagaaaaaacacaaaatacacacatgaacaaaactgcttcaaataaatatttttaaaacttttatttaaaaagttaattgtatctattatttaacaaattctcatcaatatataaaacctctattaaaatgtcatagctgacaaactgcctaaaatgtaacatatccttataaactagcattatacatctctgacaaataataattttaagttccttcatatgtagatatgttaagttacctctattctagtttattcaaatattctttctatactaaaaaaactatttcagtaagacaggaacaatgatggtataactgtattttagggacagctaagaatttttcccaaaagtgaatgttatttaaccctgattgtgcatttagccaaaaacataaatattgaaaaaatgagatacaaatcactgaaaaaaagataaaaattaacacaataaatctcttcccccaaattccaacataattaactacacatcaaggcttaaatttagataatcaggtttgcaaatttaaaacggtcaaaatctttacaaaatgtcttacaaggggtagttaaaagagagccaatcatacacagcagttgaactctttgttaattggcctcctaaaataacccatactcctaattaggttaaagtttctcaccctgtaagaattgaccaaatacaagtaaactgttaatatttgtattgattcttttagatatgaaattatttactaagctaaattattagaagtttataacccagtataataactataggaagaacaattatatgatgctaaatatttgtgttcaaaataagttttgatatcttcaaagatcacaaatcacaaactctctaaatttggacgactctgtggatttatatcttatctaccatataaactcaaatgctgtctctcttttcctatttaactcattaaggctgttctaaagatacctgcattgaaagtgacaaactgaacctggattttttttcccagatactcaggtaactgtattttccacttttcatcttaatgttctctaacctgaaaaatagctgttaagtcagtgagggaaaaattgtatttattttcattttattcaaactaagctgctttttcataaaaatctcaaatcaaacatatgaagacattccatacctcatatttatctgaaccacattacagtatgacaccaatataaaagtatctaaacttcacccttatgttaaactctgatttctaaacatctttacattttatttaacttcaactgttaattgattcattcctggtttatctacctaatatccaatatagaaatatcaaatttcagtttttagtattttgatatgtatttcaacattcactcttaaacacacctcagaattcatctttaaaaattttacattgttggaagttaaaagcagttctatgatcgtgatgatatacttcattcttaagactaaataataattttctcatgaaaacaaacctttgacatttcctctaagtatataaatatttttaggtgaaaaaattaaaaaaaattgtattatgttagtaaaccttactttagcaaatagtttttacacaaataaacgcacacatatatgtacatataagattaatactttactatgaaagaattaaccaagtaatacttagtaatactgttcaataagttcattttcactataccagattaccattttagaaaatgaaagttgtattagttaaatactgtctgaaattttcaactaaaactataaaaatcactggaggtttagggattctacaattttatttttagagtctgcaacttttgatattaacaactgaaatattttactcagtgtatgttgagtaagatactagtaatttctgcttaagaaagtggttttttcagtttcgaccatattgccacttttggttagggcagtacttggaatactttacattttcttaaaatattctcatcaattttacctaattttgcaggctctacctactactcttccacctgtcaaacagctaagcactaaattccatttgatttaaactctccattttataagatgaaaagttcatattttactgagtacactgtaataaccttaagaaaataaaaattactataaatacatatttttggaataaattcagttggagttagaccttaggatgctgagaagaacattacctgtataaaaaaaaaatctggagttttagtaagctagacaactcagcttatggccacttcatatgatgatttctgtttatgagtaattacttattgattttagttcacgtaaaaatttcaactttaccaattgtctagtccgattatattgcaaagacataaaattatatggttttaaaatttgttagtataccttaatctcatgtcatgttccaatgcattatgtaagtattcaatcaaagaagtgaggctgttctccagaattggttctctgctacaggtcaaaacctgcaataaaaatgtcatgtattatagcatgaagacactcaacagatttccatctcctgcagttccacagttgatccctgaacacagaggtatggtcttcaaaatgaccctaatcttgccaatgttcagagaagctctaacttgaaaatgttttaaaaatagaaataacttgattagaaacacctgtgatatgctttatcatccgaagcctcttcaaacaaatcagattaatatgtttctgctttcatttctctttagggcattcatgttcaaagtagtatgggtgagtgtgtatgcgggtagctgttagaggactggtacaagaggagttcataaagaaaatatcagaaatgtagtttgtacttgtaaaactcataaaatccacacagtttaaaaagttactgaagggacagggacgaaattttactttctctccaaattatcaaatgttttaatgatgacagaatttaccattctttttttttttttttttttttgagacgaagttttgctcttgttgaccaggctggagagcaatggtgcgatataggatcactgcaacctctgccttctggattcaagggattctcctgcctcagcctcccgagtagctgggattacaggtgcctgccaccatgcctggctaagaatttaccattattttcaactttagtctactgccaagcctaagtgaaaagtatcagtatttccaaatattttaatacattacagtcctaacagaccaaaatgtggagtttttttttttttaacaagttaacatatttacaaataataaatggaccactactggaccaaatggttttttaatgtttctaagagatgtaactgaatatatgttaagtgttttttttcatttctttcacctttctgaattataatgattcagtggcaatcgactgtataaaaatattaaattaccaaaggtgtatcatgtattacatgtaaatcataatgctctgaataaattttccagttatatttaagaatagcttaggaaaatgaaagagtaaaacctaaaaaaacctttattcctctgttgccaaatatttgattgtttaatgacaaaacccacacaatcatccataactcataaacaccaatccaaataccatgacattttaaaaaattaccgtcatttatacacagtcttcctcaaaagacagacagttttctatatttgagcactctgaaaattaaggtatcttaagtttaaaaatcatagaaggaaaatagtagaaaacaaaatgtactacatgccaaatgttaagtttttaaatagtagggagatgaaaaatactaaccaataagaagcaaaagaggtctggatataaataaaataataaaccaatgtgtatgataaaaaaggcaatattaaaaaaccttcaaatagtaaaactcaaatctaaaatctattacaaaatagagcttactatttattcttagaaaccactacaagttattccagtacaaattttctttactgaaataaggcaggattaaccaaaggtatagtaaacttcttataatttgataagaaatattaataatattcaaatatatatttaatatcaatttcaatatttaaaacttgtctttctaaaaggaagatcctttaaagcatctctaatacagatcaaaaaataaaaacaaaaaaccaaccgaggcaaaaaaataaaaaacattcagttccccaccagaaagtaatatttatatgatctacgagataaataaacatataatagtaatgtgatattctaaaaatctatcctgttactcttaagacaatcatgacattaaagttctaatactgtcacttccaaaaattaaatgcttaatctcattttcaatgcttatttgaaataaagtggtattttattactgatttcctttggtgttatgagatttggggctacaaaatttcagcaagtcatagttgagctctaattatgtgccaaaattagttgcctggcatacaatgtttcaaagtttgctgaattaaaaacaaaacaaaaccaaaaacccccacgaaactatatatatgacaattttttctaagatgtgttttctagttataatcagacctaaaatctgtgtcttctaaaaaggggttaaaaagaaattaatatgtgaatttttaagcttcattagacagaagaaaaaaaacacaagagccaattttaggtaatattttaaaataagagaaatttttatagaataattttttgaaactataaatttatcatcttcttttgaagaaagctaatgtgtcatatataataattatctaatacagtctctgggaattttttttcattttgtaaaccaaatcaactgacccatatttctggctttaagtattctgtgacattccaaatagttactacctaccaataaacaaacaaacaaacaaaaatacacacaagtctccacaaaacaaaacaaacgaaaatgtactacataaagcatgatgaaaccaggaatctagactatgaaagctactttaaaatttttatccttagctgtagttcatgctaaacattaaaactcatattaatctgattagaaaaaatatgcagtgttacatacaaacacccgaggctacattttctgaatgtacaactaagacaggtcaacagtatttttttaaaaagtctgaaactgcacttttatttgaatttttaaaaatagtgtgggggcaaacaaatgaaaatcaatgctaccaggaagactgataccttaccagtcccctttcccccacaataggtaaacataactttaaaaaggggtgacctattatagcaacaccacaccccgcagttgctttcctatggtaataaatgactttgtaatacaaaataaattacaactgtcaatttctacagagaaatatggataagtgcacataaacattaaaaaatacacatatgttgtaacttatacctatatgcccacaagtctaaaaccaaaatcttcctcttatatagcatcacataaaagtgaaaatattttgaatgctgtggattttatttaggcgctagtgtattctcaaatttgaagtgatgtattttaaataaaggaatcacttcttttaaaaatggcttattaaacaaacaatcctttacccattaccccctaaacaaacaaaaaatcccataaaccaaagtgctaaaaatgtatggttatacttaaccagcctggtggaatttaaagcttgcccccaactcttcccaaaactcacgtaatttgaatgagaatacaaaactcaaaacaaaaaccatcagtaaaaagcaaaacccaggagttctggtactttaggtataattacgtttaaaatagaaatgagatctcctaaaatttcattaaatcaaattttatagagaagataattagcaccttctatgaaattttcataagatgacccaaaataaatagctttgaacaaaggtaatgaaaagggatctgttatcacaattcttgttatgagggcagtacaaaatagtatgaattataaactcagctattccacttactaatgtaaattatatttacagccctacagagatttataaaagccataagattttttatttgaatattttttaacaatgcgtatttgacttaatgcgaacatacacactataagcttcaaaatttaactactattcataaaagaatataaacgtctattaaattaaaacaattgtttctcaaagcatctacagctgtttatcagttagtttgccgctgttctttgaaaacgacacctgccttttatcaagatgcaattaaatggaatgacaagctcggtaataaatggaaatatactgaggctgtctcaggcaacatcgaacaaaaatcaactgaaaatcaaccagataaaaaacagcacacccacactgttgtatacaatatatttcttcataatgaatttatcaaaggaactaaataatagatacgcacctgtgcttacctgttgtctaaattaagaaacataaatgttttgtaaattaaagttttagttcactgcagttactgaattagcaaaatgtatattttcactagatgcgaaaagttttttaaataagatgttcaatttttatggaaaatgttaaaaagatcattcgtgaaccttaagaaaattagtttctttgcatcaaaataaaagaaacaactgtccggtaatctgcatccaacaaatatatgtagtttaaggtgaaaaattcctatcaaaggaaaaaaactaaatttttcactcagtttttaaccaataaagaacagtgacaaatatataaaagtcttgttaatttcaaccagcagaaacataattttgcgaaaacagcctcttcagttttacttttaatatacatttgagaaccacacgaaaatcctttctgagaggaaaaaaaactattaaaaaccaactttttttctaaactctcgtcctaacgtttcgtagctatttccgtggttctctggctaaaagtatattttttcgtaaagtcgagaattatagtttagcgttcaacattcaaaccccccaggcccgcttccttccagccaatcagggggtaacaagtccagagtttagggagctccgttagacacaatttgaaaaacatcacattgcactcttctattctcctccgggaaacattctaagcgagggcgggtcccccagtcttcatagaatataagaaataaatcaatcgttacatcaattccacggggaaaaactctgtaggcaggcagtcctaaagaagcgtgtcaccgcggttcccaggaagcgttattcctctttgcgaacaactgaacagaatagctgctgcagaaagcatctccggaatatttgcaacccagagccgtgcgccccacacgcaatacaccggcaaagggttaatctagtggtgcctccagcgcggaaaagaactcaagatctaatacatccttaacgcgggatttttacaaaggccatagaagtattacctaaagttaatgccgtcactggctcacatcactcaagagctgtggagtaagaattgatagaaaccaccagctaagggggaaaaaaaaaatcaccgaagggaaagacaaataacaactctcgtccctcctcctcagcgtcaagaaaaggtggggatcgcaaaattaccgttaagttgtccgggtaaagacttttgggggaggaaaacattaatagtttcacagattgcttttttccttgcgacatgtttcaaacaccggagaagaaaaaagtcttctaagaaagtgcgactcggaggaaatagccacgagaaggaaatcgttagctcgaagccccatctttcatctcacccgtgaacactcctcccctttgagaaaggacaacgctgcgagagcaaatgacaaaaatccccagaaagaagctaaagtccagcatctttcctaagagcccgctacaacctcaaaagcctgcccctgccccatcttggaagcgcgagccgcggccagtcctacctacctagagacctcaccgggacccagcgcgccgggggagggcagccagggcttgggaaactctttcctggggcacctcacgcttcagcgtcaaaagacaatatagatagatgggtgccgggcggtggcgggggggactgttgccacgacccaccggagggacccatgactccgggtcctgaattttctgtcgaccttaagtttcttgtcacgagatgacggccatcaccgggtcgagaaaacggcgagaaaaggcggcccggttcggaaatgggggaggggcgcgcgtccagtcctcctgtcaaggagcggccgcctgcagagaccccgcagtgcgccgtccccggctccggtcccgggcggggggtcttgctgacagatccgctgggcggcggctgctccgccgcagccggtccgcgtcccgctcaaactgcagctcccctccccccacagccccgtctctccgcgctcccgccacattccgcccgccgccgcccactcgcagacgcccaagttgcccctaaccctacttcctcggatttttcgcgattaagtgagagtagaccccgcgcccactccctgcacccaccactgcctgcgggtcccaccactgccacctcccgagtcccgctctgctacttcttcaggctcttaccgactgcgccagccttggcgaagctccgccgactgccctttgctccaagtaatttttggcgatttttaaagtaatttttccggcggagtcatagtggcgctatactctcggacaggttatcctgtctctcccgctagattgatgagatcaggcatcactcgaaaatggcgccgaaagcgctgaggctcctcattcaaattcgttagagccaaccccgccgccccagggaatgccgggaacgcgggctgcctccacagctgtcaataccgcctcttaaccccccttctcttgctttcccgacatttttacgcatgcgcaaactccaaccctcccccctcctcccgccaggcacatgcgcagaatcatcgtggtgcacggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccaggtaggaactattactgttctcgttttgaagaccaggaaacctaggctcagagacgttaagtaatttgcccaagacagcacaggtggcacagaagtggatgaatccacatctgtcagattcagcagccctggagttctctaccacgctgtacgattcaacctgagcccacacaggaggcgtggtctccttcttcaacggtgtgtgtgtgtgtgcgcgcgcgcctgcctagagttaatgattaagtttgctgaagcccttcttcccggtcctaagctgcctgttgcgaaggcgctttcattgaattcagtttctcttaccgtcttaacttgttcataaactttttgagataggaatgggcagtttttctgtgtcacttaggatgatttttttttttaatggcgtgataagtgaactgaatccagcaaagacgagtttctgttgtgcaacacgttggtatactgacagctaccacgtattgactgtgtactgtgtgctgggcactgtgctaaataaatgatttacgaattaatcgtgtttattgctcacaacagccttatgaagtaggtattatcttcactttacagatgaggacacctgaggttcagattaagaaatctgccccaaagtcttagaactggtaagtagaagcaccatatctaggcaaacctgtctaccttcaaaaaaaatgggcactctgataggacaattaacgataataaagttgtaatttttttttttttttgagacggagcctcgctctgtcgccaggctggagtgcagtggcgcgatctcggctcactgcagcctccgcctcccgggttcaagcaattctcctgcctcagcctcccgagtagctgggactacaggcaagtgccaccacgcccagctaatttttgtacttttaatagagacggggtttcaccatgttggccagaagggtctcgatctcttgacctcgcgatccgcccgcctcggcctcccaaagtgttgggattacaggcgtgagccaccgcgtggagccctataaagttgtaaatattttaaaaccttcattgtgaatgttaaataagagagtagatatgaaagtgcctgaagtactaataaggaagtgggagaagggtagcatggtttgcattatttaagtgtcttggaaaagaaatggattttagcaatttgagatcagcaagaagtaacgtggcagagtagtataaatacactacttaatctctggtacttttttgcactacttaagtgggtcgactctggaaccgagctgcctgggtgaatcccagctccactacttactagctgtgccttgttgggtaaattatctgttggaccttttgtaaaacaagtactattaatacctcattggactgttgtaaggatgtaaatgagctaacatattaaaggaatttcaacagtgcttggcatattagtaaatgtttgttattgtcagtcagtcattgatcttttaaactggcttctttaatggttgttcaaaaatcaaactacagttagtgcctttaggggtcagcattttttttctttttttttctgagagggagcctcactctgttgcccaggctggttggatcactgcaacctctgcctcccgggttcaagcagttctcctgcctcagcctcccatgtagctgggattacaggtgcgcgccaccacgcccggctaatttttgtatttttagtagagacggggtttcaccatgttggtcaggctggtctccaactcctgacctcgtgatctgtctgcctttgcctcccaaagtgctgggattataggcgtgagccaccgcgctgggcggggttagcattcttattcaagagctccttaaaatgataaatcaaactgacaaatgatttttcccaaatatgaataatgatccctgttaggcaaataaggatgttaatttattttaccatctcataagaataatacctggaaatggaatagatttattgctttttctgattgttaaggttaaaaaaccgaggcccatctaaaatatatataaagtaaaaatcatccaaatttctagcattcagggataaccacatattgtttgtactttaaaaatataatgtacctgtggggacaatcagctagggggggtctggataagtggtatatttgggagacatgtgtaaaattgtactagaacttacaaataggtaagtagcacaatctggtttcctcactgtagaattttttatcttagtccccttttagatataatatgtcaagagaattctaaagtgatgatgataaatgataacatttattgaagacctaatatgtgtcagacactgggctaagcatgtacatgcatttttccatcgaatcatcatgtaactcattaagtgggtgcaattatctctattttgcagagactaaagtttatgtgtaagtcacttttagaagatttaagtctaattgtgtttaaagtcttatttaagaaaaaatctttcatgaaagcttcttgatttgctaaaatgggagaaaacaaaatcaactaacatacagtagttcctatgcctgaacagagagcccgattgtaaaaaacggtcttttgaaaactaagaattttatatttgaccacaagggggtgcaaattcctgagttaaatttcaaaggaaaaacgggaaaagtgcttttactttagaccatcaaattcgtgggttaaaactagtaagaattcctgcctggaactttaataccctacaaagtaatgtactttataagaagaaagaactcaattacttaggtgctcaattagggcagaagtgtcagcttgctttcttcaatacagtcaagagttaatcatccctcccccacccctttccactcacagttagtttgtgtctctgcatacccctctttacttgtcaataagagtagaactgaagtcataatttaaaatctggggttttgctcttggaaactgaaatgcaatcaccagctaatggatgctaaatatgggtagtgtgaagaacagaggtcttgtaatttctatgctttttttccctcctgctgaagtttataatgagtaagctacaactgatgcaatgttggcttcaacatattaacttatttagataaaactgtgaaagctataggtctgttcatctttcaagaaagaatgcaggccgggcgcggtggctcacgcctgtaatcccagcactttgggaggccgaggcaggcggatcacgaggtcaggagatcgagaccatcctggctaacatggtgaaaccccgtctctactaaaaatacaaaaaaattagctgagcgtggtggcaggcgcctgtagtcccagctactcgggaggctgaggcaggagaatggcatgaacctgggaggcggagcttgcagtgagccgagatcgcgccactgcactccagcctgggccactgagcaagactctgtctcgagaaaaaaaaaagaaagaaagaatgcagacagtaccttgaaaacagtatatactactgaatgtattaaaaactttgcttagcagggttttcaacttccttttattttcgtgttggtcttgtttctctgagatgggacttaatttaaaaaatacaactttttttggaaataatttcaaatttacaaaaagttacaatattaaaaagagttcaaagaacatctatatcatttgcttgctcttgtacatgggtgagttttctttttctctctctctccatatacacagtctataaaaaacacacagaggaaaaatacaagaaaaaaactttcaacccatatcaaggttttatgattatagttaaaaatatacatatcaaaaagtcaaactaaaattttgcagtgttgacactgccaaactattcttttaaggaacattggtgttctatcagctagtccagtgatttttgtttttttaagagacagggtctctctatattgcccaggctggcttcaaactcctggactcaagtgatcgtccattcagccttacaagtagcagggactgtaggcaagtgccactgcacccagctcagtgattcttaaactttgaaaatgtgttgaaagttatagaccctttctctagaatcatgcatgtatgtgaatagtttgcatatagtttcagaggtggatgatggtccatggagttcctgaagaaaagtaaaggaaaaattattcatacatatggtaggcagaataatggcctaccaaagatgtccaaagatgtacatgtcctaatctctctgggatttgtgaatatgttatgttacacggtgagagataattcaagttgcagataaaaattagggttgctactcagatgatctgaaaatagattattctggatcacctgaggaggcctaattacatggtcctttaagtgtgtaaaggggaagcagaagaatccgtgtcaatgatgagatgtgagaaagccattgctgactctgaaggtggaaggaggccatgagccaaagaatagttcatgagctctagaagctgaaaaaggcaagaaaacagactctttaggaatgcagccatgccgacatctctattttagcccgctaagacccattttgaatttctgacctccagaactgtaagataatacatttctgttgttttaagccactaagtttatggtaatttgtttaaggtaattttaaggcattaggaaactaataaaggatgtgaacagtcattttgtatgtgtgttgatgtgtggttatggtagtaattaagtgtgtgtgtgtgtgtgtgtgtatacattttttaataccacctaggtatttttctttttttcttttttttttttttttggagttggggtctctgtctcctaggctggagttcagtggagtgatctcggctcactttaacctctgtcttctgggctcaagtgatcctcccacctcagcctcccgagtagctgggaccacaggtgcccgccaccacacccacctaattttttgtattttttggtagaggtggggtttcgtcatgttgcctgagctgttctgtaattttttgcttaacaaatccataaaaagtacttctttatcttttttaaaggtctgtgaagtgtcagacctcaagatggacaactatttaattagatatagcatcttatctactactgaaattatattcctacacaatttactgaaatttcttggtaagaatgtgatgagcttttcccaaaaatttacccatctacattccctttataaaacgcaaccttttgatttacagttatgttgacaatatctttgttctgtcaagtatcttggataatttcttctccctgtagctaattgacagattaaaaacaattagaaaattctcctcagaggttatttaaacagtatataattatatgctttacttaggtatcagcttaagagaataaactgtttagaaacagatttattttgcagttggtagattattttaatggaagatcaatacaggtacttaattatctataaatgttttgtgagcaagaaactttttgtgatttttttttttaaaggataccaatattagttacatgggggaaaatttatacacacatcaggaaatgtacttgttttaggaaatttacatggtttagagctccaatttctagaagtggttagaacagattcatatatagcattttcaactttgattctctgaatatactgagttaagattttttttcctatatgaggagttattttgcttacagtatccttgaccacaaatcatggaactaaactaaaattcatttacgactaataatggtcaacatttattgaggaagtatgaccttttttattttgttgttgagacagagtctcactctgttctccaggctggagtacagtggtgtgatctcggctcactgcaacctctgcctcccgggttcaagcagttctcctgctgcagcctcccaagtagctggtacaacacgtaccaccaggcatctaatttttgtatttttagtagagatggggttttgccatgttggccaggctggttttgaactcctggcctcaggtgatccgcctgccttggcttcccaaagtggcgtgagccactgcacctggctgggaagtatggatttttttttttcacgtaccaataatgattcctggaaagggataaacccatttgtttttgttaatcttctttctaaaattaatgttaaaatgttggccttaaatgagatattaaatatggtgttttgaaacactgcttttgaaataatatatactttgtgagagcttaataaaggaaatttagcctattcaggattggaatcatagaatcttaagagttaaaatatgtctcttcttactgccacccattgtctaagtgtcccctgaggctactgagaacaaatttattctcacctacctacagtaaccctttaaatatgatcattatttttttgaatcatgatgacagcagaattcccactcccaaacatcctttaatggcttctttaatgtgtctttaattgttttatgctcttaaacccttcaccatcttggtttccttcttctggttattcttgtttaacaaggcccctctcaaacagtgacacccagaatggtattaattacatatatatactatatatagtctgaaatataccatgggtgggtattaactttttgtcctatccattacaatttttgtattttaagaacaattttaggtcgtaacagggactcataaataatggaaatggatgtattggaaatgtatcaaaagaaagttttaaaagttttaacataaactacaggagtaaaaaacttaaaaattacaacttatgactttctcagagactttattgagttgggatgaactggaagttgtggaggatagggaaccaggaatctattacattcatgtcttatttatttttaataaactggagtaaaattgagactggtctgtaggagatatgactgcggatgtgtgatcagttgtctaagacagttgagcctcatactacatttctattcttaatatgtaaaatgtatttcttatagtacaaatcccttttggctaggaaattcttatatgtttaaaataaattaaccttttaaggcagctctgaagaagtaatttattttaaataggtgagcagtttatagctcttatgggaatactttttccttattttttcatcataggattagaccctgtgtttttaatttaagtcctttaatttttgctgttaatgtttaatttacttgatgaccccgtactgttaacttttgaccaagtgaacttgggacagtatatacaaactgtttacctaattttaaggaaactcttttaaaaataagataggtttgatgtgaaacagaacattaaattcatttcaactttccatgtagaaaaatatcatatgtatttaatcaaataacttttccccccttattggaggatgtatttttatcagcatggaggttttttgttttttaataattagatgtttatgccattggcaaaacaacccaaagctgaccatgaccaaactgcaatacttttaataaactaaaagactactaatatagtagatataaaaccctttcctgataagaaatttttatagcgtatgactgaatctaacaattctccctctacctttatttatgctcgtttactttcttttatagaaaattgaaattcctaaagtttaagtttttagatgtaaaaaatgttagtatatacagttaaattaagttcaaggtttcttttaaaccacttgatgtaatttactttgtatatagcttttatttgcctttttaaaattattattacaatttttttagacagagaattgctgtatcatgcaggctggagtgcaggggcgtgatctcaggtcactgcaacctctgcctccccggttcaagcaattctcgttcctcagcttcccaagtagctggaattataggcgcaagccaccatgcccagctaatttttttttttttttttttttgtatttttagtacagacagggtttctgcatgttggccaggctggtctcaaactcctgatctcaagtgatcctcctgcctcagcctcccaaactgctgggattataggcatgagccactgcacccagcttatttgcccttcaaactagacctgtggacttgcttttgaacattttctcccctaattatagaatacatgtgcattaaagaaaacagaaaaaaatcaggaatgattggaaggcattgcttctgaaggcctcttaacaatatacctctctcctcatctcctttcccagttgaccaaagaaggctccgtgtttgtcttttatgtatattagcatgattgaacttcatccatttagccttattgaatactgtactttgtttctcttcaggaaaattacagtttgatatcttgtgggacagaaggtttcatctttcagtcatcagagagcaaagtaggaaagacttagagaggcaaagtccctctgcacctaaggatacactatttttactctaagggggccatgagggtttatttactttcatcattttggggtgaggaatggttagaaactgagggagcataaataggttaagtattatccatgacagtagggtgggagttaatggaagctcatttatagcagttctacttcctgatttatgggtatgtgtggtgcattttaaagagattctggtgaactaacaaggtgtaataattgtattttgttatatatcatattattgactgccggactgcttaacatgcagcttaataattattatggatatctttaaatatgccacattcactttattcagaagtgaactgataagcaacaagctgccatgtgctgaacagtattaggtactgggataaacaagggttttaaatgctgagaatagtgtaagctatatatgtttctgtatagccttcatggtttgctaataaggtaatctgttgtcatttcataattgaaatactagggggaatgttgtaaaaatgctctttattattgttatttaaatggaagtattttgtgtggttttatagtcatggtgggaaatcatgagtttttggactagggtagtgatggttgggatagaagatgagggaaaaatctgtaatgcctccctggtccctggcctggttgtagagtacaatggtggtatcattaaccaggacagggacaagtggaggaggctcatggcttttgagagagagagagagagagagagagtgtgtgtgtgtgtgtgtgtgtgtgtgtgtgtgtgtgtgtgtgtatgtttatgggtgtgagatggaacgctgggacatgagagggagatgacaagtccagtgaggacattttgaatatgaaagattaagcactcatgggatacctaagtagggaagttcagtaaggagctcaatatatacgactgaggcttaggagaaaggcctgggctggaaatggatatcactaaataggtggtagttcagattatgagggaaatggatgccattgctcatagagactaaacatagaggaaatgagaaccaaaattagtaaatgggcaaagtaagaggaagcagcaaaagactgagaaggaatggctgagagaggggcaggaacaccaacagagctcagagttaaaggagccagtggtagagaggtttcaaaaggaaagaagtcaggagtgtcagaaggtaaagacaggccaagtaaactgaaaaagataaaaggatttggcagttctgtcattagtaatgtttgccagaacactttcaatgaaacaatggtggcagaattctgtttgtgttgagttgaaaagtatattaaaatagggaaaggggctgggtgcagtggctcttgcctgtaatcccagcactttgggaggcccaagcaggcagatcacctgaggtcgggagtttgaaaccagtctgaccaacatgaagaaaccctgtctctactaaaaatacaaaattagctgggcatggtgacacatgcctgtaatcccagctactcaggaggctgaggcaggagaattgcttgaacctgggaggcagaggttgtggtgagccgagattgcggcattgcactccagcctgggcaacaaaagcgaagccccgtctcaaaaaaaaaaaaaaaaaaaaaagagaatggttacaataaatgtgtattatttcaaggctcttgacattttcttaaaaacaaaagatgataattttagggaggaggttacagaatagagtaggagatctacaagagaagagaacttaacatttttataaagtatggggacagagtcatcagagaggagaaattagaaaggtatagtgagatctagtaggagataagggtgcaggtaaaggaattaacccagaaaagagaaaggataccttttcctctgagactagaagggaacaggtaagatggttttatgtataacttgtaaatctagagcaggaagttgagggaattcatagctaatagttttagtttttattttttttctgataaaggagtcataaaagaggtaagggtagagctgaagtagcaagtttgagttgaagtaagatggtacaaaatatatgctctaggtaatgggagagggaattaatgagggaggaaggttgttagcagaagagggtgatgtacctgagaacctaggctggataggaaaagacacaaagcatgtgggagattgtagtttgaagaaatgagattgtagtttgaagaaatgaggaatgggtatcaaaattaggtaagaaagcaggtatttagggagtaatggagtaaaaaaactgcaaggataagtagttgtagtcagagatcaatatattggactcttaaggctgtagaataatttcttggttatcagaagatagagggtgtagctttgggtatggattactgaatgaagtggttttatggagtcagagttcatagtttttcaatgggttttccatatggacactgaagtgggaggtgatggcagaaaatgcaggggaggcagatactgtcagcaaagggccagagtcctcaacaaaatggaatgactgggtaattaataagaatgaaagaaaggagtaaaaaattcccaagattgttcatcatgccttttttttttcctcgtaaattaagagacatgagggtaaggactatgtctgaattaatccaacaaatgcaaatatttgttgaattaataagtgaatgataaactcatgttgaataagtatttcagaaaacttgtttttttcttattataagtagtcgatattaaagaaaatacaaataagcaggatgtaggaaaaaataatcccatcagccagaaatacctacccccaacaccctttgttattaaactttttgcttaaatctgtttgttgttcatatatttttttcctagcaatattcagttgtacactttaacatctaaataagtattttcttatggaatataaggatgtactataatttaagcagttccttattttggggcatttatattgattccacccaagtttcttcaactggtaaaacgaaaaacctaatagctattttttttttttagacagtttcgttcttgtcgcccaggctggagtgcaatggcacaatcttggctcactgcaacctctgcctcccaggttcaagcaattctgctgcctcagcctcctgagtagctgggactacaggcgtatgccaccatgcccggctaatttttgtatttttagtagagacaggatttcaccatgttggacaggctggtcttgaacttctgactttgggtgatctgcccgcctcggcctcccaaagtgtggggattacaggcgtgtgccaccacgcccggataatttttgtatttttagtagagatggggtttcaccatgttggccaggctggtcttgaacttctgacctcaggtgatctgcccgcctcagcctcccaaagtgttgggattacaggtgtgtgccaccacgcccagcataatagctaaatttttgccttacttattttcttaggattcttagaagtagattttctaggaggggcttcatagagatcctatttatctttattttagggccatttctaacaggcttgtttatgtgcattccatccaggattggaatcctggacaatggacagtgttgcaggtattgactgatgcaggcatgctgacagccacaaaagtgagaactgttagtcacaggtccttcttcacaaaaagaatgatgggtatttttaaaacttggaatcaagtatagttttcatgagcacagtaagagatgattcatgagctgaatacaggatatagtagtcaattcagaaatgcatattcaaattaaataaaaaactcttacaatagtctatatttgttgataatactgaactttagtagaggtttttttccataaattttaaaactgtggcaaaatactcatgaagtttatcaacttaaccatttttaagtgtacagttcagtggtattaaatacatccattatgttgtaaccatcaccaccattcatctttgtaactagtagaggtattaatataccaatcttgaatagtcatcaaagtcactctacctcaaacttttccacaaaagtatggttagtagcagagaggagtgaacaattgccttaaaaacttggtcccaagctagaattctttttagcttcatgttttgtcttaaatttaatgtaaatgtagtgttacataccataatgttcctatatttagtaaaatacaatgattatacattttttcaaaatctctgagggaggttgatccccttaactttggcaattttgagacgaagtcttgctctgtcacccaggctggagtgcagtggcatgatctcagctcactgcaacctctgcctcccgggttcaagcgattctcatgcctcagcctcccgaatagctgggattacaggcatgtgccaccatgcctggctaatttttgtattttattagagatggggttttgccatgttggccaggctgatcttgaactcctgacctcgggtgatgcgcctgcctcggcctcccaaagtgctgggattacaggcgtgaaccaccatacccggccttcatttttcttttacggtttagccaaggctatttatagtagtgtatgtcaaggagtagactgattgatgttcaccctcttcaaatgtgagtgtcacagaaactgaaattcacagagtaaaaatttagaagtatccttttatattatatttgctctagtaatcaagcatacttcatcattattaatgctatgagacaatcttattgtacaaataaagagaatgatttcatgtgctggctagggccatagccccacctttccaaagagtatcaacttttcaactatccatgcattatgactccagagacttgtaaaccctctcaggtgtaataaattttttttttttttttgagaggagtctcgctctgttgtaaggctggagtgcagtggcgctatctcggctcactgcaacctgcgcctcctgggttcaagtgattctcctgcctcagcctcccgagtagctgggactacaggtgcgtgccaccacgcccagctaattttgtgtttttagtagagatggggtttcaccgtgttggccaggctggtctcgatctcttgacctcatgatccacctgcctcggcttcccaaaatgctgggattacaggtgtgagccactgtggcccggcccagctgtaataattttgttcttcatgcctgatcccatttcaggagattggttattacattgaaggacagtagcaaaattggaactaaagtctgagtctcttaactcctagttgagggtctttccaattacaccaaaaggaaaagagttacatataacaagagataagacttactcctacctgcccccacaaaaccactttaagccatcctaagaacggtctcttttttctccctccctctctccttcccttcacctttcctttcttcttcttcttaccttttttgggggtaactcccaaccaccccagttctcagaattaaaaggttaagaatattttagtactcttcaagatacaaagtagactattagagttttttgttgttgtttctcaagcttgggacataaagctcagagatcagaacaacagaattttagaaaggaatagataggatacatgaaaaaggctgctggaatatgaaaaaactggagtaaaaataagcaaatcaatacttctgaaatgaagccttcattggtagaaaagagtgtaggtcacaaaaatgaattagcagaagttcttgatttctaattattgaagattcctatctagtggtattctaatatgcttaccaaattatgagttgcattactttttaaaaacctaaaaccaagtcaagatttacagagtgaccccagtttattttgtttggtaagttttcagttccagttattaggcaaaacaaaaattgctaatacgtaacaatgctgaaacaggcgattggtagaataaaacaaaagggattcatacagcttttgtactgtcttcttgaaaaagtcatatttggccataaaagctaatacatgctttaggaatggaaatgatttaacctgattttttcaagtaagatttgttcaagaataatgggcttatgttgtcagttgtgggttcaagcagtaattcactttggactgcttctattcaacagtatgctgtctgtacgtaaagagttacatggaatttaattttagcattggaatctatttgagataccattatcttttatattcaaatgaaaaattatgggcctctagaattaagtgttactaacctgatatagatagaataatagctgtatcaaaaggaaaaaagcaaggataatatgtgtatagggtttgaatcatacagtctcactagagatgtgttttttaaaattgtgaatgtttgttgattcattcaaaaccgtttgaaaattgtgagggagccagaaaaggggagaatatttggatgtataatttagatgtatagtttgcttgcttatcagggaatagttaagttccttttttttctgtatattttagttggtgaaattaacagtttttgttcttttagattaccctgtaaaagaacatggcattttatagatgagataattgaggcttatacatgttgagttataatgtgtggaggagtctgatgtgcatccaagtctgtctgcccctaatgtctctgtttttaaccattatcctcagaatgaaatacattcatatagtagagaccaattcttaaacagaagtcatctttactcacaaaattaatctgtgaagtacccactgttctcagtttctctccctctcactttttctttctagtgctttgcagtttttaatgaaagtgaatatttttttcagaaattattattttcatgttttttattagaggattaaatttgttgctaagatcatttagtaagtcttttgcagtcttttaagattagacttaagtgtaaacttaaagattgccttgaagtatattatttagctatattgcattattattccttatgtaatgagctatagactgagcactccttgacaaatcacaagaataagacccaaagaatcaaactttcccaagtaacttaactgcatcccaggacaaaactcaggaacatttagaggaacagaagactatccagcagccaacagataaaattcacaatgccttgccaggcacacaaagaagccagaaaaaataatccacaatgatgaaaacaatcaatcatctgaaagtgaccttaagcagagaaagatgttagaactagtaaagacattgaacattattatagctatattctatattttcagaaagtagagacatgaaagacatttttaaaaactcaatgcagttctagggatgaaaactacaatatctgagatctactaatggtatttgtagcagattagacatggcagaagaaaaggttagtgaacttgaaggatatagcaaaagaaactactcaaaaatgaaagagaaaaaagaatgacaaaagcatcagtgagctatgggacaaacttacagaatccttatgtaaacataatcagaggcatcaaaggagaggagaggcagatacaaaagggatatttgaaaaagtaatggccagaattttcaaattggacaaaaactattaactcacagatccaagaagctcaacaagaagaaaactacaccaaggaatgtcataatcaaattattcaaagccaattataaaaaatatggaaaacagccacatgttatagagtaacaaagataaggttgacagcagatttctcattagaaacattgcaagtgaagagacagtagaacataaagtactgaaagaaaaaaatgttaacctcagcaaaatatcattcaaaaaacaaaggcaaaataaagatgttttcagacatacgaaaacaactctttaccatcaggtagactgaaggtagactgtggtagggtgaagatgtatactgccctagggcaaccagtagaataacaaaacagttatagctaataagtcaacaaaggagataagatagaatcacaaaaaaatactcaacccaaaagaaggtggaaaaaggaacaaataagtagtgaaactaatagaaaaatggcaaggcaatagactgtaatcatatcagcaatcacattaaatgcatattatctaaatatcccacttaaaaggcaaagattgtcagataaaaagcaagactgcttttggacctggatgaacaggaggcaccatcacggaagttgactcctgccacaacaatgactgaaaggttcaacaccaggaacccaagagccaggacatctactgaaggctgttggttaagctgtatatgtttctggccagaagaaactctaccttcaaccaagttgtggtgaagaggttatttatgagttgcaccaaatggccatctctgtctctttcctggatgatctggaagatgaagcttcctggccaggaaaacaaaacagctgtggttgtggggaccatgttcaggaggtgcccaaactgaaggtgtgtgcactgcacatgagcagttgggcctgcagccaaatccccaaggctggggacaagattctcacctttgaccagctgaccctggacaccctcaaaggctgtggcaccatcctgctctctgggcctcacaagggccaagaagtgtactggcatttcagcaaggccctgggaacccagcatagccacactaagccctgtgtccactccagggaccagaaattcaagcacatcagaggctgatgggccagccaaggctacaaaaactaaccctggatcctctatcttattaaaaagattttggcctgggcgcagtggctcatccctgtaatcccagcactttgggaggccaaggagggcagatcacttgagcctaggagttcaagaccagcctgggcaacaagtgaaactccatctctataaaaaattaaaaaaaaaaattagttgggtgtggtggtacatgcctgtagtcccagctacttgggaggctgaggcaagaggatcgcttgagcccaggaagtcaaggctccagtgagccatgatcgtgccactgcactccaccctgggcgacagagtgagaccctgtcttagaacaaaacaaaacgaaacaaaaaattttggatggtgggggaaaggaaaataaaaaacaagatccaactatatactctcaataaaaaaacacattttaggctgggtgtgatggctcccagcactttgggaggtcaaggcaggtagatcaccggaagtcaggagttcaagaccagcctggccaacatggcgaaatctcgtccctactaaaaatacaaaaattagccaggcatggtgatgggtgcctgtaatcccagctacttgggaggctgaggcagaagaattggacgaatgcaggaggcagaggttgcagtgagcagagatcatgccactgcactccagcctgggagacaaaacgagattccgtctcaaaaaaaaaaaaaaaaaaaagaaaaagaaacacattttacacacaaagacataataacattaagaataaaaggatgaccaggcacagtggctcatgcctgtaatcccagcactttgggaggttgaggcaagaggatcacttgagcccatgagtctgagaccagcctgggcaatatggtgagatcctgtctccacaaaaaattagccaagtgtggtggtgcacacctgtagtcccagctacttgggaggctgaggtgggaggatagcttgaacccaggaagtcaaggctatagggagtggtgatcacgccactgtactccagcctggagtgactcaaagtacagtcactttgagacagagtgagactctgtctcaaaaaaaaaaaaaaaaaaaaaaaaaggtaaaaggatggaaaaagatatatcatactgatgctggcattagtcaaaagaaaactggtgtggctatattaacatgaaataaagtagatttcagagcaaataatattaccaggaataaagaaggccattttataataataaaagggctggttaatcagaaggatacaataatcctacatggttttgtctcaaataataaaagcttcaaaatatgtaaatcaaaaactgacagaagtgcaaggaaaaacagacaaatccatagttagagatttcaatacccctctttaaatgattgctaaaacaagtagaaacttacaaggatatagtaaactcaagcaacactgtaaccaaattaacagtacaggttgagcatccctaatctgaaatacaaaatgctccaaaatccaaaattttttgagcaccaacatgacccaatacgttgggtcctattcccaggatctcttattatatatatatatataaatgttcagaaaatccaaaaaactttgaaatctgaaacacttctggtcccaagcattttggataagggatactcaacctgtaatagaatatatattctcttcaaagtatacatgaaacatttacccaaatcgatcatattctaggccagaggttatcaaactatggccctgaggccaaatgtagtctgtttttgtatagtccatgaactaaaaatggtttttacattttgaaagatttctttaagaagaaaagaaaatatgtgacaaagatcatatgtggcccacagagtttaaaatatttactgtctgaccctttagagaagtttgcctgcccctgttctaggccataaaacatgtctcagtaaattttaaaggattcagataatgcagagtatgtcttctgactacagtagaattaaaattagaaatcaataacagaaagctgtctggaaaatccccaaatgtttggaaacaaaataacatgctactaaataaccttctaataacccattgattaaaataggagtgcagtaaaattagaaggcattttgagctgaatgaaaatgaaaacaaagcatatcaaattttgtggcatgccactaaagcagtatgtaggaagacataagcaaaatgcttatattagaaaatataaaaagtctcaagttaatgagcttccaccttaagaaattagaaaagaagaacaaattaaacacaaagaaacaaaagaaataataaagatcaaagtagaaataaatgaaatggaaaacaaaataaattgagagtattaatgaaaccaaaccctggttctttgagataaataaaattgataaatcttttgccacgctgatcaggaaaaaaaaaaaaaaaagagagaagacacatattaccaatatcaggaatgagaggtgaaatatgacaaattctacagatacttaaagaatagcaagggaatattatgaaaaaccttaagcaaataaaattcaacaacttagatgaaatggtcaaattccttgaaagacataactaccaaagcttactcaaaaagaagtacagccaggtgcagtggctcacacctgtaatcccagcattttgggagtttgaggtgggcagatcacttaagtccaggagttcgagaccagcctgggcaatgtgaagaaaccccatctctactaaaaatacaaaaaaatttagctgggtgtggtggtgcatgactgtagtcccagctacttggggggctaaggcgggaggatcgcttgagcttgcgagattgagccctgattatgccactgcattccagcctgggtgaaagagtgagaccctgtctcaaaaaaaaaaaaaaaaagaaaaaaaagaaaaaaaaaagaaaaaaaagaaaaaaaaaagaaaaagaaatagataacttccaaagctatgtatctatttttaaaaaattaatagttaaaaatattctcacaaagaaacactagtggattcttccagacacttagggataacactgtgtataccaattatatacaaatcttccagaaaactgaagaggaaggaatacgtctcagtttatttttgggggccagcattaccctgatacctaaaccacacaaagccattacaagaaaagaaaactatagcccagtttccctcttgaacatggatgtaataattctcaacgaaactttaacaagtcaaatccaacaaaatataagaaagttaatattactggatgaggtttatcccaaaaatatgtcattgctttaaattaaaaaattaatcattgtaagtcactatattaagctaaaaaagaaaatctgatcatttcaatagacacccaaaaaatctgacaaaatcgtatatttgttcctgattttaaaaaaccaaaaacaaaaaaaacaaaaaaaacaaaaaaaaaaccaaacctgttagcaaactaggaatagaagggtactttctcaaccagataaaggacatctataaaaatcctacagatagccttatgcataatgatgaaaaactgcatgctttccctttccccgtaagataaagaataatacaaagatatctgctctgaccactttcattcaacatcagaggttctgtccagggcaatcaggcaagaaaaagaaataaatcgcattcaagttagaaaggaagaaatacaactgatgatagccatcattcctaagagttccccttgcctctttataatccttgcctcctcttacctctctccccaggaaaccactggcctgttttctgtcactagagaccagtttgcattttctagaactgatatatgtggaatcatgcagtatgttactcaattttttttgtcagtaattggtagcttatcttgcaatcaaagttcatatacaaccatttgatcttcattccattccctcattagtccatagaatgtcaatcaatttttctttcttttatttatttattttaacgaaacagggtcttgttgtgttgcctaggctggagtgcaggcttacttcaacctccaactcctgggctcaggtgatcctcccgcctaagcctccagagtagctgggactacaagggtgtgtcaccatgcctggctaactttttaaaattttttgtattgatggggtcttgccatgttgcccaggctggtctcgaactcctgagctcaagacctcccaaagtgctgggattacaggcatgagccactgcgcctggactcaatttctgtatgatgatgactttcatatgtacatcaacaggccagatagcttatcaagaaagcttctcctctgtcttctagtaatatcccacttagatctgacattatttttttccttcaaggtatttcttccaaatttcttggctgttgttggtgacaacacaagtttttggacctttaagtttacaatcttaggttcatttccttattttatttcttccctataggtaaatgatcactaaacttgttacttcttatagttacttctttgtaaggcactgcagatatgtttcttttcatttttaaaattgcccatttaattcaagctattaaatatcaagcttgtactatatcaagagtactatatatcaagactatagcctcttgatattttccctaccctcccatcctgccatacccatgtctccactagcctatataaaacataaaatacttttcatcaaactctctgtagagaagtgttgctgggcgaataagaaaaacctgattgactagaaagcaaatgtaaatgtaatctcctttcttttcagtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaatgaatggttatcttttctctctggcaatccaaattcaccactccttaaaaattctacataagatttgctggctgggcgcagtgactcacgcctgtaatcccagcactttgggagactgagacaggtggatcacctgaggtcaggagtttgagaccagtctcaacatagcgaaaccccatctctactaaaagtacaaaaattagccgggcgtggtggcaggcgcctgtaatcccagctacttgggagactgaggcaggagaatcacttgagcccaggggggcagaggttgcagtgagctgagatcacgccacttcactccagcctgggcaaaagagcaaaactccgtctccaaaaaaaaaaaaaaaagatttgcctattccagcagacttctacccaatatcaatctagatttaaatcacttgattttccacatccctttagcaattatgtatagtttgcacttcattaacctacccttatttatgttacttctcacatacacccatatctcttctgtattttcaatcaaaagataatgcctcaaatgttatatatattgtatgtgccactcaacagtgcctcatatgctgcaaaaaaaaaagacagtaaacaatcggggtacctttttgtcttttaagccatattttctgggtcagtgtggtctttcaagggagtttagacaggctctattttttgttacttcactcctatagtatgtgactgtaaattgttccttcagtgttcaatttaagtacaaactaaagagaaacagtttcctaaagaaaaacattttaaagttacagagacacctatgtgttcgtaacatttctccagaaatatttgaagtaacgtaaaacttctggactggtcagtttaaatattttcttggaatttctatagaaatttctgtggaatggtgttatattggaaatattaattaactataagaagactcctacttcttcacagagaacaagcagggatatcctggattttcacagtatttaggccactccttaattgtctcatgaaggaattaaggtagtggaacacattcaagaattgcttaggtgtcaaaataagacaaagtgtaacagtttttttctgtagtagatttttaaatagttaaaagactctgccctctttatctatactgtattctggcaataataaagttgggcagcctatacataaaagcaatttctaacaatgccaaattaacagcagtttcttggccctttcctttccctccatgaaagttacaatattaggttatttcacaggtttcctccatgccccccatacccaacctaaaactgtgttaggctgtcaaagaaaacaaatcaggtaagattagtgtttgcctttacgcagtcattctaagtacacataaaatcatacataatatgaaaatacagcaggaagagaaacatcaaaccatagaactgagttttagttttactgacatttatatggcatacttcctgtttttgatttcagaagtgcaaccatgcagtgcttctatgaaaaactgaatagttgagtacagtttgaggattataacaacttatccaaaggaaacaaacagacctaacttactgctgttttcatttgtggaactgctatctttgttgtaaaaagttgagtatttttcaaacatcatttaataatagggtagcccctaaaacaagtaaggagctataagtctgagttgtgaatttgactagtaatggaataagaaaaccaagccaaactccatctaaatatgtatgtaaaggtaatgcttgtaaaaatttgctttttcctcattttgagatttcagttgccagttgactattggtatgcaaaattaacaattctgcctaaaggaggtaaacgatagaggttaattcttaaataaaagtccctttgtttcactattaactttttctatttgaagcataattgtgtcagctaatttattttttggtaaccacttaggaatttgggagggaggggggcactcaagtaagcaatgacagccagctagacatcaaaatccatgttctcacttcatggccgtacagataaatttcatttcctagcctctcttgcagttagatgtgggcatatgactaagctctagctagtggaatgagaatggatgtcaactactttaagctctttaagtcaactaaagaaatcaactactttaagctcctgtccctaaaaaactcccaacagactgacccctccaaggaaaccttggaagttaggtcctaaatgcttaggtacagtaagaccttggaaactactaaagaaatagtaaagtaaacttgttttgcaagaacaactttgagccactatatattttggggatgatctattatggcaattagcctgccgtcattaatttgatctataaaacatatatgaagtgtccctgtgatacacaactccagtggtcacacactgtaatgtatgcaactgggatttttctgaagcacaactgagaggctacaggtatgcatacatatggatataggtaaatgttcctcccaggagtggtaaaatgctgtggctttgccaactaactccagcttctctcatgggttttattgtggatgattattgatttgtgtaaaggaacttcccttttgtgtctgtggtaatagataaaggtggaatggatcctccaacaagaatcttgaggggaaaatatatacttatgatcaaaataagatatctttcttgggtttgtccaatagtgatggctacatagtcttcctattaccttttatctacaggcaggcagtaggccataatagtattagaagcccctccctttctccaaaaaaaaaaaaaaaaaagtgctctgagcagtaaagatatttaatttaacatatctgcgcttcatgtttctcatctgtaaaatgagagttggattatatcacttcaaaagtttccttttttcactaaacattctcccatctatgactacaatgtccagagctaatggtagaaatatatatatatatattttttttttttgagagggagtctccctctgtagccaggctggagtgcagtggtgcaatctcagctcactgcaacctccgccttcggagctcaagcgattctactgcctctgcctccctagtagcggggactacaggcacgcaccaccatgcccagctaattttttttttgtatttttatagagatagggttttaacatgttggtcaggatggtctaaatctcttgacctcgtgatctgcccgccttggcctcccaaagtgctgggattacaggcatgagccactgcgcccggccaaaataattttttttgttttctcttttattttgagacacagtttcgctctttttgcccaggctggagtgcactggcacgatcttggctcaccacaacctctgcctcctgggttcaagtgattctcctgcctcagcctccggggtagctgggattacaggcgccgcccccgccccgccccgccgccaccacccgctaattttgttatttttagtagagacggggtttctcagtgttgatcaggctggtctcaaactcctgacctcaggtgatccgcccacctcagcctcccaaagtgctgggattacaggtatgaacctccgcgaccagcctatttgaaataattcttaacatgagcatttcttcagatttcaagttgatattacagaagcgcaagtgcttcatagaaacttgaaattattttaaaaaaatgtttaactctcaccaaggcacaagagaggttatactcttctcccaaacaagctattaaattgaaaggattttaaacttacccaaggttttttagagtagttttattattattattttatttattcgtttttttgagatgaagtcttgctttgtcaccaaggctggaatgcagaggtgtgatcggctcactgcagccccgacttactgggctcaagttatcctcctgcctcagcctcctgagtagtaaggactacatgtgtgtgccacagtgcccggctagttagagtaattttaaaacactgtgtcacttctctgatttctatactttactccatgagtggagaaataatatcaaagctaatacagaatgtgatagttattgaaataatactataaaaagtcaaaaactagacagcagattttatagtttttcagtgaatttaccagttaaaaaccttaaattttacttttcctaattgtatgtttataatgtttcaatgtaataacaattcatataatagcacattcaggatcatggcaaaatcagctaagtcatagttaacacacactccttgtctctacgtatgtggtgctaagtcatatttttggtatagctaacaaatgattttttgtctgtctgctggtggggttttaatctcctggatttcaactttggttaaagttaaaaaatacactatccagactttatacaggcatgaattggctttaattcacattcttttgctgcaggagagctgcagaaatatggacctcactcagggatgatactgttttagaaaggagaagggacaggctgtataacattgtccagagtggagttttcatgttgcgagaaagccatgtataggccggagtacatgagtaaaaggaataacaactcccccatcccctgccacaaaggaacaagacaggagagccaacaatagtattttgactattagttgacgagtatggattctaaaaatatctttacataattgcagaaattgaggaacaatctaaatgtttaaaaatgagattgataaataaattttggtatatctatatgttggaaagctatgcagatgttaaaaacaggttttcaaaactattcagtaacatgaaaaaatggtcattataaactactgagtgacaaaaataagatataaaactatatgtagtaattagcaactatatattttaaatacaggaaggaaacatgaatgttaacattggtttttctctggctggtgggattacagatgacaatacttttgtggtttccaacatttctctagttaacacattctgtttacaattttaaacattactttcaaagaaaaaatgtgatatatgtaaatatggttatataaaatctgtatacatatgtattttatttatgtatatcaaaaccagaccaaaaatactgagtttgatagttttcagattgacactgtaacagaatactttccttgaccctcattttatgttgagatctttatggcagtgaaagggctagagagaggcatgtactttcagagtttctgaaatgacatgtatagtatgaaaaagcatagaagcattcctcaattttcacatcttgaattttaatacaacctgtaattttgtacatactaaatgaatgtattagttttccaagctacagcattggtggccagttagcagttaataataatatttttcaaaggataataaatgaaaatattgttggccaggtgcggtggctcacacctgtaatctcagcactttgggaaaccaacgcaggtggatcgcttgggtccaggagttcttgaccagcctggggcacacagcgagatcccggctctacaaaaaaaaactaaaaaaattagtggggcatggtggcatgcgcctgtaatccaagctactcaggaggttgaggtgggaggatcacttgagcctgggaggcggaggttgcagtgagccgagatcctgccacttcactccagcctgggcaacagagtgagataccatctcaggaaaaaaaaaaaaaaaagttgaatatactagagatccaaactatttggaggaataattgattttctgggcaaagctaagaaatagaagttattcatactattggctacaaatttgtaaatatattggattatactccctcccaaatcataactcttaatcctgcagttttattgcatttttctgggtatttagttttgtgatgcttttctgggagactaagttaagagacccaaactcagattttaaaattagttcattttttttttgttttacatttttctaattatttctatcaatgaaactgtggcatattacaaaatttcaagataaataattttctgtcatgtttcataggtcaagtaaaaaaaaggttctgcagctaaaataaggcttaagggggaaaagtggccagcagcacattcaaagtttatgagcacagacttggggaatcggatagatgtaggttcaaattcttatactgggggtaggcaagaaagatgcataaacagtgaattttaaagtttggagggattttagagatcatttaatcaaaatccattgttttgcaaaggaaactaacaccctggaaagttaaatatctcacctaaagtttcaatcccagcattgctactcatgttatctaggtttgcttacttcccaaattcagcactctttactttctactacaatatgctacatttgaggttggaggagaccagattatagaaagtactgaaaattagaccaaagagtttgaacttactttaaatctgtctgtcttcattattattattattatttggaggagtggtactgggcacaatggaatgataatgatcagagtcataaaagatgtatagagatcctatgtttcctgaaaattctgtatcatactcagtacaactttaaacattctaggggagaacccaactcatttctttgtcttatttaaataatactgagtaatggaactgactagattacagttgataactattttattttttcacttgcttttgtcattttattccatgaattaatggtatacatgtgagattaaactgatgctgagttgggaggcaacactgtttggttctgaagagcagacttttccttaaaagttaaaatattaagaataaaatcaaaacaaaaaccttgagtctaaatttgaatatgactctcaactttaaaaggtagtccacataaatttttctccttagatttatttttgatattaaaatatatacagaattaaaagagaaatttaattttttacagcaaaatttttaccagataatgaagcttaaaaatgctgaccttttagctcatttctaggaatttattctagtttaggaaaatagatttatgcataaaaaagctcatggcaatattatttgtaagtaaagaaaataaataaccacttacaaggaacattatgcagacactgaaacttttgaggagttttcaatttatgatacatttgaggaaacatttatgatacgttgtcatataaaaaggcagtgtacacaagcaatttaaacttcatcagcttaaacaactgcctggaaatatgtcaactctcaacagttgcctctaaataaaggaactattggttattttttcctggtgtcctttaaatttttttttctttattttaacctattttcacactttcttcacttaccatgtactacttctataatcagatacgtgtttgtatcctaatgatatgttttcagtatcatcacgagtataaacatatgtgtgtatgtgtatgtgtgtgtacattgttgaccaagagaaaagttgatattacttaaatccaaataatgaaatttccaaaaaaacgcatacatatcctacaacttataaaattataatggtttaatacaatgtactaagtattctgacatagcaggctttcagtatattagttgatgatgaagataattagagaagggatacctcaattaatttaccaagttccttgagtctgtcagcaactctcccaccaagaatttaacaatataatatgacattaaaaagctggtttgtgtggtgcatttttgcaaactattattttgtatttttatttttttttttgagacggagtctcattctgtcatccagactggagtgcagtgccgcgatctcggctcactgcaacctctgactctggggttcaagggactcttctgcctcagcctttcaagtagctgggattacaggcacacgccaccaagcctggctaattttttttgtatttttagtagagatggggtttcgctatgttgcccaggctggtcttgaactcctggcctcaagtgatcctcctgccttggcctcccaaaatgctgggattacaggtgtgagccactgtacctggccttaaatgctaagttttgacacacaaaaaagaaaaatttgtccttaccttgttcattttgatcagctatgtgaggttcaggtaagattttacgatcagtaaaaaaggtttcttgtggaagtaactggaaataagatttaccttgtagggtcattataagttttggagatcatgtatgtaaagtgcctagcatagtgcctggctcacaggcactcagtaaatggtggctattataatacataatattaatatgactccttttgttatatttctatacataaggtgatctgaaaaaaatatgaagtgtagtcccccatttaaaaacatgattctagggctggatgcagtggctcatccctataatcccagtactttgagaggccgaggtgggaggatcacttaagcccaggaggtcgaggctgcaaggaagtgtgattgtgccactgcactcctgcctgggcaatagagtgagaccttgtctcataaataaatagatagttaaataaataagtaaacaacacatttctagacttctagataaaatggggagtgaaagcagaccatagaatctctctgcacatatactttacaagaagtatacaacagtatactttgtatactggaaaaacaacaataagaactcctttaaaagcattactagaatcagctagaaaaagaaaatgtccacaacctaaggcaacagaggccaaaagaatgcaattatttcaaaataaatttggaacagcaagaaatgaaataagacatagctggaaaagtcaaattctcaccaagaaggaagactggcagtcccagaacattcccctaatgaattcattcttttcttcttcaacatgattatgtcccatgtcttctctcctaaatctcccacatctctatgctcctcacttcaaatcttgtttcattgataaatagaagttgttacaagagaaacttatcttcccatatcaaatctaccaatgtgcttttatctgtactcaaatatactttcttcctgttacaaagatcaactatccttgctattatctaaggcaagcccctctactgtgtcctaggtcccatcttctcttgcatattcaaacattttgttcctgtgattatcccctccatatcctgcatcctcagtttctccctcatcaccctacagtccatatccacatctgcttacaaagggaacagaaggccctttatatcaaagttcttcaaagactctataattgcaatcttcacttccttacattatctcttgaatccattccagtttggattattgtctccacagcaccacttaaagtgctcttgttgagattaccaactaccttattgacagatcattttcctcttctcaaatgtctgcgagtcccagacatattcctcatacccaccatcaacatttccctccaaggtcatgtcttcaatctcttggtgttaaatactgtctaccatcataggactcctaacatttatattctatccctgatccctctgtggagctctggactcacatacaactgcttgtccagcaactccgctcaaatgtctaaagagaacctcaaagttagcacatttaaaataaatctcttgattttcttctcctccacattttacttctccctaagtcttccctcatgtcaatatatggcataatttctagttactatgggcaaacatgtagaaatcgtccttaattcctctttatcccagttattaagctgttatctttcagcaataaacctttccataaacactgctttgtgatgctgggactgggactctgcaaactatatttttactttgccagctgaattcctgctatgtttcatcaatatagagtagtagaggaaaactagaagtcaagaagaagggaaaataacttgccctccctcataggccttctgtacctgtcagtgttgccccagctgtgggccttcaccctgacaatggtagttagctcaaaattgcaactatgtttggctctcctagaccagtcccaacagaccctctcaggagtaccagcagcagatgggcagcacttccttgtcggaggtcagagttccagctctgccaagtccctcctcctagctcctgggttctaagaacttgaggtctttctgtgtttacccagtaccaggggcagtagctgcttccccaagttactctgttatctcagtgctctcttttcgcttttttcagtcctgcaacacccatttaaccaatctcttatactcagtgattgctcttgaaatacttaacagcagccagagtggttcttctatggcataaaccatctgcctgctcctcatcacacttagaacaaacatcaaattctttcctagggtgtacagctcctttggtgatctggcctacccatttctctagtctcatctcccacctgcttcccgttactcgtttggctccaatcactctctcttgaacacactgcttttccacctcagggcctttgtatgtgctcttctcatacctggactgcccaggtctttgcctagctcactgccttacttcactcaggcctattctcaaatgtcctcttagagatgcctgccctaactactctatctaaaatgcacaatcctctctgtacccacccccaacccgccccaattccttacctccatttctttttcttatcactacaagtttatttcttcctcttccatcctcaactgaaatgtaagcttcataaaggcagggatgtgatcatatttatcactggtgcctggcatatatagtaggtactcaaattctagttaataaatgaatttaagaaattctagaaattaataaattgtaatgaatgtagtagaaaagtagaccaaagaaattgcaaagaagataatgtggaagtaagacaaagctgacataatataagctgatccatctccctgcatatataatgcaacaaatgaatcagaaaaggcacttaaagatgtaatagaggagaatttccacaaaataaacaagtctgcagaataaaatgttcaatgtaaaatggacgtatattcaacattgaggcatatgctcataaagaatgaagaaaaaacttttcaaatctcttggcagaaaactaaatcacttacaagagggaggaaatcaagctggccttagacttcctctaagcaatattcgaagccagaaaacaaaggaaaaatgtctgcacagttttaaggcaaagccagcatgacccaaaactattatatctaaataagtaccgttcacgaattaacgaaaaaggcaaatatagcatctatgagtccatgtaggggaaaaaaaacttcttagtaaagagcagatgactaagtgatgaatcaaaattaataaggaagatatagagaagcaaggcatgttgtaagctctggatttttaagtacagatcaagatgagataactaaagaaatgaaagttacaaaacaaataaaccttaaaacttgactttgtaaaaataataacataaccaataaatatatatttttcatagcagagtctgctggcatttctgaatttgaaacatacggattaaaaagtctctaaagccttaatttttaaaatcttgggtattttaggaactaagctctcttgtgatgacgaaacattttcaaaaattcagcagttccttccatttctcttccaccaaattagaataattttaaatttaatactttccaatttaaaagtactgtgatgttctcggctgggcgcggtgggtcatgcctgtaatcccagcactttgggaggccgaggtgggcagatcacgaggtcaggagattgagaccatcctggctaacacagcgaaaccccgtctctactaaaaatacaaaaaaaaaaaaaattagctgggcttggtgacgggcgcctgtagtcccagctacttgggagactgaggcaggagaatggtgtgaacccgggaagcagggagcttgcagtgagccgagactgcgccactgcactccagcttgggcaacagagcgagactcgtctcaaaaaaaaaaaaaaaaaaagtactgtgatgttctcatcttaaataaaatgatcttatctgtataaatgcatagaaatatatcctaaactgatattcatttattttgatggtaaaatctaggatctgaggagatttaaaaactttcctgtaactttctatattgtttgaattatttataaatgagcatgtatttttataaaatcaatagccattatccataaaatagcattatacacaacaatgtgaatatacttaacactactgaactgtacccttaaaaatggtgaagatggtaaatttatatttaccatttataacttttgccacaattaaaaataataaattttaaaaatactattgtaaaatttataaaatagctaatgcacaatagctttacagatgaatttacagattctaccaacatttgcccgaacaacttttccaccaaaatgtgaaacctcagattatacccttgcataatactctatatttgcctatacattattttagtaagcagagattattcactggcagatactgttataactatgccaaatgaaaagttacttatgaaaagtaactaataagttatgttactttattaactatccttgtgctgtaaagttgtaaatatgtcatttgatttaaatattcagaagaaaatcttttagctttaatgatttttttcctgattgttaaaataatatgtgctcattttagaaaatatacaaaggtaaaaatgaccataatcacagagtacattttggtgtactttttccacccttttcctatgcattttacatatatattatatatgcatttcctatgcatttttaaataaatgagaaagttttataaactaaaaatcttagtgtatattaaacattaatatttgtgtcattaagtatttttaatagatacatattttgttagattgatacaccatggtttattaaaccactctcccactgctgaatattcagattgtttcctctgtatagatactctagtgaatatgcataaatctgtgatttcatatctgattatctccttcaaattggttcctgttagtgcaactactgtgtcaaagaattggacatttttaagaccccagaaaggtaatagataagactgaaagttttttttttcttttttttttcttttgagaccaagtgttgctctgttgcccaggctgcagtgcagtggcacgatcttggctcactgcaacctccacctcccgggttcaagtgattctcctgcctcagcctcccgagtagctgggattacaggcacaggccaccctgcccggctaatttttatattttttttagtacagatggagtttcaccatgttggccaggctggtctcaaactcctgtcctcgtgatccgcccgccacggcctctcaaagtgctgggattacaggcgtgagccacctcgcccagacaagactgaaagttttattgcactcttagtggcactggttatcagcacttattttcaatctttgtcaatctgacgggggaggggtctctttctgtaatttaattaggcaaagttgaatttttactcacatattcataggaataactttactaccttaaggacttgtaattctttgtttttttacttaagaagattgcatttagttcttaatgtatttgtagacagagcattattactatttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgcattattactattagctagcaagatcatattttctttttttaagaccctaagctatgtgatcctggtatcatattttctgtattgaatttatttctccatgtgccagtttcactacactttccaaagtgctactaaatgcttagtttataaggttttaaaaaactcactgcataattactttaaaataatttcctcaaccctgccttcattcaaaatgtctggagacagactggcccacttccaattttctttcacgttatcattactgtgaagtcattctatagataggagagcattctggcatacagaaaaacagcatctgtgaaactatatggcacagtttggttggggttgttgctccttcagaaccgcattatgtaattttagtgtttacttaagctcctttgggctgcctccgtggtagctatgagctcacagagaagtaagtacagtttagatctgatagcaaagtctatcagtttatcctgaatgctgcatcctttttttgttgttgttgttaaatcattactgtatgagaaactttaaaaacaaaggtatagtttcttcattttattttttaaaaaagctacttcaaacatcattaagtaatacaccaaaaaataaagggttcataaatatatatttgctccttatctggacgtacttatttaaaaactcatattctacagtatgaacttacagtgtgattttgactcaacataaatataaatatgcaaaattaccaaaattagagggattagcctttaggaaagtacaaattattaaaatggcctaagcactatttctatttctaagtcatagaggaagcacatttaatatttcttaaaaaaaacaaaaaacaccaaagatgtataagttaatatcagcttagggagaattttacaagatactaggttataagaaaagattatttaaccttgattattcaatgaaaagtagtattttcagttttttagagcgataactcttgagtctctctaccaaacaaataattatatatgctggtttaaaataaaaataaatcagtctgcattataaaggtgggagaagtatccatttttttattgtaataatcaagtgttacgtcgccttcataggaaacatgcatactcttataaaatacttaaaagcctcaactgttcctttagaattactgattttgatgaataaacaagccccaataaagtcaatatcgtaacatctaaaagcatattgtcccttttgggaaatgtcattttgttttaattattattataaaattacttactggaatattctccatagcattttgctttttaattttgagaaggacattatgccattgattgccagcgatcctatgaggtccaaagttgggataactcatggagggcaaagaaaaaagttttcatcaccgtggaggtacagctactgtgaatgtcctacctagtttgggagagaagggtatgtgtgcacaggaggcctgacctggagggaatggacacagggagaagaaaggtgcaggaagattatgagacagactgcctactcaagttggctcaggattagctttgctggaacatttaaatgtttgggtttttatatttcattctaatataaaaaagagggtatttattaggtttcttatgtttaaacttttctaatgtacaaatgtactgtttataaatctatttatcagaagttacatgtggtgattttaaacatgttgcaaattgacactcctaccattaaaaggtggagtctaattcccctccccagaacacatatggccttagtaatttgcttttaacaaacggaagtgatggatatgatgctgcatggcttctaagactaggttataaaaaatgatacagttttaccaggtgtgatggctcacgcctgtaatccaaacactttgggaggccgaggcgggcggatcacaaggtcaggagatcgagaccatcctggctaacacggtgaaaccccctctctattaaaaatacaaaaatcagccaggcgtggtggcacgtgcttgtagtcccagctgctcaggatgctgaggcaggagaatcacttgaacctaggaggcataggttgcagtgaactgagatcgcgccactgcactccagcctgggtgacagagtgagactctgtgatacagtttccatctggctctcagtcttaggacctgtggaactagccaccctgttgtgaggcagccagaccacatggagaggccatgtgtaggtgttctggctgatagccccagccatcagtcagtattaaccactagacaagcaagtggacaagccttcagatgatgccagctccagcctttgagctgccccagctgtcatccagtggattagaaacaagttttctctactaggcaaggtaatgttgttttaagccactaaattttggggtggtttctgtacttaagtcactgcttccaataaatccctagtcaggttaactgtaacgggttaacctgttggaaggaaggaaatggaagaggcaaaggaaaaccctttccttccacgcttccttatttccttagccagactgtgagtttagcaccttctgctactaactgttggagattaagtgtgcttttgaagtgcaaaaaacaccatcatggggactcagtctatcccaacacctttccttgagggcttagagactgagcaggggaaagacaaagtttgatttcttccatttctccttttcttcttccttaggtatctctagtttcaaaaaaagggagaagcaagatttcatcctctcctatcttcactgtccttctaaattcaaatctccagaaagacaattatggtttctttttcactgaaagagaacacagctttttcagtcatataaagggaacaaagcagcaacatgtttctattatcaaggaagcaggattttattcatcagttatatgctacggacactgctctgtctttagtcactcatcacggttcttcaaagattccttctgctccccttcttcccctgaatatgggtgttcccagggttccctcctcagaccacttcttacagggcaccctttgtggtccatctaagcccctcccactgctttagctatcacctacattttaatgactccagagagccaaactacttcaacaccccctgctcccccagtagttctctgatacttcagattctacagggacaaaacagagttccttcccctagacttgaggcctacttctccttttagtccacaccctaaaccagaaatctgggtatctcttgctcttgccctttacagccaaccagttttcccattccaccaacagaattccaccaatttaattacttccttgaattcctcttttctctatccccactatccctaggtacacagcggtggtcctaattgattgttacttaggtcacaggctgttttacattccatcttcaagtctccaggacttcaaccagtgtacacctcaatatgacatttccaaaactcctttcatggctctccctttcctatgttttagtcctgaggcagaataggaatttactcataaagcaagtaacccccctaaaattgtatgcaaaattttagtataggtatgtaagcgcatttttttttcctagagaaagagcccattgctttttattttcctcaaaaggtatgtgtttcccccaaaacttgtaggtctcaggctaaagtccaaattcttcagcatgcagggtatatacaaagccctgcccgacctggcctcttgcctccctgcagctaacctggcaattgctctctcttaacatctacctcctggatttacaaactggggtggaggtgggaaaaaagaatcaaaatcataaagtgaagccaaaactgtttgtgtagcatttatacactgttgaagaatcaaaggcctttttttcatagtgcttttcgggagggagaaattggattgtaaacatgtaatttacaatctccacattttttattctagataaatgccacacacaccttcctgttacagaatattgcatagcaactttcaacatcattcagttttttaatacctatccacatatgatgttatgtattttacaaatcctgcaactaacaacgcagttcttgatagactgcgatctactgggaggactgctcggttttcacctgaattattgctcgtggttcacacactaacacccaaaaagacactctacgggtcatgacgtgtccctaaaatcctccatctactccagaaaacgttctaactttttgagacgaactgttgtaactagtctcctggcgaggcctgctatgtcttataccacaggctctaactgccaaatctttttcagaagtctttcagttgttgcctccaaacggagctctttgcagtcctcgggcggacgaatggacggattcgagcgaagcttatttcccttctcctaacgcatctacctataaatagcgctcaccgcgctgagtcaccaaaaccccgagtttccccaaatagcgcgtaacgactgctgggatcgcgtccctcggggctctgtgacagactccaaccacacacccgctgggctggactgcgggcccacacggcccagcgggtctctcaccacccggcgccccagggacgcgggcgaggccgcggtgtccggaccgagtcgacagcgtcggacttcccgcgcgcggacggcgctctggggaaggaggagccggcgggcggctggacctggccttgactgcgcggggtccgcccccgccccctcgggagcgcagagttgcggggggccggcaccagcctccgccctgcgccgcccgctcacacaatgggacgcgtcgggagggggcggccgcggctcccattccggtcccagggcggggactccgggcggcgggagaagcagtcgggctggggccagaaggaaaacccctctctccctctgcccactcaaactgcgaaagggctccagccggcggtgccaggggctggggagcagctggggagggagcggaagtgccaccccctgcagtcaagggtggtgacgtcacccctgcagccagcctgtagcgggggtgtctgtacatcacatgacccggcccccctctccccgccgaagcccgcgcgcgcgctctctcccccagccccgactcccacctctcccccgccccctctccccaactttcgccctccccgctccggcaccgctgtcaacagcgccagctccgccccctccccgcgccctgtggaaccgccacggcggcgcggcgggcgctcgcgctcaggtccgaggctccgagaagcgagcgtgccccggttccaccctgccccccagctcagtgcttgctggctgcgtgggcaccagagccagggggcacggcggcgtgcagcgacagcgcttctctgctccatcctcccacagcagttagaggacgaagctgaggcgccgggtccgagctcggagggagcgaggcgcatgcagcggcctccgggccctgacgcgtagcctccgggggtcggcccacgggcgagagaagcagccgggagcccctcctcgaccccagcaaggcggcccgcgcctccgctctccctaccgcccgggtggcgcacgccagtcctccgtctttggctgcggcgcaggcaccggccatacgacgaggggccaggcggggaccgcctccttgagccccctcggccacccctgccgtgtggactgctggggttgcagatttgctggctgttgctgcagcgcctcgttctatttttcctctcagttcccttctaaaagtggaggctcgggggaggaaaaagaaagcccacagtgttgaaaggggcggtacggactgacctgtcaacggcggaggaggaagacccccgttcggggcgagctctcgagcccgcgcagggatcggagctctgggctcgcgcggaaaggcacggcggcagctgtgcctcagccaggtgtcccccctcggcggggcccgcgccgccgcgcccgccccctcccccggcgcagcgctccccgccccatcgccggggaccagggaaccccccggctcgattttttgtgcagtttcagcaaagctccgaggaagttggtccttttgttccactatttatagattgcgtcaacattgcgaaaaggagaaggcggagcggtggcccctccccctcccctccccccgccggctcctgggagagaaaagccccagcacacgacctaagtacacagcgcgccagccgcccgcccgcggccttctgctccccgcttcttccccctcccagccggggcccgaacgctgccaaccccgtcacgtgcccgcccgggaaaaccagctccccggggctccgcgccgcccgccaggcttcgtggcggcggcggcggcagcggcctcacccagctcgtgggctcgggccgcggctcaggcgtcacgcatagcgtgggcacccacgccctcgccacccgacgaggatctcgggctccgcgacctgtgggagtgctgcggggcgtcccgcacttccgccctctctcgtctccggctccccagtcgccgccccgctcgccgagtgtgcgcgcattcgggcctcgcctcggagccgggaggctgtcctgtccccaggcccctcgcgcggccgctcttccaggcattgcggtgctagccccctctcccgcgcacgactggggagggcagaggtgtgagggatgcgggggtggctcgcagccgttcgcgggcaggcgggcggagcgcgggaagcgcggtgcgggcgttccatggcgcacccagacgctctccctcctccgcaggtgcagcggggcgttgcgcgagctcgagtcccccttcccggacagctagggagaagggagtttgcagaccggagctacagttggaagaatatagtttttgagaagttactggaagttagatgtgagacaaaaacagacgaactttccttcaaagccttatgacgaaatgataggccttgccatacccttgaaatgaaactgagctccctaccggcctaaagccgctgttcctgagcttcatgtaaacaaggagggcggtaaacaccagaggaaggccttacaacaataccaagtgcaagtagctcatttgagtgttatttatcttagcagcttccctgagtgatttatgtatattgcagtttaactttacagggtgggaataaaataatttggcttctcagctcactggcggaagaaactagagctgagctgggacgagggcaagaagcgcgtcgcacctttcctggcagctgaacagtgtgatgaacagtctggaagggttatgttattacttaaggggtttggggaaaccgttcccgcgcacagaccctcattcgggccaactgcaggccgtgggggactcttcaaggactcgcgcaacccgagccgagcttcctggctgggcactgggctcagccagtgctgagagcgctttcgctgggccagtcaagacagcaataagtttgcctctatttgggaaacctttccaggcttgcctgccctcttttaagagggagactaggtggtgggatcgtcagctgccaatgtgtgcactcgttctaaagaaggcgagaggaagtaaagcgaacctgtgcagtgtttgctgggcttccaaaacgcggagcttagtcgaccccccagcgaaccggacggcgctttggtcccctcacacctaacggtactcagagcctggtgcgggagctggcgcgctcgctcctggtttccttccaatttaggcaaaggccctggccgcccgtcttcctgcttctgctgtgccctgccacagcactcctaagacggcgaattcgtttctgcgccaattttgttttgaatatctacaaaccacttttccttgcatgaagaaaacaaggcagggccccctggcccgtcccacacctgcgagaggcagagatacagaggcctcgggcctcagccttcatttccccgccctagcttcgcgccaagctgcagtgtccccgacacactgtcaggacacgcgcttttcgcccctactttgttcttgcgcagtcttcccagctgcggagaggagggagcgaaagcaaaacgaaagcacccggggcgcatcagttgcaatagcttccctgagcgcggccgtgggaggccaagatctgaggtcgcgaggcgacggtgggggcccgagctgcgcagaaactgggtgggggcggtccctggagggcgcccgggagctgctagaagttgtccggagcccctcaacccccttggaaaagcgaacgcggatgttaatataccaactccgcagggaacttttggcccgggtcttgagctgaaattccagactgaatgggaccgtgctgaaagttcgacgaggcaaaggagtatggcgcgggggcaagctttgacccccggcttcgtatcctcgggagaggccgggactccggctcgcccagcgagggtgcgcagaggcctcctgggattctaggcccacagaatttttgctccagtgaagttggataagcactccgcctccccgcaaaaaccagagttctcggcttataaacacttcaataaactctggtgacattctccgcgctcgctccttgccctcgcggcagtcactgcagggacaaaggcggcctgcgcagacttggaagaggcgcggcccgcgtgggcggctttaccggccaaagacgttttcagttaaggggaggcatcttcagagctgagggtaactccccacagccaccccgcaggtagggcagccaaccccaatctggtcagcttaaaagtgtcctcggtttcgccccctttcccagcgaaccaacactggcagattggcctgcgagccgctcgctctgttgctctagcacatttatgtagccaaacggtcgaagagccccatctttaagcccaataaacacttaactttattctatttaataacacattttgttgtggcaatatttgtggattttggcaggtattaaaatctggtgatcctaaatgagtccaatgtggaaatgcagtattctctatgagtaaatagttctgtgcttcctctcactggcacctgacgcaaggcgcagccaaggactattacacctctggctgctcggacgcatcttcgcactgcgccccctcgctctttaaacctgggagacttgtaattgtgtacctgtttgcattgtttagcctatgcatcgcagattattcattttactaacaggactcaaaaacagctgtaattttcaaagatgcacgatggagttcgcttaggcgaacctcgggaaggcagtcttggtttcctgctaatgttttgccggtaacaggcagtagtcaatcccagactagctttgttggtttttattcctcccctctttaccacaacggcaaataccagaaagtcccaactgtaaaaagggcggcccactccgcccaaatttctctatacgatgctgagaggcgagctacaggtgaaatagactcctaggcacttctcttagaaaaagccttctatttcctctttgaaaatacttagcaaaagctgtttttgacttaacagactataaaaatgcctactttcaccatgctcgccctttggtttcatacgaagccacttttctcactttcttgcaagttctttttttcctttgtaatatatttttgtgaaacaggttcgattgggttatcttgctaaactgtccgtctaaaattatgaagttgatgttttctactctcctttgtttaaacaaaaaggacgcacacggatgtgaaagcccgtggttgcctttattctgcacgccacctttttttttttttctctgcgttcacaaatgatgctttgcctgggctaggttcagacttcagtacctaaaacgttatgcgtctgggcagtccccaagagctatcgaaaggccagccttgctcaccccattggaaccagcatcagaaacctcgatttagagtccaatttggaaacagatccgtgcctttctcggtgaaatgggaagttgcctaaacgatgcatctggctttagattttatggggaatatgatctggaaaagggaacgcctgtttcagctggggcaacacgccccgcgcgggtcccctggggcttctcctgcaaacaacgcgcgggatctcgacccgcagggcctcagtcgacctctgcgcgccaggcttggggttgaccccacaccagcgcgctcccttcctggcctcgcctggggtctctggcagtggctgacgaggctttttgaccaaaggagaaagtttgaggctgcagatcacatgtccttaaaggatctggggagagggagaggctctttgcaattggtgccaagaaactcgaacatcccgcgctcgccgcgaggcgaaaagaactatcctgggggagcacaagtgttcccgagactttgccaaagtttccagagtccggaggtagcttgcctcccacccccgcccaccactgggttatttcctaatcccctctaggctgcctcgggcgaggacccaggcggggcccggggtggcggagcagggagagtggtggggaagatggaccttccttgtggccggctccttcggcagtggaaacctctaaggggttaaaatggcgcggctggatgggcgtggggaatgttgccagtgttcggtcccgactcaggggagaaacggggtgggggtgtggggatcccggaaagggccggaaaagccgggagcaccgggaggtgtgaggccagagtttctgctactgggggctcttccagggaagacgctggcgggaataggatggggctggcagctggggagcctcgcggtggctattgcacgtctcggcccccctggacagggttatgtcaggagagcgccctggcaccgagctctggccgctggataagatactccctcgccggctccctccgtgagcggggctgggcgggtgcggaggggcgggcggtgcgcctcgccgagcccggggcgctgaggtcggcaagtcgtcttcggaactggcggcggcgcttctccagtcgacgtggaaaaaaaaatcgtctcaaatagcacccctcggtctgcagccctttaacactggtaaagtagataacaaggaactctgctgaacgagggaaactcagtttagaacgtcccagagtttccaagtttgtcaagcgactgggaatcttggtcgccgcgtggagagctgcgcccatttccccttccagaagaaaactgaaggcgtattcctccaaaggaaggctgcagtcaggcgccacacagaacacaggcagtcctctccggccgatctcgggctcgcctctcccagggccgtagggagcatcttttctgagcagccccgggagggcagctccgggcgctctccgcgctgggccctgccgcggccggtgcgttacatcaggaaacgcttggtccggttttctgtctgctagtcaaaacaattggctgaatctcgaaataacttttttgatagtccggaaaagaaacatgacaaatagactcaccatcaggcttgcgtcagagaaccattttccccagactatagtgagattgtttttttcattagttgcaggaactgatttttttatgatttacctacctgctgcagttgctgaatgtattcttctcccctccttttccccacttcatctggttgtcaactcctttccctccccgcccccatcccccatcccttttaaagctccgggtactggagtccatcgtatccagtttgtgtgtgtgtgtgtgtgtgtgtgtgtgtgtgtgtgtatcccgctagtctagcccagcgtttattaatggtcaatataagccacagtgtttgcatagccctcacaaaatgggtcatgttttcggttcctttgatctgcagcgacggaaaagttttgctttgcatattctcttttttgcacatcgagtttagtgacggtgctctcctcacaagttacaagttccctcccctttcaaacagttatagggatctatttttacagggacccaaagagttaggagaaatccagcatgtgctaaggctcaccttcactttttttttttccacacaaggattaacattaacgatgtaatgagttaaaacagactttaataccactaagcatggatttccccattaaccttggcaattatgtcacttcaaagaaggaagtatcaataacgaaattcttttgaattaaataaaattatggaaattgtccatctgaggtctgggcgcagaagaaggaggtttcggtattttaaagaagaactcttattggtggataattattaatatgaaatgaaatttgtaaagctagccctatcagggtacctatatatataggtgcttgatgagtatttagtctccctcacaccattttctaattcccatccttgaaaattttggcaggaaatacagacttcccagtggctaaaaaattatgctgaaacttctcttgtggttcaggtaacctccacttacttaaaaacacacacacacacacacacacacacacacacacaaaatttatccagggaactttaatagcttattaaaccttaatggaactatctaggcaaaataaaaataatggtgattacgtattctaaatccaaaacacattaaattaactcgaattttttgatggttccaataggtaactattaccacctgatttcgtttacgagtttccacagtaaaaacgaaatttgtcagcactcgtttgcttctagcatttctgctacagcaggcttcgccggcagactgatctttctagaccttgtctctttcagagcgccaattttatattgaggctattcagttctccacttttaagagagacgggtgcacttttttttcctttaaaaatcaaatgagaaaatggagaaagagtttgtagcactcacgggtggagaaaacccatctgcctgatccttttgtcccggtgcggagtcgctggagaggagagtctcctggagccgcttcgcggatcccactgggtcacctggtcctggcttattttctttgaggcccattctcggggagtaaatagacagtagcgagtttcctggcaactttgcactactctttaaatagaagagaattcctccagtttgcctccccttataggctttcccgcctcaaattgttttaaatgctcctcacagtctttttgccccttctcccaatgacaaggcaagtctcagcgggtgaccttggtgtgtgccgcagggttcaggctcttggagcccagctgccctgctgagagagcgggaggatagtcgcacctaattagtacgcggctccggcggagatgagtgcgtgggcactgtgcgtgcatcttgcacatgacacccaagttcaaagcgccctgcttatgaaaacttggggcatcaatatcgtctcatcactcaggcgcccttagcgaatctggacagatcgaggggcgcagtcttggcttccggaccaggactttctttttttgagatctatttagctagtttagaaaaatacaccttatgcgaacatatacagctattttctcgccctccactccagtggtctgcaagcccctggtgctagtgtgaatattcctgagtcctgagcgggttcccgcccgtgcagagccaagaacactgagcggaggtcactgtaagttcagagccgtgcatcctggttagaattgggagaaaaaattctaagcccgcccggagctgctcagaaaagatgggtctcggtccagcgcccccttaaagtcctcagtgcgcgaaagtcttggattactgtgctttgcgcaaattggacgccacgcctgaagggcccgcggaatcaatcgcttgccttctgtggggtcctggcatcagcgtgaccaggacatgctattattattggaaaccgagtcttgaagtggacccccagcctccacccaagccctgcggccagggaataattctaagggctctcccctttggatgtctagggtcggggcggtctcggctccctggatcctctggtgtcccggcaccgaggggcgctcggcagcggggcagaggggacggcctcgcgaccccgccaggggcacgaaggaacggcggccgagggaagtccacgcgggctctggcgcagcagcgaagctggaggcgtttgctccgctctgcccggagcaaggggcgcgcaggggaaaccgcttctagagcttcgcggggaagggatcaggggcggagggaattctgtattctagttgtggatctttcgggtctctgtcagttaacagaagcctttggggtgtgggtccgggacgccgctcggagccgtaaaaccttgcctgacccggcgctcccagccactgcggtgcagccgccttcgccttctgggtgcgggacacaatctggcccaaggtcgttcaaatcggggccggcctacccctcagagagagcctccgcccatggtccagtggcagggaagcctcaggctacggcctagatggagcattcacaagggcgtttccaggccccagtggcctctgagcaggggttaactgaggttcaggtttcttctgaaaacctgaactgaggttcaggttcacaaaaagaattacacaagtttcccaactctacaatctgttaactcaaggccgattaccttctcagaatcctctaagtatttttgcctgtaaagtgaatttggactttcttcttctcttcctcacacagctggtcacagacaaaaggtgggttacaggcctggaaaagattcatcccctgctcacacatgtgcctctttcttgggacgttgtgtgttctccacactcctgggccggtcaggaggggtcttgtgctctgctagggaggtgggcttccctgtaggaagagtgtggagggaaaggcctagctggcccacttggtagggagggtcccacgtggcctgcagaaaggcatgaaaatgaccaggagacaggacctgggccgatatgtgtgaagggtggggatctggaggcattgggaaaactctctcccagtgaaaaagaggcccaagaagttctgctgcctgttctaagaagacaggatgctcagtctcaaggtgggacaaggccagagttccttgcgaccaaactgggatcggaaatctgtattttcctggctaaacttcttgtattttaagcttctttctcatttgctttccgtttactctttagtcaagtgtttctgaaaatcttgccaaaaggaagtcattcagttaacagatatttattgagagaccactgcatgtcaggcacaggaataggacggtgaagaagacagttcttgtccttacagcttacaatccaatttttatcttaagagaataaaagcaattaaaggatgccatgaaaaagatacctgggtagatccaaggtgaagggagcatggctatttggggctacttacaagaacttcagtatccttgaaacttagagggcagaggacctgctgggggagcagagagacagcttgaggagaggagcctgggccctgagagggggacccggggtgaatagttcatcatggggctttcatggtgcacagcaggtgaagccgagggctgtgttagatccgatgccccctaggtttccttctggtgtgaagatttgaaggattcacttttatcaagggagctgatgtttccttgccaggcaccacatatatccctgtgctattacacatgattaatactgcagactttaaaataacaatatgcaactaaaaagtactttcaagagaactcatctagcagaacgttttgtaagaatattgtagttagagaattgtgttggagattaaatcatacatagtgaacaagacactgtccagtcctcacaatttaccatccagtggaagatacagagaaatatatatgagacattcgaattcactggagaatagagagcaggctttatgctctcaggaagttgggttatagggttggggcatttagttcaaggtagcttggggaggtcccatgaagaaatctgggagatgattcatagaagaacggcttttgtgtattgactgagcccttattcttatatggcattcaaaatcctcctgcaaacacagtatttctggggctcagaattgccctgaattaataactgtgctagaaagacaaaagaaagttcttgcaactgatgagacttaaaaaagtcccctctggaaatgttaaggccttcacaatatttctagggctcaggattgtcaaaggctactaactctgccagagagacaaaagaaagatcttgcaactaactagactaaaaaaagtgctagtttgatgttacagtgattaattatgaaaatactcaggcatgatgcttttaattgaatccttttgtagcattattggtaggggcaggagggaacagcaattccttgaatgcctgctgttccataggcccttgacatatattgtctcttttaatgctcatgacaactccatcaagtcggtatttttatttccattttttagattagaaaaatgaggttcagtgaggttatgcaaggccacttggggagtaagtggcagacccatctgacttcaagcctgtgttctcttcccttttctcatggagtgccttcccaacccagagggtgatgagtctaaaaaggaatcatattaagagaattcacatttgcaaattttaaattcctataaaaaaataggcttggatgaacttataatatctctataaattatattttagggttgccaatataaaaaattaaggagatcaaaataaacatcaagaatgctttatacaaattaaattaacagaatgcaattaatgtctctttaccgttgcttgctagaaaattttcagaataaagagatgcttatccattagttttgctttattacacagagaaacacatgcgtgtctagccttacacttaagtggaaattcccttaggtcactttccctgggttgtgactaaaggcagctgtcattatcatgtaggccatgtgaggtttgtgactggagaagggattatggtcatgttataatgttataagttgataaaattttataggtacaagtaaaagctttttacttaaaacgaaaatcctaggattacatcaatcaatcaattcagcaaatatctgttgaacatcttctgcctgccaaggaccgtgctgtgtgctgaggatataacgttgatcaagacaaactgagtccttgctactggagacagccgatcaggaaggaaggaaaacaagacttgcttggcttctgccgtgtgccaaacactctcctagattcatttaatccttcagatgagcctgctgtctgtccctgtatatgcagaacatgcgcagaaaaaaagtgagcctcagaaaaattaaatagcttgttcaaggtcatacagcttgtaaatgacagagctccaattcaaacccagcaataaagacaaagttcttttcactatgctacactacatccttgactatgaaaatactaaaaattgtgagtacttgttagtcattttatccctccttggcttgtttcctcaattaaaacagctgggtgactattcttatactattcacctcatagaacactcttaaaacccaaagcactgtaaaaaagtttttttacagtgctttttaattgtttagcttaatttaattttataggagaaaaagcatatgaaccctaataacaggtgtgtcataataatctattggtagaaaaaaaatcctagttcgataggattagattttgacaaattattattgttgcttttcttttattaatttaacaccaaacatttattggaaatagtagaattatgccaagcctatagatacagagatttctgagcctgtagatacagagatacaggataagggcaaattccttatccaacaaggacctccaagtctagtgggtgagagacatacctatttaggtaaattataaaaatgtgctgtaacagatgcccaaggtctctgttgcacagactggagtgcggtggtgctatcatggctcactgcagcctcaacctcctgggctcaatcgatcgtcccatctcagcctctcaagtagctgggaccacaggtatgcgctaccatgccaggctaatattttgattttctgtagagacggggtctccctgtgttgcccaggctagtctcaaactcctaggctcaagcagcctcccagagtgctgggattataggtgtgagctactgtgcctggccccaactcttcattttaaagttttccaatagttcttgtaaagtctgcttacacaggcattggggaaagagagctagaccacttgattaaagtgaggtggcctagagaaaaacagctttacagcctctgacaatgttgacaaggatgtggttatattctactagcatagattaaggattcaaacagatttagataattcagtgtgccatggatgggaaaggttgatgggaagtcttcaaagtagatataggcaacataaattataaaacattatatggcggggggcattttggctaatagttttacccctgagttcatttaaaactgtcagtggatgccactcatttctagggcatctagtcgatccaataagagtacagcaaagacaggagttcaagaccagcctggacaacatggcaaaaccacaaaaatacaacaaatacaacaaaaaatacaacaattagctgggtgcagtagcacgtggctatagtctcagctattctggggctgagatgggaggatcacttgagcctgagaggtcaaggcttcagtgagctgagatagcaccactgccctccagcctgggcaacagagtgagaccctgtctcaaaaaaacaaaaagtacagtaaaaagttctgaacatattttttctaagcaaaggaatgttttattcaaatgaaactttaacaaaaatctagtatataaagaactgcagtagctgaagaagatggatgaggaggagggacgccctgacaaccaccagaacagccatgcattcagtagactgaggggcctggcatcaagtcttgccttctgtgtattccaggtctggaaataggcagccacatctgaggtgcacagtaagtatatgatgactgactgaataaatgaatgaaatgccatcattttgcctctaaatgtaattgaggaacacaaagccgctaacattttcattagtgaaaaccaaggtaatgaatccatttaatagctcattttcatcaccagattcttctggccactcacggtccttacttgccttctttgaacatgagcttatgaagcatttggtttttacagtccaatttcctctaggactgtttccatttgacataatcaggaaaagtacccacctgagttcaggaaacttggtgaaattcaggctgcattttagggggtgagtggtgggataggaccaagagggaaaaagaaaacaattttcttgtaaggatcacacacggctaattttaaaaataaaattattcatctaattatataaataatgtattgtcattgtagaaagtttggaaaatacaggaaaacctaacgaaggaaataaaatttactttccctgccatcacccagagataatgctgtcattgatgtctatccctccgttcatgtctttatgaagcaggataacatatataacatccaaatatgttttaacttgcttttatgactacataatatatgcaaatattttatgttgttaaatattgttctagaacatgatttttaaatttctgtatcatcaccgatggaagaatgtaccacattttgtctaacaaatttcttttatttattatttatttatttattttttaaattttttattttattttattttattattattacactttaagttttacggcacatgttcttattgttgaaagtttgacttatttcccctcttttttctattatgaatagtgctacattgagtatcctgtagtctgagtgtgtgtctgtttagtatttatggcatgctacttatttttttatttttatttttaattgttgtgggtacatacacagtaggcgtatctatttatggggtacaatggcatgctacttttttttttttagacagggtctcactctgttgcccagtctggggtgcagtggagtgtgatcacagctcactgcagcctcaacctcctgggctcaggtgatcttctcacctcagtctccagagtagctgagaccacaggcatgcgccaccacacactgctatttttgcattttttgtagagatgggggtctcaccatgttgcccaggctggtctcaaactcctgggctcaagtgatctgcccgccttagcctcccaaagtgctggattacaggtgtgagccattgtgcctggacggcatgctactttttaaggcttttgatgcacatgggcaaattctagaatggctgtactgaagtagacattgtggacaatgcatttgggttcttgtttcacacaccagagcttcacttttcatctgcaacggcattctgaccatttttaatgagcattagttatttgacactgagcataccactttcctaactttgagaagaaagagaggtattaaagtcttgggtgtggctgtttttcagaatttacaattaaaaatctatctcaatattttgctgtctttaaaaagcagtgaagtctgaggaaggatattagtggattcagtggctgctgttcataatgcctgcaggacattttgagtgtttccttcctgagttcagagcctcatcctcgcatctcaatgagacattaccctagaacctctaccaccatgactaccagcacttctgaattgaaactgtctttggctgtcaatttgctttggggaccttttctagaagttaaattcatttttgtggaggctaaaactagtcactcgatcacatttgtgatatgagtcatgttagaataaagatctagaagagtggtagatcctatctaacttgcacaatagtagaaagtgaggtacaaacaatatttctcctagtccctctgagttcaatctggatttgagatttacttttcatgatctgacacaaagtatgtgtgtgtatgtgtattttgaaaaatttggacaggagtcccatatgatgttgaattaatcaaatataaatacacacacacacacacacacacagacacacacaaacacagagacacacactttattccattagggaaagtatgctttcttttttttctttgctcacaaaactgagaaattggcagaatattttacttgtaacttggcagtattgcaatttacagacgagaaaggcaagccaaattgggtgaaaattgtttgagattttttttcccagttttagacagtgaaaatcatgtagctgagcgtgcacattcagccgttttctgcttgatttttaaccgcgtttgttcattggcactgccagagctagttacaacttcccggtgcaagcatgtgatggccaggggaaggtgtggggattcgtggctgtcctccccatgctgttaatgttaaaataactgttgtttgaattgttttgagatactgattagagaaatatgaaatgtgatattatttgagcttcataaatccatcttaattatcaatatataaacacagacttaggagtgggagatccagatcagacatgtttacaggcctgagctttttccgtgagtttctggaacattgtggtgcctgagacacagcgggaatccgacgactctgagaacggactttcccttttaaatgctggaggctttgaaatcgtcttcacaatgagggaggattcatgaagtaatgaaaagctgtttcctctttaaaacgttcagacagcagcacaaacatctgggaatttgtttgaatatttgggttccctgaattacccatttccttaacatacattttacttacttttccaagggagatacatttccacctcatgtttttcccagtttagctgtgttaggctcttcactttagcatttaggttgctttgtatttaaggacacaggttaaggccgtattatgaaaggtatgatttgggtttgggggagcaggatgttgttatgcgtgaggggcaaagtgatttttgtgtgtgatacaagtttcaattacatcatggtgtcatccttataaattaaatttaaaaacagttgtgccaaaaaaatagccactaatgtttcttttaaaaaatgattaagcaacaatatttactcaatatttgaattaagcaaaactgtcatcttctttctccttttcagaacataattcctctttcaacttcagaagtcatgagacttccctttctttctccattctcttcctcacactgcagtgtctcaaagggtgaaaatgtctgtgtgtgggagagggtggtggtggtagggcagtggtcagaacattctggaatccaggataagaaaaaccagcttgatttctgcacttaggacattgttgatgtttatttagggatgtgctatctggattgatggaaaaatttggaaatacttaaatatttcggtatgtaatatcggatgatgagacagtgcagcactgatagcttcctggttgtcagtgtggctctgtatctctgttttacttgtcatatttgtactaagacaggtgtggttttaaacggtcagtattgaactatttttgactaattagatgcgttacgtgtgacttgccagtttataattagttaacatatgataaaaaatatgagatatattgattggtataactatactaaatataatttaatctagttgacttttttaataggcattttaggataccacaattactgctgtgaacttcaatgggttatgaatgacaattgttactctggagcatcaggcatgtagaaagtatagggattgggcttaatacaaatttagtggcataacctggcagtcgcctatttgattataattctgctgttattctgaatgctgttcatctgcccttatctcatacaagtaggttgcagaacatatttttaaaaatctggccgggcacagtggctcatgtctgtaatcctagcaccaattccgaggttggaggttggcccgaggtcaggagttcaagaccagcctgggcaacatagttagaccctatctctacaaaaacttaaaaaaaaatgaggttgggtgtggtggctcacgcctgtaactccagcactttgggaggttgaggcgggcggatcacaaggtcaggagatcaagagcatcttggctaacatggtgaaacccagtctctactaaaaatacaaaaaattagccgggtgtggtggtgggcgcccataattctagctgctggggaggctgaggcaggagaatggcgtgaacccaggaggcggagcttgcagtgagccgagattgcctcactgcactccagcctgggcgacagagtaagactccatctcaaaaacaaaacaaaacaaaacaaaacaaaacaaaacaaaacaaaacaacaaaaaagagctgggcgtggtggtgcacacctgtaggcccagctactcaggaggctgagatgggaggatcactagagcccaagagttggaggctgcaatgagctatgattgtgccactgtactccagcctggatgacagagtgagaccctgtctctctaaaataaataaataaataaataaaaatctggctatatgagctggcaagtttgtttatttactttaaaagttaaacagcagttaattgtgatttgtggatcacttcttccccattgatttaatctctgcttgcttaaataaattaaggtactgtatattctggattatacttcctccgcctcaaatttaggaatattgtgaagtgagactatgatacttgactgtggaaagggatatatttgtaccccattaccaagttttcttcttggtgtctttctctagttcagatggaactatcatttatatctaggtctgatgaaataaaactgagggagaggggcttccaggtccccatttcttaaaacgtcatgttgcctgacatgaatgaatgcatagccacactcttgttctctgaatctgtcagtcaattatgtgcatagttcgcaactaggacgggatgtcctgtgaagaaaagataggcattaagcccctgtaagtatgaggattgcttgcgacatgtcccaagcaattgtagttcatcgctgagatcaagaatgacatgtttggctgggctcggtggctcacacctgtaatcccagcactttggaagggtgaggagggcagatcacctgaggtctggagttcaagaccagtctggccaacatggtgaaaccccatctctactaaaaatacaaaaattagccacacgtggtggctcactcctgtaatcccagctactcaggaggctgaggcaggagaatcatttgaacccgggaggcaaaggttgcagtgaaccgagattgcgccattgcactccagcctgggtgacagagtgactccgtctcaaaaaaaaaaaaagaaaacatgtttggctttgtggtacaaagcaaagttttcattagcaaaggtgaaagtgcccaatatcctgttatatcaaactcgattgattaatgagagggatgaaggttatggatgtttttgtttgttttggagggtgtgtatgtgtgtaggggatgtttaatgtgagtcaggcagtgtgagaatagtttctggggtctggtcccattgagaacaacctgattctggtaatctttgaatatcatttaacacattacgtggctcttaataaatgggtctgcttcatagttacaatagaaattgacccctctgccatgtggtcccctccttccctccatttggccttttatccttggatttgggtcacaacctttggggaagggtggaaacaaagcagaactggcaattatcccagtgatctggattctaattaattaaggcctactttttttctccttttttggagaattgtgcctgtaggcattttgtgggaaggatgcctttcttattgaataactatacctcaagcttttttttttttttttttttggacccaggaagggatataaaaaataattagttatgaggggcaccactgaaagtagaagatttacactcaagccaggaatttatttgcatatcaaataaaggacagagtcatgcatgatgtctcagaatctctagttatcctaatcagtaaagaaaatgaaaccagatgtgttcatttcagctttgaattgtgttactattagaataaaaattaagttcccttaagtatccttttaggtcaaatctaatcatttctctagatataattctcagaaaagccagtggcattttgatagtggaacctggtattttgctggacttaacagttctctgtgaagctacatacaaattttatccattgaccattatgctgtacatttcttaaagtgctatttttgttgtggtttcagtgattctcatccgaaacatagctgcatcatgtcatggaaaaacactggactgggagttagaatcattctcctctcagctcttccattaaatgaaaagatttgtgcttttggaaaatcactttaactctttggacttcagttttgttggcctgctacataaggtctctaccatcattgaacagtttaggtctttattagaacatgcacaacatagtgagctaaattgcaaactcatctgtaaaaatttgacatcttaagcttcagagtaaccctgcttagtatttaaaagcaaatgtcaatgtcagaaggttgaagtcctaacagtattagaaaagcaaatgccatcaacttattgaacctacagtttttaaaaatttgtgtcttaataatatttaatgtttttatccgttatactggtaatccatgttcactgagaaagtttataaaactcaaaaaaaatcgatcttaatctcaccactcagaactaactagcaatattttgatgtttccattccttttggttctctgtatttctcttatattctatgccatgtatgatttatttttacaaagttggaatcatagtttttctatcatttgtttgtttgttttttgtttgttttctttttgtttttttttagagggagtctcactgcaatgcccaggctggagtgcaatgatgtgatctcggctcactgcaacctctgcttcccaagttcaaacgattctcctgcctcagcctcctgagtagctgggattacaggagcgtggcaccatggctggctaatttttgtatttttagtagagatggggtttcaccatattggctaggctggtctgaaactcctgacctcaagtgatttgtctgcttcagcctcccaaagtgctcagattacaggcgtgagccaccgcgcccggctgtttctgtttttttcacttggggaaacattgtgagttgcttcccatgtctttattccaaaagatggtttttaaaggcttttaatttttgtttttgaattacatatacttatatataattataattatatatatgtagttttattttatgaagcagaaaattaaactttctctctccctgcattctgccaacccactctctctttctcagtcacattccctgtagggaagtccatttatagtttgaggtatattcttaaggtccgtaatagatgtaagtatatacatgtaatagatgtaagtatatacgtgtaataggtgtaagttcataaatgtaatagatgtaagtatttaaatatgtatgtatggccatatgtgagagttttttacttaaatcaggccattccattcacactactctgcactctgtgatctttcatgctgcattactgggagtgaggaggtattttctagttaatatctactgccctagctagttcacagtaatggctccacagtgattcccactatggatgtctgtttttttttttttttttcttgatggagtctagctctattgcccaggctggagtgcagtggtgtgatcttggctcgctgcaacctctgcctcatgggttcaagcgattctcctgcctcagcctcctgagcagctgggattacaggtgcatgccaccatgcccggctaatttttttgtattttttagtagagatggggtttcaccacattggccaggcttgtcttgaactcctgacctcatgaaccacctgcttcagcctcccaaagtgttgggattacagacatgagccaccgcacccgaccggatgtctgtttttatttaatcaatcacctattgctggacattgtggttggttgaagttattttattttgttttaaaaagggttgcataatatcttgtatccaaatctttgggtgcatctttgattatttccctaggatgaagtcctgagtccactgggacgtacgtgtggcttttgatattgccagtttccctacagaaaggtcatcctgttttacattcctgtaaaatgtgtatgagaggcccttctctgaccttttcccactctgaactagtcaaaacttaaggcacatttttcatcattattgtaccagtttttatctcaatttgagtccaggacattcctttcagagtatggggaaaaaggtcatccagattctctggtgccttgatcatctttgacttttctaatgagactttgtaaagaatcctgggaagttataagttccactatacggtatttctatttttatttgtcatgatgaactcatagattaataatttattccttttcttaaatttagaaactagctgacttagatttcctctcttattaaaatataaagtcctttgggaatggtaacatattatcgaacgttgtgatttgtattccaggaactagagtctgttttgattgagcgtctaaaaatccttgttagggagggaggagaaaagtgcccaagatcagtgggtagggcccctggtcctagggaaagagtcattgttgatttaccaccattagtaataagccattcattaaatccatgaagacaaatcatgtgttacattttagttgtaagtttcttgatctttagattttgtgactctgaagatacacttcagttattgctatgctttttttttaaggaaagaaagttcacaaataggcaatgttttgatatatggccaataccattttaatatagcactccactgtgggggttcagtttatgacaatggaatacagccataactagtcacaaaggaaccgagatcatgatataatggggaacaggtacaaccctaatgcaggatgcttgcattagattcttggccctgtgcaattagtatcctgaattactctaggcaggtaacttaggtcatgacaatacatgctttatatacttctaataaatagcactgtaaccaagcagttcaaagtgggctcctaacactccatgacatcttcattagatcagatgatcacaatacaactggataaaaagatcaccttgtcactgcattcagtttgtgctgtacagataggccttttattcctctgtcttaatttttccatctacagaaaaatattggtgccaatataacatgagattcagaaactgactttttgtcttcatttactcagcaaatgcttatttgaacatggctatgtcgactatgtgccaggtcctgtgctatccacttcagtttacagtggtgggagtcagaggagtcaggccagaagacacataaaaggagcccactctacatctggcacccctggattctacattgcaatgtaaatgtccctgtcaagaccttcactacctcctgctctgcagcaggaggtaagagcccatctgtgcaatttgctgtccgactttctttcagtacctggaggttggaaggggggaaaaaagcaaactttgggtatcaaaaatatccctctccttatcaatcttgatttctgaatttcattatggtgttaataccattcgtcatttattatacagatggcaacaatttgtttttgataagcaactcagtgcctttcaatcagtggctaagaccaactcgttgaacacaatgggatggttaattaaagacacattttaaatacacacacaactcacagatgtatgcagggacatgcatacaactgttaaggcagcctgctttggtcctgaagaatataatttgatttacagttgagaaatacaaactaaactctgtttggggaaaaattatgccctaaaaaaatgactggggtagaaatactgtatttgagaaatgagaactttaaaacactccactttgtctttgttaaaatgggcgtaatagaagtagaattttgccaagatgtttaaccttattgaggccacaaagtaggaaaggtttcatttttaattttgcaaaacccaactttctttcttcctctttatttccttgttttcctcccatctccctccctccttccttcccaccttcctttcttctttccttctgtcttttcttctatctttccttccttttttctttctctgtactctcctgtcataatcaagagtaaaaagtttaactttatgcatctgaatacatttattcatggattcttatttaataaaaatagaaaaaaaaacactcgtaaagaaaactcttggtgagttacaaatggcacgcttcctttggggcgcaggaactcagggtgctcttaaacaccttgacattttcaggactttctgccacctgggatttagatcaaaactgcagtgcgtgtcagaccatctcagaacaaggaatgtttgtctcagacattattatgccctatctcttgatgaaagactgggatagagtcaaatcatgtgtcttggtgtttgtttaatatttgtgttccgcatttattagctgatgagttactggagatttgcattcttctgagtcagccagtatgacctattttattgcagtctaaagttgtactgaagggtgccttggaaaacatgttctccaaatgttggtcaagactgacattcacagaatttaaagctggatgtaatgttatccaatgacagcttcggaaatatgatgactctgcaagaaatcaggggaaattcagaatggctgttaagaccactcctaagactatcttgactatgtgaattctttctccagttttttctgtgtcatcccagcttgccatctctagctcctgcttcacaggcctcgaactacctctccagtccacttcagtgccttaacagctcagatttcacttccagtagtctagggcttttacataaattagagcaagaagagaatacagtggggagaacaaaactgattaaaaggttggaaaaataagacttatgaagaaaggttaaaggagctaggattattcagcttggaaaagagaaactagtgggtggcttaataaaagttttcaagtatatgaaaggttattatatggagactggcgaccagctgttctcctgccgctgagaagagaacaaaaggaaattatctttaacttctgcagcggggagctagcttggaaataaaggatttcccagtggtgaggtttgttaaacattagaatgcattaccatggcatctctttttctggagatctttggaaataagacagggactggtgtggaagggatggtttagataggtggaggcttgcctaagttactggagaatcaaccagatgacctgtggaagctctttgctggtcctttgagtctacaccaagccaactggacctcagccagaaaagatatggagaagagccaggctagttcatgcctttgactgtttcagcagaggcagagccagtgttcaccttgtcacaggcttagttttcttgatatctaattgttatttggtggtaagtagtgattggagcagggatgggaaggaggttaaaaaattcaaccagctaaaacatacataagatctccctcaaagaatatttcagtgagtaagggtgaggcctatgaaatatgaagtgcccttgtaatttttttttaagacttcaaacgtttttcctcaacactataccttctatgtgttcatgtaaactgctcctttaagcttttgagatatagaagtgtatgtgtgtctctaaaaaatggaagaagtgttccatttagttcttattaataaatggataaggattatgggattttggactcagatggaatgttggagagatcatttagtttaacacagtggatgagtttttctggacttctaggcttaataatcccaaaattatattgccatgacataaatatagtattatacttaccacaagaatttaagtataatataatcatgttaacaaaaacatctcagtgcatttattatttttgtcaaacaatatgttagtaaaatatttttcaaagaattgaactctgttttttaaatttagttcattatttagacataacctaaaagatgttgacaatacattcctttttttttttagattgaagcgttttttaaattgtggtaaaaaattccacaatattaaatttactatcttaacttttcttttttttttttaaattgaaacagggtctcactctgttgcccaggctagagtgtagtggtacgaacatggctcactgcagccttgacctcctggggtcaagtgatcctccttccaccacagcctcctgagtagctgggactgcaggcacatgcccccaggcctggcgaattttttaattttttgtacaaatggggtctctccatgttgccaaggctgatcttgaactcctggtctcaagcgatcctcctgccttggcctccaaaactgctgggattacaggcatgagccactgtgcctgcccattttaaccatttacaatgtatatttcactagtgttaagtatattcatattgttgtgcagcagatctctagacctttttcaatacgcaaaacagaaactatatccactaaacaccgattccctctctcctccctgccagcccttaggaactccctttctactttctgtttgtatgattttaactactttatatacttcatttgagtggaataatacaatatttgtcctttgagactggcttgctttgctttgcgtaatatctttgtggattatatggtagttctatttttaatctttttgagggaactccatacagtttttcataatgactgcaccattttacattcccaccaacagtgcacaaagattccaatttctccccatcctcactaatacttgttattttctgttcttttgatagtgaccatcttaatgagtgtgaagtgatatcttattgtggttttgatttgcatttctcttatgattagtgatgctgagtatcttttcctgtgcttgttggtcatttgtgtatcttttttggagaaatgtctattcaagtcttttgtacatttttaaatcaggtgttttttttgttgttgttgtaaaaacacaagtttcttagatattctggatattaaccccttatcagatatatgatttgtgaattctcccattccataggttatcttttcatcttttggttgttccctttgaatgcacagaagttataaataatttactaagctttaagtattgaaatttgaatcgaggttaaaaattttcttgattacttcaaacatattatttcaataaaaccacaaaaggtattgattcagtatgaatcactgattatgaacacacacacacacacacacacacacacacacaagcaaacataaaccttttattcctgaacagttataagaaaagattatactacttcagttgttatcctagagatttttctttcaactatttaagaagtttgagattagactgttttaaacttctgataccattctacaaaaatgtgattaaagaaaatgaaagtaacttttactgtgcagcgtcagaataatgaacatggtgtattctttctcttttaatcatttcatttaatgcttcattcacaaagattcttaaagaagcaaccacagtgaggacgtgctttggcaggcaaggagaggacttgcactctgtctcccactccactgtctaactttgaactattaatgtaaatcccagaaacctgaactgttaccatttccttgcccaataggggtaaccagacctattctcactaacttggtgaatgtccgaaaaatacataggtcagtctgatatttttgggacttcctaaattttctttgcttttgcaagacactcagatctatacagcctaatttgtttttacgaacactagcagagtacttcaggttggagtttttgcctaaagaatataacaaatggggagtaagttggagaaaccagagggagcctggtgcttctggcacaggtaacacagttaactgaagtcttttggcttcactaacaatggccacctgaagcttggccaaccctctgtatatgccctttctctaatcagaaaggtcatatgccacggaagatttttctcagtttttaaaaatcccctggctggttatcctgattccttaaaacagttttttgaaagtaacaaaagtagaatgtttgatgcattttatgagtccatggtaaagttagatacatgtgcatatgaacacgtgttcttaagactcctgtgtagtcaagagagctgagtgttcagaactcaaagttggcctaataaaagacaccagactatagtacttgctttgtttgttccgtttgactgaaccaaatgtcttcaagtttcgttttcaatttttatcgtaaaaaccgtgaaaagcaaggtgtttgcttactgctgggatttgattccatcttaaagacctggagcagaagtttatatggatttcagaaagcagctgttttatgtgcatacatagtacaaggtagaaaaatgtaatgtaacccagtaagattaaataacagcataacaaaaacttaaaaaattcaaagttgaatatgtagtacacctctcacagtggaagtcctggcttttaagaaattgctgcaagcatttaacatgagaaatctgtgaatgttcattcctagcagaaaaaagatcggatatgattgtaggtttctgtgttgttgctcatattgagccagctattcatgtattcagattcatgggagaatttctagcatgagttctgtctggtatatcactctgtgttatggtttctctatctacctttacaatgcacatcctgttgattctacttattatggcagaataaggaaatatatgtgcattacgatagtgctattgatatgcacttgatactctggctaagataaacataaatcaggtaaagccaagtgtattttagcctttaaactgggatatgcattccccacctgctcagactgaaaactgtcttgtaggattaagaggatggggagggtgcatggaaaattattttttaaaggaagaggaataatatgtagagttaggaacattatagactgttaaaggaccaatgtttcaatgcaaatgacctccaagttatataaaagccctgtgtatgatatgtttattgttattagtttttagcctttgcagtcttcggagactttgctggcctggatttcgagtttagtagagtacattcagctgcattgtgcatttcagctctatggaaccgttgtgcttcgtccctgtttacctcatcctgtgggcaagcatctgcttttgcgtcttacttcttagaactgcagctggatttctggaattctgtggctgtgtggtattttctcctgcatattaataagattaaattgaccaaaaggtttcttttttccttcaaaaattttcctaatatttttagagtatgaagattatatagctttattgtaaaaatattcaagcagtattgaaaaatataaagatcaataataacaacagtcccagagataaccactagtagtataacatattggtgatcatccttacagatgactctcataaagatcaatactaacaacaacaatcctagagataaccatgggtaatataacatattggtggtcatctttacagatgattctcaatgcatatatattcacatataaatatatataagtaaatatatacatactcttacaaaatgaaaaaatacaatacaaacttttgtaaccttttccatactaatcactatagatctacatcattattttaatggatgcattatatatattgtatatagaatactatctggcactcagtaggccctcaaccaatggttgaatgaatgagcaataatttatttaaccaatcttctattagtggacataatttattttctgtttttcactattataaatcacatggcaattaatatgtttttgcatcttctttgttcacatgtacaattatctgtttaaggaaaccttaaaagttgggtcaaaaggtggaaacatttaacaatttgatagtgataaacttgctgagttggctgagtttatgctcaagtcatacaaatttacattatcatcagcaatacacaaaggtgtttgtttccgcacattcccctgcatgcctacattgctgtcagtcttttagagtttgccatcctgatagaaaaattgctgtactggttttccttgcattatttacattacaagcaaggctgagcatctctttgtatatttattggccattaggtatttcttttatgcattgtctgttctttgtccagtggttttgtcttgaaacaccagagacctattttatcttaatgaagtcatttacttttataattctatcatatgcccccaaacagggaaagatgcatcttttaggtgggtatactgataagtgaacttgtgtggacccgtagttctcatttgtcagaggtagcaacgtagggaatttgaatatttttacctctaggtcggtgtctttttttttttgtttggagatgaagtctcactctgtcacccaggcaggagtgcagtggtacgatctcagctcactgcaacctccacctcccaggtccaagcgattctcctgcctcagcctcccgagtagctgggataacaggcatgcgccaccacacctggctaattttttttttttttttttttgtatttttagtagagacagaatttcaccatgttggcaaggctggtctcgaaatcctgacctcaggtaatctgcctgcctcaacctccctaattgctgggattacaggcatgagccaccgtgcccagacccagtgtctttttgtgtgaggaccactactaaagttttaagagatttcttaaaaaggcaatcgtcattctgaggcaaagattaccaacatctggattccaaaaagtggggaaaaatcagttattcatatatattaaaatgacacacttcatttccaactaccaagtacaatgttcacctttattctgtttgttttcgctttgtcgtgctactgaaatatgtgtgcatgtgtatttaaccaaagagaaactcactcctaaccccatatttagtggtgggaccatcccttatttagtgaggctgttttttttccccccagacccgagttgttgttgcccatgctgctgaattcccaatatgaataaatcataatcatatgattatactaaatcagaggtttcagtacccttccacaaagtgacaataaaatgctcattaaaaaaaagagtaggttgtgttcaatggtgttaatttaaaattttaatgctcaggccaaaatgccagaaagtgaacctcagtttcttggtaataataaggtgaactggcttccagcagagagattttgtggcttctgtatcctgccgctgcacttctcccttctccagcctcctttctatttggtggtgcagaatcaccttggtcagccctttgaccttgcctggaaaaaagtcctcatcagtgagtgagtgtgaggttagagtgataaagattctaaaggaatgccttgttttgattcaaatagttggattagtcacagagttacttaatccacacacatagtagaatcctccagcaagcttctttgttttcatcagagcttttgagagattattatattatatctctatcttttaaagatagagtagaaatccatctatgaagaatagttttaggtgcattcctgcctgaacacacatttggacagtcttataattatgtatcttcccgagatgcattttgagccatttctacccagaacttaaaaaaatatttcctatgagtgctggaggttcttgcttctcttaacccactaactttttgaagccataagaatatcttattaaggattatgcaaaataacgtcctacaaatcctgatattattacactgcccaaaaaacttcaaagcatcaggaaagtgttgtgtttttttttttttttttttttttttaactaaaccagattcagctggctaccccacttggctacagagtactaaagaagagactgaacttgatcctgctgcccttgcatacacaacactcccattgacgctagtgaagacttaagcgcatgaaaggattccaggatcaaaaggttagctctatggggagctgtgtctggctcaagcaatccatttttttctattgacagtgaaaacgttttatagttctttttcaaagttttcccaaacttttacaataacaggcaacttgtgaaaaagtgagaaggcatctaattgaactatatccagaggagatcatggcagagaccaacaggaagaaaaacatttccaaaccacagcgatattggtcaaatcaattgtatttgaagaataaagcatttgaggcgtcggctgagaaaaattttcattatgaaacttggttggactatgaagcagaatgtgagataaaataaaacacagagctcatgagtttttatctttgtctgctaatgacttatgctagcaggattatactttttttttgcattttatgagatgtatgaactaggaagaaaatacatgctatatctaaatggattagacgtgcagattcttaactaacatttaattcattgctagtaaaacaaatgccttaaaacatttaaaaaagtgaaattatcttaaggagataattaacaagcagagtagaatagcatttttgaagaaagtgtaatatggttctacactggcattttctgcatttattgaagatacttagtctatccaacaattcactcattcattctttcatgaaaccctgtctctactaaaaatacaaaaaaaaattagctgggcacgggggtaggcccttgtagtcccagctactcgggaggctgaggcaggagaatggcgtgaacccgggaggcagagcttgtagtgaaccaagatcgcgtcactgcactccagcctaggtgacagagcgagactccgtctcaaaacaacaacaacaacaacaacaacaacaacaacaacaacaaatttctttgtgcacttactatatgcccaatgctaatctaatagttttacaagacctcaattgaacaagtgtctgaggaaatggattgcatctaataaagcaagacacaccaactgtggatgggtggtgtgtctagagtattttgcattcctaaatcactcttctggagaaaatttgtatcaataattttgtctagcttcacctggagttacacattttgattggtaagtggcttctgtgatttgcctcttagaaatacattataatgttatcctaatatatgtactaggacagacaatgctacgttgaactaacttgaatagcatattttataatcataaaactgatataatattatagttttgatcttaatcctcctctattgtatgagcaatggaaagtcttggtgaggagcttgtctaaacatttctcttgcattttcacataattgggcttgacagtttcctgccattgtataggataacttcagttgatggtgatcatgtttttgcttaagggtcattgaattgtattagaaattttataccatattcttgtaatcctataagtcatttttgagttacattattgaaagtgaacaataatgtaccacaaaacaaaagttactcatgcagttaaagcttttttttgtacctaggtttagaaactacaagtccacagagaatagggctcgtgaaataaatgaaaatacacgctcatctccacccactccttgttgttggggcctggtcagatctggtgaaaacattaagccatttgccttaagtggtattggcaagttaatttattcaccttctggaaggtaccaggctagtgcttgcagaggcaagattttttttgggtgaagggagcaaacttttccacttaacatgtgcccatggaaatcaggtacttcttttttcagctaccttagcttctgttgggaatttgagggtgttttatgggttatgttcttatacggtggttaagtaggcttgctgaaatggatctagaaaagacccaggtcagtcactggttgaaaaagggttgacagaaaattaaggagatatgactgagagcagtttctctttcaggtccccaaatttctcctctagccaattcacattaaggtctgaaatttcccccattggtgtcattccggccattgtttccagaagggactttcaaaaatgcaaatatgttcctgtggagcatttgcacatttggtgagtttgtcagcctaaatgagcagttatctttggaactaagaaagaagggtcttaacagagaaccaggttggaggaagaaagatcctgagaacattcatgggaggtaggccaggggaagacatacagcatgaaactttggcagtttagaaacaagggggataactcttgttaagagagcttaagggtcacagaagacaaatataggtcatttcacagcctaatttggagtttgatcttcacagtagctctttatgggagatcagaaggccttagctcaggtatggggaaaagacttcctgtgaagtctttattctgcttgatcaaggctgcttgagggtgtcaaggggttcaagagaagttctgaggccaagttcaaactcaagggaaataattctctcatttcatgatttgtgccatggatccatgaaggagtggtcatcacgacctcagactctgctgcatttttggagggtttagtaagtcggcaatggcagtgacagctcagtccagttctcacagtgtgagaagaacttgggacatccagctaatggatctacaagagttccaggtggccctgaagaacttcagcacttctccttgcatatttgtattaacctggaaaattgcttcttgaagagaaaaggaagtgatatttttagaacaggatcagtatttccagcacatttattaatgggctagctcctcagtgtttacatggcaacaggataaactattattagtactgctcacatcatgaggtatcaggatgttttttggcgtggtagaccatctattcagatgaggaagtagagtgcatccatttatgaatttattgttgacatttcaactgtaattctttctcagtttcttccctaatgtcaggatacaaattttcatatccttgagagaggattttttgggaggggcaataaagacaaattttaaaattgaaaataaataaactggcaatcccataaagctcttgatcatatttagaccagtgagtgtttcctgaatgtttttgatgtttctgatcctgtgctgagcactgtgggggatgcaaatgaaagaaataatacatggtttctaccctcaaggaacttataatttattaagacacataaggcacttgaaccagttaaataatgagaaaagacagtatatgacacataaatgctttagaagtttagaaaaaggaaggaacagcagggttatttaaagagctaaaattcctgtagcttgcttctcttactttattggtggatgactccaaaactctgtaagaaggggaatagggagaatggaaggagtcttacccatctcttacttccttatgcaatgttgttcatgtacagtcagtgtctacggaaacttgaggactgatgggaaaattattttcagaaatggaggtgaatgaaaacagtcatggtggaatattttccaaccataactcttgccttctgttcatccatccgctcagagagccaagtgtacgtatgtagtcttctagctactaaattccattcctagatagtcataggtcttccaaggcccaaaggcttaccttgatttctgtttttttggataagtcccagtcaaatggctgccacagaagacagaaagtcatatatagattctccctttcctcctcattgcttcttcccttctctcacccccatgccccattccttatctttttactgatttctctctccgccctcctcctagtcatacatctacttttttctagtattcctagtttttttttttttcctcacagttgttcatggctctttgcacaccactgtctaagtctgaagaagtaaaaagagaatgaaataagtgttgccaagcaagacccttctcttctttccatgtttggaaaacaacctcttggaatacagctcttgaaatgtattgaattatctttgtgttttgtacacagcccagtgtacaaaactgggattgagggattgaattatcattgtgttttgtacacagcccggagtgctcaagacattccaaaaaggttaaatgacagcagtagcagtcacccctcttatgcaagacattctgggcttcatccaagataggtggagcattgctgtatcactctcatgcattcatttgctcatttattctctaaataaagagataagcagaggccagattccgttaggccttccagaccataatgaagaatttggttttgattctaagaactgtgggaggccaggggactgacatggtctgatttgtgtttttaaaagctatctctggctgcagtatgagaatggatgatagaggtcaaggtcaggagcaggagatcagttagagaagctattgcagaattccaggctacagataatggtggcttagactaggatggttgaagtggaaatgaagagaagtggaccaattcttgccaaaacatatatctgtaagccgaaccctatttcttatattagtgttgccttcatttaaggctgggggctggctccagcattttgatgcttgggttagtgtgctagaagctggcctggaagcctagaagtctggccccattggaccaccttactgggtcagatgtaatcctggcccactagccactcatgcctcttgcagggtcatgaagctgcttaaaatgtttgttcggtaacttaattactgtttcacctacattccattggcttaaattcttttcttttctttttttttttttaaataaaagagatgctggaagcgatggtttaatacattttaaagttcttttcccacctatttcctactctgtttgcattgtcatttgggatatttcatgcaagcaatctgttgaaatgagaattttaatgttgcgggcataatgttgctagtattgctttgaaaacaccacatcagctgtcaccaacactggacacggcagagtttatttcacagatatttgctaagggctgggtgtgcggaaaaaaaaaaaaaaggtatggcctctgcttccaaggagcttgagaggaagggaaagtaatacaaattcttgaacatcttttaactgctagccttttacatccacgactcattcagctgttgcaatacctctgaggtgagtgttactcttatccttaggatgaggaaaggggcccagccatctgtctcaaatcatactgctgtcgtgtacaagccgtgagctaaacccaaagtccatggccttcccaccttatgctgtaggtacacttcaaaagctgtcatgtcttctgtttgaataccacccctgccccttcacagctgcaagatcttgggaaaaatgtcttcatctctgtgagcctcagtttccttatctttaaaatatagataatagtatttacctcaaaagggtatgcatgaagcatatatgaaagttcttggcacatagtagccaggaactaaatattgttagtttccttttttggtgaaccagtgtatggcaagagaatttgtgatgtgattttggtgtagagtcttaagcaagcatggcaagtattttttgtttgttttcaacttcacagatgttagaaaagcttgtgttgtacatttatgtttagacattaggagagagattctttcttgggttgcaagattgtaggatttgtttgcagagtatctgtatctggacagagaggcattctcaagctcctggcccatcctacccaattcaggtagcaacaggaggggaaagaggcagttgtttgtataaggcatgtaaatgaaggctgaaaatcctgtagggtcaattcgtgtgtcctttggagctgaaattaatggatattttcctttgaagggtcgactctccaggctatatccaatacaatacagggacctcacactgtctttttgtgagggatcatatttgttttttcaggccttgatgaaaaccaatttgcctttcctgaaactagacatttaagctttgatgagctgacaaaggggggatgggcagacaacaataaccttgcagtctattttaggctcttaaaaataatatatgggacaatagtattgctagcttctccacaaagtgcccctttataagcatgtgtacaagataggaaactaccaacatgaggggaaaaaaggccaaaaggctgatcttaattattgaactgtgctgtgttggtttcttttagagtggattgtggaggtcacatttgtaggagattctcagttggtttactgtagtttgttaaaattattgagacataggtgatttcaactcttttttttttttttttttttgagacagagttacactctttcacccaggctggagtgaagtggcgtgatttcagctcactgcaacctctgtcccctgggttcaagcaattctactgcctcagcctcccaagtagctaggattataggtgcctgccaccatacctggctaatttttgtattgttggtagagacgggttttcgctatgttggccaggctggtcttgaactcctaacctcaggtgatccacctgcctcggcctcccaaagtgctaggattacaggtgtgagccaccgcgtctggccaattttaaccctttaacatttacttttactctttaagaacgacatttactctttaagaagaacttttcttcccttacacagtgtctgctttgaaccgagtctttgatatatagagaccctattagacccatcaaatgtcctctcagcccttggattatttctcttccaactctgttttcctataatatgatctactacataccagcagccagtctcgggcaatataacgaaggctagcagtatgttcacatggtcatgtgtatttctaaattttgcaaaaccaagatgtgttaagtgctgtcactgaagatcactttctttttccattctgacttcctcaccgtcatcattcgcctcctgtcagatagtatctgagtgatgggcacgttttggatctggctagaggaagttgaattggggatacatgtattttagtgtgatattttaatgtagtttgcagtccctttcatagtcatctgggtgaggaatggcttgtaggaatattcttaccacccattggacagctcaccagcatggatggggagcaaaggtgaaggccataggtcctaaggctaggagccagtcctatggcactcatcctagaaatatggggtagtggagaaaaatgaggctggaaacaaggtttgagaagctcaaatgtaggaaattcttacctctgtagacataaaattgtgagcagaagaattgatgccagccaaatatattctctcctgtttggaatatatgcagtgatactgagtatacaattataaactcactatgtgtgtgtatttgtgtgtgtatatacatacttttaattttcttttttgttgagaatagtgtggaattgattttgtcagaatccctatgtttgtagggcacgagcctgaaggcatggagcaagaatgtctgtgtgagaagacacatgatttctgcctcctattctggatctcatatatgtatcttattgcatctgttgcatcttgtcctgagacagcctgatggttccagaggaaagtgtgcaaaattgccactaaagcaagagacatgctctgagaaacaagcattccatgacaaactgtcacacattttcatcaataagtcacggtatatagtataagaggaattcaatgaatttctcttatgtagcttagtgcagtgtaggaacgtttgaattgttctcgtatatgccttaatttcaggttaattgtgtatttttttttcagaattactgttcatatcaaaattcagatatgatttgggtaatgggttcattagaagcccaaaccccagcatcacacaatatacccaagtaacaaacctgtacatgtacctcctgaatctataaaaaaacaaaaatagctgggcacggtggctcacagctgtaatctcagcactttgggtagccgaagcaggtggataacctgaggtcaggagtttgagaccagactggtcaacatggtgaaacgctgtctctactaaaaatacaaaaattagctgggtgtggtggtgggcgcctgtaataccagctacttgggaggctgaggtaggagatttgcttgaacttgggaggcggaggttgcagtgagccaagattgcgccactgcactccagcctgggtgacagagtgagaccctgtctcagaaaaaaaaaaaaaaaaaagataaaaagaaaacaaaacagatatgacaggaaggacatattcctgttgaaagccatagtgtaacaatcactacaaagagaataaaatacctaggaatccaacttacaaggtatgtgaaggacctcgtcaaggagaactacaaaccgctgctcaacgaaataaaagaggacacaaacaaatggaagaacattccatgctcatgggtaggaagaatcagtatcatgaaaatggccatactgcccaaagtaatttatagattcaatgccatccccatcaagctaccaatgactttcttcacagaattggaaaaactactttaaagttcatatggaaccaaaaaagagcccgcatagccaagacaatcctaagcaaaaagaacaaagctggaggcatcatgctacctgacttcaaactatactgcaagcctacagtaaccaaaacagcatggtactggtaccaaaacagagtatagaccaatggaacagaacagaggcctcagaaataataccacacatctacaaccatctgatctttgataaacctgacaaaaacaagaaatggggaaaggattccctatttaataaatggtgctgggaaaactggctagccatatgtagaaagctgaaactggatcccttccttacaccttatatgaaaattaactcaagatggattaaagacttaaatgtaagacctaaaatcataaaaaccctagaagaaaacctaggcaataccattcaggacataggcatgggcaaagacttcatgactaaaacaccaaaagcaatggcaacaaaagccaaaatagacaaatgggatctaattaaactaaagagcttctgcacagcaaaagaaactaccatcagagtgaacaggcaacttacagattgggagaaaatttttgcaatctacccatctgacaaagggctaatatccagaatctacaaagaatttaaacaaatttacaagaaaaaaacaaacaaccccatcaaaaagtgggcaaaggttatgaacagacacttctcaaaagaagacatttatgcagccaacagacatatgaaaaaatgctcatcatcactggtcatcagagaaatgcaaatcaaaaccacaatgagataccatctcatgccaattacaatggcgatcattaaaaagtcaggaaacaacagatgctggagaggttgtggagaaataggaacgtttttacactgttggtgggggtgtaaactagttcaaccattatggatgacagtgtggcatttcctcaaggatctagaactagaaataccatttgacccagcaatcccattactgggtatatacccaaaggattataaatcatgctgctataaagacacatgcacacgtttgtttaatgtggcactattcacaatagcaaagacttggaaccaacccaaatgtccatcaatgatagactggattaagaaaatgtggcacatatacaccatggaatactatgcagccgtaaaaaggatgagttcatgtcctttatagggacatggatgaagctggaaaccatcattctcagcaaactatcacaaagacagaaaaccaaacactgcatgttctcactcataggtgggaactgaacaatgagaacacttggacacagggtggggaacaacacacattggggcctgttagggggtggggggctgggggagagatagcattaggagaaatacctaatgtcaatgatgagttgatgggtgtggcaaaccaccatggcacatgtatacctatgtaacaaacctgcacattgtgcacatgtatcctagaacttaaagtataataataaaaaaagaaaaaagaaagaaagagatagaggaaacaaaaaggatgccataagtataagttgaaagaaaatatttgtggtatttgccagctttaaaaaagtttgtaagttgtgtgatttctgtactcattctcaataaatgttcattatttgtatctaattttatgtattttttcttaaagagggacacaaaatttgcatatgctttaggtttcataaagcctggacttgccctgtttcataccaatgttgtggacatattcatagcagtctgacagtacctgtgagatgaggaagcaacatgctgtagtggaagaagcagccttgattctaccactaggagctgtgtaacttcagcttgtttcttagcctctgtgaattttggtgtcctcagctgtcaagtttggatgttgatccatcacagaattgttgagacttaaaggaaccctcagtgtacttcttggcatgtgataaacactcaataaatataatttccttttttcacttgagctctctctgatggtttacagatttatcttaggtcagggacccaggtgaggaaatgcgttgtcctttcaaaatgaattttgatctgagggtagtaggtagagagttggggtttcccctgggattcttgtctttaataaacccgagacaaaatgaatcacaatggtgttttctctagatgtaaaacaaagtatgcagtgccttcatcagctgtgtagagtattgggctgaaagtattccaatttagtgtgtctgccactacacacacacacacacacacacacactcatttggtatgacccaaggattacattattctgaatcactgcagttttttgacatggcttcattcttcaatcaaaaatattgatgaacaaagccctgggccaggtgctggattcccttgaaatgtaggagtctgggaactaggatttggcattcacgggtgtcctaatgagcctggagcagcacattctttccaatatgtgtgctttggctatatgtaccagcgatagcctctatgaggtggggatgggacgggaaccccaggttagctaaatactgacttgctgtcagggtatgatttagtcatcatagcagactgggttaatacctatgatactggactatgaactcttttctttaaggacaagacacaagactacttttttcagtgcccgccatggctagtacatagtaggtgtttgtagcatttattgaattgatttacagtctacattcagtaggagtaaaaaaagccttttaaagtgcccaaaggattttcctttttgaaacaaaattgcagctttttgctgggcgcggtggctcacagctgtaatcccagcagtttgggaggccgaggcggatggatcacctgaagtcaagagttcgagaccagcctggccaacatggtgaaaccccgtctctactaaaaatacaaaaattagccacacgtggtggcaggcacctgtaatcccagctacttgggaggctgaggcaggagaattgcttgaacccaggaggcagaagttgcagtgagccgagattgcgccactgtactccagcctgggtgacagagtgagacatcatctcaaaaaaaaaaaaaaaaaaaagagaaagaaaaaagaaaaagaaaattgcagcttttgatgaatagcctgataattatgtcccttagcctgctgttgtggaggaataggagtcattttgaaatggggaatcagaagcagtctgtttcacactttgctcacaagtgattcctctgagtgaaagaagtcaaaccaaagcaagtccagggaagtctgagaagttagcatacttgcaaagacaaaacagccacaagtcaactgtcagctgagtgagtgcctgtctggacgttatcctgcaggcagttaggaagaaacattgtttgaagacgcctgtcaccagcacacatgactgatttctcatcagaagagggattgtgagtgaaataagaaaaagtctgtgtaatatgtgtcatgatgagttatacatttacctattaactgtatacaaaacctttatgcatatagattatccatattttatttgggggccatctggttaatttgcctgctttctaaactattgagtcaaataagctcactcaggtattgtcagaatgaacccacctaatctggttaacattttggtgtctgggcaaggtctacccaggatcaaatctgttgacacccttctctccaaccccagccctgtccctacctacacacacgctttgtttaaaaatactcattggtgcttactctgtgtcaggtgtcaggtagtgtgctagcactgaggatgcatagtcctttccctctttttttttttctttgggacagtgtcttactctgtcacccaagctggagtgcagtggtgtgatcgtggctcactgcagccttatccttgacctcctgggctcagctgatcttcccacctcagtacctcctgagtaactgggactacagctgtgcactaccaccgggctaatttttcagttttatgtttttgtagacttggggtcttactatgttgcctaggctgatcttgaactcctggactcaagcaatcctcctccctcagcctcccaaactgctgggattacagttgtgagccactgtacccggcctcatcatatccctcttgaagcttgcagtgtaggacaggtgaacccagcagccacatctcttatttgggtattgcgggagacctggcatagtcagcatccagcagtgtttccagagtggctggccttgctgcttctcctcacttgctcctcaagggcaagatgatatgcaggttaccactgaagcaaatgtcccatccattgtcttctggtccgcttaaaccttgatctagtaattaattatatgaaagaacagaaaaagtttcagagaatgataatctgttttaaaattttcttattcatttttaatagttgtgtttttggggtacatatgatttttgatatgtgtatacaatgtgtaatgatcaaatcagggtaattggggtatctgtcacctcaaacatttattttttctttgtgttgggaacattgcaattcttctcttctagttattttgaaatatacaataaattatcattaactataatttccctactgtagtatcaaatactagaacttattccttataatgataatctctttaatagtcatatttaaatgccaatttacaaatggagtaaaatatttaacagaattgaattgataattttgaggcctttgttaataactactcttaattgcagcaattttgttttggacagagattatgggaataaattttaattctggttggaaaatagtactgaaacagcacttgtcttattctttcaaatttttagtacttgggtatttggagtcattgagatttactctttgtatatgcaggaacattagttgtttcagactggacaatggctggttataagtagttgaataaaatccctgcagttcatccattcttctcctaccagcaggtgtcattatggaaatatgaaaatactgtaaattccagagttgtaggaactagctgtgagaaagaaaagtaacactttggatattaaaaaacaacaaaaaatgaaaaaatcatttggcactaagcaaggatggcatgtttaattactgatttggcagtgttctacagtatgatgtaataggattttaaagcacataatttattttaattagattaagtaaatatttataagaaccattctaggctcataggagtcacaaaagaaaagtaagatgtgattcttatcctcgaggagccgacatgatatctgaggatacattaatgaaataattagttcatagaatgaatcaatctttcttttttacatgctggattgaagaacatagacagtaaaagttgcaaaagctggagggactgagtagtgtttttgattgtgggttaatcaaagaaaaagttttaaaaattcaagtagggaggaacttcaaaataatttggtaacttgatagctcattccttcctttcttgctaactgcctatctctcgctataatctaaagtaataattataataattacatattacatatgtatccaaggatgtaacaattggatttaacagtttactataatcggccgggcgcggtggctcatgcctataatcccagcactttgggaggccgaggcgggcagatcacgaggtgaagagatggagaccatcctggccaacatggtgaaaccccatctctactaaaaatacaaaaattagctgggggtggtgatgcgtgcctgcagtcccagctactcgggaggctgaggcaggagaatcgcttgaacccgggaggcggaggttgcagtgagccgagatcgcgccactgcactccagcctgggagacagagtgagactccatctcaaaacaaaagaaaatgaaaaaacaaaacaaaaaaatggttttctataatcaagcgactaatatgatcaaatctttctaaaaactaaggtaaacattataagtgagcatttgtattaggagacttttccaggaacctggatcaggttctaagtgtgctcggtcagggtcagtgcttcattcaccctgttttcccctctagactgtgaggttttctaaggcatgggatatgtggcattcctctttgcattcctggcactcttaattctgcctctggatctgtagtgagctcttagtacatgtttgttgaatgacagtatcaccaaaggatagggtatttacagtcctttgtacattatattgttagaatgaatgcatattgatactagactaggcaacctcaggttgaatatttcagaaaactggattgagaaacctggcttgaaaagttgatagcataggcagccgcccccttctgcgctgtcacgccgagccagcgcctgggcctggaaccgggccgcagccccccggcttcgcccaccatctccctaccatggacccccgcaaagtgaacgagcttcgggcctttgtgaaaatgtgtaagaaggatccaagcattctgcacacccaggaaatgcgcttcctgagggagtgggtggagagcatgggaggtactgctactcagaaagctaaatcagaagaaaataccaaggaagaaaaacctgatagtaaggtggaggaagacttaaaggcagacgaaccatcaagtgaggaaagtgatctagaaattgataaagaaggtgtgattgaaccagacactgatgctcctcaagaaatgggagatgaaaatgcggagataacagaggaggtgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgcagccatccgagactgtgacagagccattgaaataaatcctgattcagctcagccttacaagaggcgggggaaagcacacagacttctaggccactgggaagaagcagcccatgatcttgcccttgcctgtaaattcgattatgatgaagatgctagtgcaatgctgaaagaagttcaacctagggcacagaaaattgcagaacatcagagaaagtatgagcgaaaacgtgaagagtgagagatcaaagaaagaatagaacgagttaagaaggctcgaaaagagcatgagagagcccagagggaggaagaagccagatgacagtcaggagctcagtatggctcttttccaggtggctttcctgggggaatgcctggtaattttcctggaggaatggctggaatgggagggggcatacctggaatggccggaatgcctggactcaatgaaattcttagtgatccagaggttcttgcagccatgcaggatccagaagttatggtggccttccaggatgtggctcagaacccagcaaatatgtcaaagtaccagagcaacccaaaggttatgaatctcatcagtaaattgtcagccaaatttggaggtcaagcataacgcccttctgataaataaagcccttgctgaaggaaaagcaacctagatcacattatggatgtcgcaataatacaaaccaatgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggtctgttaattcttatatttttctttactaatcattttggatttttttctttgaattattgggcagggaagatacttatgtgtggaagattattgctctaatttgagtgaaataaaagttattagtgcgaggcaaacataactcatttgaggataaaaaaaaagaaaagttgatagcatagattctgaagttttctcttttgattccacttctccatccgaggacatatatttcaaaaagtatttcagtaagcgatgtgattccaggacattgtccatgagatatagaggacattgtacttcatctaaataaaactgggcctaattttaggcagaaggatgtacgtagtgttattttattaccttttcaacaactttcttagtaatcagtcattttcaatgaagacagtttgttcaccaccatatttgaagactattattaatttaccagctgctatatggtaaggggtctgtcctcagcctacctttggtagtttgaactagttatactttgttcatcattttctgacatctccagctgcttactagacttctctgttttgattttccattgtcacctcctatgtaacatgtcaaatagggaaatcatcgcttttacctataaaccacatcttcctttaaggccataccttttcttttaatgttaccatttattttccagttccccaggtgaaaaactttgatgtttccttgttctcaaccccttccccgatccaatcaatcaaaatagtatctatacttcctttgtgatgcctatgataaccattcttttcttcctttctgtttctattaccaagaccctggattagaccacgcatgaatgacatagcttcttgaatcatcctattagcgttttctcctcttttaccccctattagtgagtaggaacattttagttagaattactcaaatatcagtaccaagtccacacccttaatcagagttgctagggcccttcatgacttgctgatgatcactctaactcaactcttgtacccttaaaactgtttgctctggtcatatagaaaaatgcaattttccaatctagccatgttctctttgacttccagattatttgtattgtggtagaatacacataacataaaattgaccattttaaccattttgaagtgcacagttcagtggcactaagtatattcccattgttctgcaaccatcaccatcatccatctcgagaaatgtttcatcttcctaaacagaaactctgtacccattaaacactaattacctatttcccctcctcccagcttctggcagccactattctactttctatctctatgaatttaactactcaaagtacctcatataagtggaagtatacaatataggtccttttgtggctggcttgtttcactttgcataatgtcctcaaagttcatctatgttgtagcatgtgtcagaatttccttcctttttaaggctgaataatattccattatatgtctatgccacattttgtttattcattcatccactgagagacatttgggttgcagtttcttctctttaagtgtattctgctaattaaaaacaggttactcttcctgccacttctttcagtcatgttactttgctgctcagaagccttcaatgagttcctttttacagatagggtaagtcgcagcatgcacagcataacactcaaggctcttgcctctctgggccctgacctatgtataaaacctttctgttaattattagtcttcaacatttattcatgaaacatagtttttgagtgtctggtatgtgttgggccttggggtaagtgcagagtaaaccaaatagatattgtcccttaccctatggaactgactttggagttaagtgattccttcgctcaagccagaaggctctcctttttaccttggaagctggctacttcacccaacatgaatataccaaagaccatttggtaaatgaccagctcaccaaagctaattctgcaaaaatcacttgaccaaataatgattttgctgaaaaattgaggtttatattttttactttgtccctgtcatcactgctgttctcttcctgggcatgcattggccaactgctgtttaatatgaactttgcctgtttttcacattccagactctgagaatttttagaatggtcaacattttctacgggatggtcaagtgttttccatttgtttgtttattttttaaagcactgttttttgtcttaattacttttgcctctgtccctattgctcctgcttctgcaccttcctgtgccctggtgcaatggctatgagaaattgctctaaaccctgtgtaaaggatttgccagatgattgctcagtgaattgttcattcgttgagttagtcagtaagaagatgatcatttggcaaattagtttccaaacattttaaaatttcttctctcccttgtaggaaatcaaagggaagcattttctactatttttttcaggtctatcctctctgtttgaaccataatatctttttttgagatggagtcttgctttgttgcccagctggagtgcagtcacacgatctgggctcattacagcttctgcctcccaggtttaagcgattgcagcgcctcagcctcccaagaagctgggattacaggcatgtgccaccacacccaactagtttttgtatttttagtagaaatggggttttatcatgttggccaggctggtctggaactcctgacctcaagtgatccacctgccttggcctcccaaaatgctgggattacaggcatgagccactgtgcccagccaaaccataatctcttttaatagctctgttgatttgtttttgggagtagccttcttgtgagtaggcttcttgggagtagccttcttacatcttgtgctcagaatcagtagttgcttggttaatctaaagaagctggttaaggtgtagaatcataaaaacaatatagacacatcttttaaaataaaactccaatgtgcattctattaaccaatcctttaggatcaagacattttcttccaaaatgggtccactaattattcaaatcatctctctttcataaaccatactcattatgaattacctatgatttccagtttcagtttctttagacaggagcaagatcttaaagacactgtgatacaatgagtaaagaatcctggtgtatttttactatttttccctgccattaacacttgtcatatacagtttaagagcagattatcttagcaacatatctgtattgattctttaaaaggattcaacctaatttttaatgtaactatttttattgtcacattcatcagacaacatatttaattaaatatgattataataacaaatacaagtggcacaacttttctatcaattgcctgttggtaagcgaaccatgcaattgctgggagtagaagcctacaggcttacgagggaggaggctgcgatccaggagcactgagcatgcctggtatcagccagtatgtttccctgaggacatagggagcactggttaaatgtatagtcatttagtgcaggttggctatacaggcttttactgtatttgttcatccttatagacaaagctgtgttattgcttactatcttgtaataaagtaggagttgaggtgagatctagcagaaattgatatggggaactgcacaaatccttcaggttcaaatgacaagaacagggaatatttacatttgatgtaaatttgcatcacttcatcagaagtccagaacctgtgggaatgggggtgcagagagtgaagaagcagttttagactgacatcgttggcaactttattttggggcagacggaccatctctgccaggaactctactcctctgcctaaatgaccatgcggccccccttccaagggaagtctctaggtggacatcatgtgactgcccaccccttggtctgcacccaccttccatgtaaggaagtgctagtggccttctatcagggtctcttccactgacttctgtatgtatatgtgtgtgggaaggaattgtgtgttgggggtaggaggtggggtcagggctctgtgcctctgcagtgcatccagaaattcctcaacatttttcacagtgtatatgccctctctagtttccagtactgataaaagcttttccctgtttttgtattccgcttgtcacttccctggaaatccacatagaagggattggaagtctgtcctcttttattccaaatcttcctcttccccttcacctcaaactttgtattttaggctcttaaacgggtctgtacataactttttcctctgctataagcacataactaataaactatgggttagagtaaggtaattggcagttctgtttctcagtgttcgtaccattaaaatgatttttccaaatcagactcaaggcaatggaataataataatgagaagttattttgcactgtgctttatggttttaccatgatttagtgcttcatttaatgagacaaataaccagacaaggccgggggtggtggctcacgcctgtaatcccagcactttgggagatcaaggtgggaggattacttgaggtcaggagttcaagaccagccttggcaacatggtgaaaccccgtctctacaaaaaattaaaaaattagcagggcgtcgtggcgcatgcctgtacctgtagtccaagctacttgggaggctgaggtgggaggatcacttgagcctgggaggtcgaggctgcagtgagctatgatcgtgccactgtactccagcctgagcaacagagcaagatcctgtctcaaaaaaaaaaaattaaaaaaaaaataaaataaaataacaagactacttgagtggagtgtttttggaacaaaacattacctgagatgagagaggcattatcgtctgctttcagcaggacactctgcttggagccctggtctgggtactcttggattttctgctctcagcattgtctcatgtaggtacagttacatcaggtcattatcttgttggggctattactttaaaaaaatagatacagtttttgacaaaaaagaaagatagacaaataaaatgtcaaggacagccaagacagaccctagcttcagtcttgaggatggctttcagaaaatcacggctggatttccttgcctgtgatcttgtttttgaactgcctaaacctgcactgtcacaaatgggcacatttttgctcgaccaaagaaaagatgaatttggtggctttggaacaacattttcttcatttgctcaaccacagggagaataagggctatttgagaaatagcccttggacagcaggcatctttcttctaacagaagacgaaatggatcctccatctgtctcaccatacaacccttgctgtatgtgtcaacttgggttgaaatcttatagatgctgttgtcgatctctgaactcaaaaatctcttgtattactataaattaccctcattgacttccctaagtgttctcagatttctcttctaaaactgtccctccagggatctgcagggaagatgaagattttttgtttgtttgtttgtttgttttttgggtgggtaggggggacaccaaatgccatgaactcagtccctgctttgatttgggaagctgaccatatctgaggcaattctcctacagctgtggttcaattctcctcttcttttcattacctcccaggctaggagcctctgattgtgtgaaggtggggtaagtagcatgactctccataaagaaaagcccatgcttactcccaagatgaggcagtgagccttaataaaaaaggtgctggaagtaatccccctttaagacagtctaacatgagaaatgctcaagagaatattgtgcacatattagacacccaatcagtatttgttgagtgagtacatgaatgcagcagtgggtggcagtcatgctaggccatttctggtgcagcctccatgtctgtttacctcttcagaccttaattcttcatctcctttcctctccttatcatggttccattgttgctctgctttttcttgctaactcaggggaaaagacaagggctagtttggggattacatttcaaggctgcactgaactgatggcaattgaaggacagagaatgggaactacaaaggatgcttctgaaccagattcctatataacttctctcaaatgcagacatagatacctgcctctgccggtcttgatgctaggatagggctgatggtcataggttgccaaagagttttttttttttttttttttttttttggagacagagtctcacacagtggtgccgtctcagctcattgcaacctccaactcccaggttcaagtgattctcctgcctcagcctcctgagtagctgggactacaggcatgaaccactgcacctggctaatttttgtacttttagtggagacagagttttgccatgttggccaagctgatcttgaactcctggcctcaagtgatccacccagattggcctcccaaaatgctgggattacaggcatgagccaccattcccagccccaaagagctttcttagaagagcagctgctcagtgccccagctgggtttctaatactttataaactaaggtgtttaaagtatgctcatgtcacatctccttgttctagcattgttaggatgaattgcgaactcttgactctgaaactgggaagtgctctcttttaacttctcagtttttaaaaacatggcttgtgtctgttcccattgtcatttctggccttcatatggccacaactacctgttaagtcagtggaaaacagactgtggcttttcttaggtgttttcttctttttttttttttttggttagggtttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacacagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagcccttcgtcagatgagtaggttgcgaaaattttctcccatgttgtaggttgcctgttcactctgatggtagtttcttttgctgtgcagaagctctttagtttaattagatcccatttgtcaattttgtcttttattgccattgcttttggtgttttagacatgaagtccttgcccatgcctatgtcctgaatggtattgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagagctctgttctgttccattggtctatatctctgttttggtaccagtaccatgctgttttggttactgtagccttgtagtatagtttgaagtcaggtagtgtgatgcctccagctttgttcttttggcttaggattgccttggcgatgcaggctcttttttggttccatatgaactttaaagtagttttttccaattctgtgatgaaagtcattggtagcttgatggggatggcattgaatctataaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacagtggggttttctagacatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaaagagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattgatctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcagtggtgatatcccccttatcattttttattgtgtctatttgattcttctctctttttttctttattagtcttgctagcggtctatcaattttgttgatcctttcaaaaaaccagctcctggattcattaattttttgaagggttttttgtttctctatttccttcagttctgctctgattttagttatttcttgccttctgctagcttttgaatgtgtttgctcttgcttttctagttcttttaattgtgatgttagggtgtcaattttggatctttcctgctttctgttgtgggcatttagtgctataaatttccctctacacactgctttgaatgcgtcccagagattctggtatgttgtgtctttgttctcattggtttcaaagaacatctttatttctgccttcattttgttatgtatccagtagtcattcaggagcaggttgttcagtttccatgtagttgagcggttttgagtgagattcttaattctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtcttgttgatctgtctaatgttgacagtggggtgttaaagtctcccattattaatgtgtgggagtctaagtctctttgaaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctattttatcagagactaggattgcaacccctgccttttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatatggttatgtgtgaatttgatcctgtcattatgatgttagctggttattttgctcgtcagttgatgcagtttcttcctcgtctcgatggtctttacattttggcatgattttgcagcggctggtaccagttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctactgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctgggtaatatcctgcagagtgttttccaacttggttccattctccccatcaatttcaggtacaccaatcagatgtagatttggtcttttcacatagtcccatatttcttggaggctttgctcatttctttttattcttttttctctaaacttcccttctcgcttcatttcattaatttgatcttccatcgctgataccctttcttccaattgatcgcatcggctcctgaggcttctgcattcttcacgtagttctcgagccttggttttcatctccatcatctcctttaagcacttctctgtattggttattctagttatacattcttctaaatttttttcaaagttttcaacttctttgcctttggtttgaatgtcctccagtagctcagagtaatttgatcgtctgaagccttcttctctcagctcgtcaaagtcattctccatccagctttgttccgttgctggtgaggaactgcgttcctttggaggaggagaagcgctctgcgttttagagtttcccgtttttctgttctgtttttttccccatctttgtggttttatctacttttggtctttgatgatggtgatgtacagatgggtttttggtgtggatgtcccttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgcctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcggactgctgtgctagcaatcagcgagactccgtgggcgtagcaccctccgagccaggtgcgggatataatctggtggtgcaccgttttttaagctggtccgaaaagcgcagtattcgggtgggagtgacccgattttccaggtgagtccgtcacccctttctttgactcggaaagggaactccctgaccccttgcgcttcccaagtgaggcaatgccttaccctgcttcggctcgcgcacggtgggcgcacccactgacctgcacccactgtctggcactccctagtgagatgaacctggtacctcagatggaaatgcagaaatcacccgtcttctgcgttgctcacgctgggagctgtagaccggagctgttcctattcggccatcttggctcctccttcaggtgttttcttaaattaacttctggggcaacatcaactctggaggcactgtctcctttctctaccttaaggataattctgagactctaaggacagaatggtttctttatagactttcagccaggtgcatttgctgtgaggctaaacatccaaacagatttagagtgagcgacagtgggtattcaggtcaagtccaccagtttgatgttccttcttttccatgcttttttccttcagaatacagtcaagtctccaaaaaatgtatgtgtagcttaaacaaattccgttatatgatataattttgctttccattccagccagtgagtgttttccctagagtatgcagaagatgatagaaaagaacctgttgttacctttatcatttttgttcccatgtgctgctcagagtgtgacgttttcattgtgccaagtataattctaatatttattgatacaacttgttgccatagtttctatacacgatcttagccaaaaggccgagaggcaataccacatgtctctaagtggaagctagttctctggtctcaaccaaagtcatagtcatttgttccaactttggaggaaaatctggatgtgttggacttaactgagaaatgtatctccaacatggtgccttccttagggattttcaagggttaattttgaagatatgtaattttagtcctaagtgctgacttttgaatgtaactgtgacctaagatattatacaacagtagtgtctgattcctctttatagtgtcttttgtgataggtaattcacagactggttacagtctgttttccttttcttttttaacctaaaatattttctagttttctcaggtgatgaaattgtaggttaagctgggatttgtaaccttctctacatttgctatatagcgtctatgtaatctttctattggtctgagacattgcagaggaaacctatagccatgcctggagccaaaatgttggacataacccaatttgctttttttttttgttttgtcttgtttttagagttagttgatgggtgctgagatactaaggtactaagaatgacaaaaataaggaaagacttctgaaatagacaacacaaaataccaaagctcaattctttcacttttcttgatgatgaccacactgtttacagtggattgtaggttgttatagtgatgggaaaggtctgtgctgatgggcattgggaaagatgttgcaatctgaagatggactttgtctaatgcagtgtaaccgacaaagccaggtctcctggtatgggctcagtctctttgtagtttaacattcaaagaaacaacagtccaacttgagaaactttgaagaataatgtaaatatttgctgtaagttttatttttaggaggctttgcatagggattttatatagtgaaaggatacagaaagcttcctaaacagttccttgacacctctttccttcttgccagtttccgctcatgacagctatgaaaatctctctcttgctctgcctacagtgtcctcactctgggtggttctctcatcctttgtgcccctgcacaccacactgaccttccctggtgtatgcagtcctctggaacatgttctgtctagctctggtgggttttcttgtgagaataagccacattgctccagaattttggtaaatgaaattttcgtattagtaggaatattttgcttatttaaaactctttgatcttggcttgagacatattgcttgttctcactttgatatgatgtgttcaataaagtcatctaagaccctgcaaaccagatccatctgccttcacactttcattaaattagtaaggtcactatgaggagaggtatacagttactgttacagtatttaccaaacagtgggcccacagccacactcctcacttctccttttggtctctccttagaaataaagttgtttaaaaccatttgcttccagaaggccatatataaaggtagtaaatttaggtgttaattctgagcatggtagtggtgctgtgcctcattgctttccagtctgaggatgacttctaccccaaattattctttgagttactcctagcaggatgagagcaggacacagggctctaggggagaggaaaatgactaagatgatttagcatatctttatcctttacacagctttgctataaatttatagatgcatctgtattattcagggctttccacagaacagaaacaataggagcgatataggttctccatatatacatacatacacatatctctctctctctgtatataaatacattcattataaggaattggctcatgtgattgtagaacttgacaagtcccaaaagtccaaagatttgcagggtgagttgttaaactgggacccaggagagctgatgggtcttaagttttactctaaaacttccctgcaggctcaagactgaggaagagctgatatttcagtttgagtccaaaagcaggaaaagactgatgtcccagcttgaaggtagtcagacagaaggaattctctctcattcagcctttttgttctgttcagtcttcaactgattggatgaagcccacatacattagggagggtgatctgctttactcactctaccaattcaaatgttaatctcacccacaaacattcttatagacacactcaaaagagtgtttggccaaatgtccaggcaccgtatggcccagtcaagttgacacattaaaattaaccatcacagcatccatggagagtataggaacatgtaaattacaattgaattcccatgcatatatatgggtattacttgatggatatgatcatgtttttagagctcagtgaaaaataaggcattagagaattgcaataaataataaaattatttattttgggtgcttttgtcaaagaggtatattaatctcttgatccctttcctctgcttcatctaactcgtaggggatatactttatattgctgtgcttggcatcagcaactgatgtgacagctcttcctctgttctatgaaaaggtgatgtactttaaaaaaaatgtttctgtagaaagtgcttatatccactcaataaaatctctaacaggtctagctactttaaaaggaacagttaggagagatgttttgcttgaatgatagtttaaagaattcctgtgttttttcccattagctccatctaacttgggttgtctcagagaaatccactggagctgatcttcctcagtaagatgtcttttggttttgttttatcatcattcctcatctgagaaccagagagagaaagctgtcaacaagttataggttcgtccagttggtggagctgtttgggccacagcacagggacatatcttttgggtggcaagttctaggtatggggctctttcatttgcaggtggcttatccaagagggctggagatgtagctcctaatattcttaatccagttaaccgggatgctaacatgttgtactgatgttacttctgtggcaaaacttctcagagatcttgggcccagtaactggtccaaaagaaagacttgagaggaagaatggctttacctgaagtctatggtcattcttattgctgttttttgtgcgttcaattcagactttcagcttggtcactgttcttctcttcttccccttcctctatgtggttggggactggaaaagggtgtcctagttgttcgagaccctatcctggactgctctttgctcctatctatccaacttctcaaagttcagctttgcttttcctttcctgccttgtactcacccctttgggctaatgagattctcagctttttccaaacgctgactcttctctcatctctaggtcctttgggtaaacatctcttccaaccttgatctaatttttaaaaaactgccccttatcactaattttagaagcagcaaactcattatatagtaatttagattaaaatatatatataattattgtattcctggattttgttctttttttcttgtttagttctgaattttgctcctctaggatattcttagtaaatctctaaggaaaatgcaaaatctgccactaataaaagcagccactgacatggatgggatctagggcgaaagcaaatggggaaaaatgggaaacttaaaaaataagagaaatgcctttttttttttttttaaagccagagacatgatcttgctgtgttgtccaggcatttcaaactcctgggctcaagcaatcctcctgcctcaacctctcaaaatgctgggattataggcatgaaatgcctatttttgaatggatacttttaaaattatctacttatctagtatgctcccagcatctgaagagcagataggattcattgatgaaagggtgaggtggttaaaacatacaggaggccaagactagtagttagccctgtgtaggtatcacaggattacttgggtcagagactcaagcagaagtctctttaaagcttttctaaatgataaacattgttggaatggggtaaagttgttctactgcaagaaaactcttcatcagaagaaattaagaattaattatccttatctaattagactaggtgtttctcaataacaagaaaaagtagttgctgcttgcattgcttttactctggcactagtataatgcagtcattattggtcataaagcactctaaaaccaattaatttgtaaagcttattttgacaagaagtaaatacaaaggtaaggcatagttagcataatgctgctatcatggcactcttgggcataatttatatacataaaaaatacaagggcaagtataactttcaagctgattgcctgtaaaagacttaattgaaaacagttttctgcttttaaaaagtgatttattttagatgtgctttaaaaaacaaaggtcttattgataaccattttgagtatattatctcgatgtgggatttaagtaaaaggtcaaatcttatagaagtatttttggtatgactcaattctgatcacagataaactttatcaagaaaatgaaattagttaaacattttcatgcctgagcactagtttaaagaggcagcaatttttttttttcacaaagacttcaagaagagaactttggttgagaaacctagaaaacaaagaactcaagatgttatcgtataaatgttctttaaacaagttaatattatgagaggggaaaagcattagatatgtttcactagaagaataaacaattcacatgtgtaatttttgcagtggatagacaaatctcagatcttttctgcctgatatcatttgcatttattcagcttattcaagtaaaagacttatattttatttcagaaaagctaacatggaacttttaattttacatttaagtcctgtttagttgtaattctcactcccccagcccctgtagcctcctgaacagctctgacttgctttttttctgaatccagcatcagtcctacaattagtccattggccaggtgatggtcatgtgcctggttagagtagggcaggctccatttgctgatgggctgtgcgactcaatgttcacaaatgtttagtcattcagctccttttcaaggaataagcctggatcaggcaagtaattaacctttgctagtcccaaggtttgttcattagaggcagggaaggaggaatcttctcacttttcttctcagtcctactgctcgccccagctttatgaaacatgagctatgtcctaagggaagagcaagtgggcctcaggtcctcagaaagcaccacaaaactcttaaaatattaagcgtaggagtctattgttcctttgttttcctggacagggaaacctctttaacattggacttcattgtctgtaccccatttcctgttcttacagtggctgttcagtcagcatgatggccggtgggacctggaggtccagcagcagctaagatgtccaggccctactcgtttgtacccctggtagcattctgccttagatatgagagacacttcccaggctcttcctgcatttccatcttatgctctggcaagcaaatgccaatcttggctcttttccacttaaaatagtccttctactttttatctgctgtgtaaattggggttagaaatattgacttaaactgcaccagactctgctgccagcttgcccattctccattacccaagtcttcctccctaacagaacccagagtttgttcatatattggcagcaatgtactcagcccgggcaatggatcttgactggtttcagccaatcagaatatcttctattaaggataaggatagcttccctgcagctaggggtggctgagtaaccttgttctgaccagtaagatttaagcagcagaagtccactgggaagaagggaatggggaaggaagactcctgggaaagcttttgtgctcttaataaaagagcagagaaactgctgtgctgcttgccccttcatcttggcttgaaaacaaatgtattgcctggagctgaggcagctattttctgaccatgaagtaataagccttattgtttgacatgtgaatgcaataaacctctacccacataagctacctccattgaaggattccatacttggcacagaatttctaactgacacacactaaaattcagatataaaaaaaaatagtttctgtaacgttttggtaactgatttcatctcttcctgaacctttgaggttgaaagtggtggcagcagaggtggcagtagccacttacctttatcattaatgataagttaatttattttggggaaatgactcagttgttcaattttccttccacttgcctcttcgagatgatatctgtggtaaatgggtgtgagctcttaagcagtagcatgatctactggctcacgcttgcttttcagagctgattgttaagtttaggggaattctgcaagtcacttgttatatgcaaccattattagataagttatataaacttacaatattaaaaagaaaggtagtactcaaaactcaccactttttaattatttaagtacattttactattattcttgcaattgaagttatttatgtctttttgtttgttttagagacagggtcttgctctgttacccaggttggaagcccaggccggagtgcagtggcacaatcatagctcactgcagcctcaaagctctgagctcaagtgatcttcccagctcagcctcccatgtaggtggaactatagacactagccaccacgcctggctaattaaaacaattttttttttagagactggggtcttactgtgttgcccagactggtcttgaactcctggcctcaagtgatcttccagactcagtctcccaaagtgctgagatgacagacctgagccaccacacccagcctatttgtgtctattgtatctgtaaatggaaatactatataatgccgcagttagcatgagagtacagatatctctttgacatactgatttcatttcctttggatgtatacccaggagtgggattgctggatcatatggtagttctatttttaattttttgaggagcctgcatactgttttcataatggctatgctaatttacatttccaccaacagtgtacaagggtttctttttctccacatccttgccaacatttcttgtctcttgtctttttgataaaagccattctaatgggtgtgaagtgatatctcattgtggttttgattttcatttctctgatgattagtgattttgagcattttttttcatgtagctgttggccatttgtaagtcttcttttgagaaatgtctattaagatattttgcccatttttaaatagaaaaatcctctacttttgacttttcccttaaccttcacctaaaacctctcaatttgagatttaggtccaaggcaaagaaaccatgttttcctgcttatgtctccatctttttaacgtcttcttacccatcaccatgagcttttcttttcccttctgtttggtagaaaatagttttaagttatttcattctccttcctgaggagttgctttttccctttctctgaggccatattggtgaaaaggctgcagagaacctgattcataggggagaatgaattaaaaatacattttaatgtatataaaaaactatcaccatcacgcttgtaactatgagtcaccttgtccacccttccactcctcactactccagggttccacagacctgagagtagggactgtggtgaagaatgactggcagatatacagcaactgaaaaggcaccacgcttttatctcagttgcattaccctttgtatatcagcacttaaaaagggatcttttaaataacatccttgaatccttttgggtggtagaagtaaaattggggctaagcaagaatgaaatggacttttagaagttaaaataggatgttgtatgggcaaatgtatgaggtaggaaaataatgttgtcactgctttgctatctccattttcaacagctctctcagtgcctctggcatctccttcttttgctatgtaccagccctgtcacctagtccctcccactattaatcattaatgacttaagatgttaccacctccttaattgtatttaaaagttaaaaaaaaacatgcttttattctttcccattacaaataacaattcatattccttttagaaaaatacagataaacataataaaagtcacttacaatccattgccttgaaacaactattactaccctagtatacatcttttattaaacattcttctacagattattattattattatggttatttttaataaccaaagacccaagagagggtcttgctctgctgcccaggcccgagtgcagtggcacaatgatagctcactactacattgaacccctgggctcaagccatcctcccattttagcctcctgagtagctgggactacgggcacatgccaccatgctgggctaattttttcttttttgcagggacagagcttcactatgttgaccaggctggtctagaacttctgggttcaagtgatcctcctgcctcggcctcccgaagttctgggattacaggcatgagccactgtgtccagtctacaaattacttcaaatggctgcagggcagaggtcacattcatccttatcaactgtaaatagcaatttatttgtggtcaaataataacttcaaaaccattagctaatattcagaatctattgacaaatgatggggaaaatctttttgtcagggaggtctttctggtgcacctcgaatcactccatgcctttgttgttgttttgcttgtcaaacctggaaatctttttcctctctttcacatctatcaaaatctttcctgtcttttaggtccaccaatgtttttacctgcccaacctcctttaaacttgcttctcatagtattcatcccttcccctgaatccttgatcacttgtactgctcatctagcactcatttgtacattttctcaaattgttgccaaactgtttaatgggtcatataagtgtttagggccaggaataactttggtgatcatccagtgtcttattctgttcctgctgctataataaaatattacacactgggtaatttataaagaatagaaatttatttctcatagttctggaggctggaaaatccaagatcaaagtaccagcagaatttggtgtctggtgagggcttgcaccttcttgctgcattctcacatggtggaaggggcaaagggaccaaactactcccttgagtctttttataagggcactaatcctatccttgaggcagagcccttatggcctaatcatattgtaaaggctgtacctcttaatattgttgcattgaggattaagtttcaacatgaattttagagtgacattgaactactacatggaactcctgggctcaagccttcctcccacatcaccctgctgagtagctgggactacaggcacattctaccatgccgggctaattttttttgggtctcactacgttggccaggctgctgtcaaacttctggggtcaaacaatcctcctacttggaggacacaaacatcagagggacacaaacattcaaaccatggcacccagcctatttaaaaatgagacccagagatcttgtgattacacaagattctgtagctaagattacatccctgttactctgactgtccccctgccggcccccaccaatccagctttcactatctcatattgcatctttctctacccaattagctagtaagccttaagcactagaagctattattagcatcatttctattttaaggatgaggaaactgaggtgcagataggtcaaataattcaacttaaggttaaacagtttgtaattggtggaaacaggactgtacccaggccactgactccaatgtccatgcttaatcctccttgtaccaccttacccatgtccatccatactgtagcttcagaaagattaagacctttggaggagaaataaagactgagtttgacaattaggaaattgttaacttttgccagggaattttcaacataggagtaggattgggagctaaattatgacaaattgagggatgaatggggaggtgaggcagtggagggcatgagtaccaaaaacaggtgggtactcatggaagggcagccatagggcggtggtttgatgagtatgtagaactgagggaaggcttgctttagtgattgattttttttggatgaagaagtctggagttcatgaaacatcctagaagaggaaggccaggatcaacatgctgatggattgactggccctggatagaagtggggtactttctttttgaacaagaagtggggaaggtaagtggaagtaaaacttgaaagggataaaaattgtggatgactgctttttttttcttggacattaggaagctgtgttgtcttgtgagggtcaaggggctagggttggggtagggaacttgagcaacatggaacaaatttggaaatgctgctgtaaggaaacacaatacaggaatatgcagggcagaactgaggtttgagctttaaaacgtaatttagataatcaacatagttttatgattttcttttccaacagtggcagaatattcagaattggagaaaacagagttgctgtggaatgtcaagggtgagcagaaggactgggcaagagggcaagagaatggagatgttgagagtgttgttgaagcgattgactaggataggctctgaattattgatgaccaagagttcagaacttgttacatataggtctatctcatatgcttttgcatttttgtctgtcatattctttgtctaatgacaaagaacatacatgcttacctatgctttcacattaaactacagaattctactttgtttccctcctcaactcctcctgcaagccttagtcttgaagagggaagggaggtctctactgaagggcacactttactgtcacaatcactcagtggcagtgggtgcatgttgatggatggtaaagggagtgagaattttttccagccacttgtggaaaccctagggtgttgagtcaccgtcttcaagatggagggagagagcatgtctttcagtggatgccagcagtgacatcacggtcagaatgcactcttgctggatcaaacagccctgagaggaagcatggggcctcatttttatgagaccaactgggaatagccatggttcttatcatgtgccacctgccatcagctgttttctctccacttggttccaaccaatctatcacacttattaaagttcagcacttatatcaccattatagcattgcttacaattttaggcctagaggattttactaatttaatcagtagcctgatgatcaaagggagggagttcattgcatgggcactgagccaaagaaacagtcttatgaggattttctcagcatttcctctggccacaggtatggaaggaagaacatcaggaaggattgataaatttggaataaaagcaagcattgagaggttggacatttgatgaggccaaggaagaggtttggtggaagaggtcaaggcaagagtgtatggtcagagaccgggagtttcagggtttatatttcagatgtgttctgaggctgtgctataaagagaggagagcatggacttgggagtctgagcagcaggtttagaatcctagcccctatctagtcattatctctgtgacactgggccatctctacctaggagtgctatagcctgactttacattatctgtgagggttacggaaaatgatgtgaatttactagcatggtgcctgccacttggcaagttctgatatatagtcatgactattgttattattgcagggtgtggcctcaggaatgggttaccaaagatgaagatggccatatggaaacagaggaaatgagattggctaagtcatcaacatgaatgttgaaattaccccattaactggcaagagtccaggaaacggcaaaccagatattaaggctctcaggcacactgtgggagaggatgggaaagtgatggtgttacaggatagcctgtagttcaaaagaagagactactgaggaaggcaagaacagcaatattttggaaaagacaatgaagagtgagagggatggccttgtgatggggcaggcctggaggaatgtgtggcctctatgtctctacatcactcaaaggtctatctactccaaactccaggaccgggccagttcagatgctcatcctgcctctcaaatgttttggtttttgtttttcttctctgctgcaggctcctgggatagagtctacttttctttccttttaacagttgccaatactccttcttgcccttaggtttctggtctcctcaaaattagctgtagagtgggacacatttacctggttacccttcacttttctttattgaccttgaagactagcaaataccattaactttttttttttttcttagagtcttgctctgttgcccaggctggagtgcagtggcatgatctcggctcactgcaacctccacctcccagattcaagtgattctcaagcctcagcttcccaagtagctgggactacaggctaatttttgtattttcagtagagacagggttttgtcatgttggccaggctggtcttgaactcccgacctcaagtgatccgctcatctcggcctcccaaagtgctgggattacaggtgtgagccaccgtgcccggccccattaacttaaaaaaaattgttgtaaaatatgcataacataaaatataccattttaaccctttgtaagcatacagttgagtggcatcaagtacattcacattattgggcaaccatccccaccatccatctccaacactcttttcatctcgtaaagctgaaactctgtacccattaaacactaacttcccattatctactttgccagcccctggcaaccactgttttactttgtctctatgattctgtatgatttctttctctatttaatttttgttttaaagatttaagagctatttactacaaacgagtgaacagagaggagagcaaaaagaacaagtgcagaaggcagcaatggtagccttgtgttgtaggagctcctcctttcttacttctctaggtgtttattgccaatacagtgatacagaatttcaggaaatgtagacttgtctgttattcagggacaggttggggatgtcttggctgccgcaggactgtatcgaccccgccacccctaactcttgcagtcaaaagatacccaggcctccagctctgatcccattcatcaggccagtctttgccagagatagaggaccctggatgatgacatgatgattctgttcttcctcaagggcctcctgccttgaaagtcttccttaggcagaacccacataggatcatgatggatttgggtggttgatgtacctgcttggtatagaaggatcaagggttatgactttatccaacatactcattatctaattccccacagatagatatatttctttgggagaaaacatgctcagatatacttctttgggagaagacatgctgtccctcttggctggagctggagctcccccatcccgtgcctctctttcttgctcacgcccaatccttctctcctctttccagccccctctttcaagctccctgtcctgctgacctatgctttctcttgggaaggactgtccccatcctctggagggacatcctgctgctgtatcccttcttatgtcttgcacacttgagctcatcaggctttctggcagctaatggaatacccttccttgggggatggggtgacctctgggccttaatgcttggaaggggcttgctggcctctggaggtgggaactccagtgccttctctcttgtggcctgggtgggcttgcttgagctggactctgaggagcactggcggcagctctcatgtcgtctctgaaaggctgagctagccctgtctggcagaggccttcacttcacagcactctgttctgtcttgtatctctaggatcagacttctgtgtgtgtgagagaaatgtttagagcttccctgtttgctgaggaataaaattgaaaatgattgcagctcagctctatattctgaaatcacagccaatctgatagagccatttttaaattcagacgctgcttttttaatagtcaggcactgacatattttaattctcccttaccgaagtgaaaaggcacaagcagattaagaatttatggtttaaacaacaaaataaaacaatgtgttggcagcattatactccctagaatttcacacatttaattttgttatttttactttcttgtatcaggcctgttaaatcctggaaggagagcagacatttgagaaattttttttcctgttctgtttggaattcatttcccttagtgtgacagttgagataagctatttggactgcctccagggagtgctccagaggtgggcagggaggaggcctcctggttccatgactaaggtatggctgcgttgggagctcggctcagccatccctagtgaaatacagtggaaagcggcagctggaatcagatccacaaggaatagcctgagttctccagaccaaagttatattttttaggtttgcctagctgtttaaaccaagtcacaggcagggctatggtagtcattcctaggtatcatcccagtgggacttgtgtacctgggatccgatggtgggactgctggctctggagggctagctggtcagaacttctgatgtctgctttgggcatcaagtgggaacatttcctgtatctcacatgggctggcagatgcttccatttaccactctgtatttttgctgaaataattatacctgacgtcacatacgaggcttccttgcctagaacagtggttagagcaggagcctgtgtagttgcctgcctgggcttagagactggttttactccctaattggcaaattacttagccctttggtggctctctttttccatttatgaaagagggataacagcagccactgtttaagcttgtaaggatgaaatgagttaatacttaaaaagtgccgagacattgaaaatgttcaataaagctgcaattaccacgacatcttaaaagcactcgagagacaaagctctggctaaaattgttatttctgtgttaggcaaaatgttgggacaggctaagcatgaccttgagtccttttggatgtgctgtcttgtgaccctcttcttggtggcatctctccctctccctccaacctggggtagtgacacttttcgtcctcctggaaagagctcccgtttgctgaggaataaaatggaaaactattgcagctcagctctatattctgatatcacagccaatctgatagagccatttttaagttcagacactcagatggccagcaccctgagatgcaaatttcccagggacacacattttaacaaggacaaaaggatgagtgaggttgaggaaagcatttaggggacagcctaatggcttcacaggtccctgactatgctttagatccctgagagtggggacagtcactcagagccatcaagtaacaccaaaatgcactttactgaagtcatttgccccataaattctgccaagtagagattctttggcttacaaactcctcgggcattatatacacttttgtgtaaattgcttgaggtattcagattgctttcttctgaaaatctagcaacgatcccattctgaaggcccaggagttttgtttgtggatcaaggagaaatgaagtggcagagggtgcattttgtttggaacatgtggttctctgggggaggctggcttggcttggatagggtgctggagtaggggctgtggctgagggcagcatgggggccttgtgtatctgagggcagaggagaggcaaagggaaatggagctggagtgcaaagggaggggaaggcctgtcaaaggcaacacatagtagagtgactgtctttgaacagcttcgtgtcagaccttagccctttcgcctaatagctctgcgagcaaattatttcatttcccagtgataggaatttttctattctgggtcctaaacaaatagctgcctgatgtggtggctcactcctgtaatcctagcattttgaaaggccaaagtggggagagctcttgaacccaggagtttgagactaacctgagcaacataatgagaccttgagtctacaaaaaaaaaaaaaaaaaaaaaaattgttgagcatgtgcctgtagtcccagctacttgtaaggctgaggtgtgtgatcacttgaacctgggaggcagaggttgcagtgagctgtgattgctccactgtactcaaatctgggcgacagagtgagacctgatctcaaagaaaaaaaataaaaataaataaataaataaataaataaatctgatgctacgatttgatttctgtggcttaacattttttgtcttcaaacagaccaggattttggaaagtgaattattttattttttcagtgtttcacacctttcttctttctgatgttaaagggggctaaagagatgcattggtttgctcaggctgccacaaagtaccaaactgggtggtttggaactacagaaatgtattgtcttacagttctggaggccagaagtctaaatcagagcattggcaggattgcttccttctgaggactgtgagggagaaatgtgttctgtgcctctcttcgtttctggtggttatcttctttctgtgtttcttcacatcatcttacttctatatgtgtatgtctctgtgtccaaattctccattttttataaggacaccagtcacactgggtcatactggccctctctactccaatatgacatcatcctaacttaactaattgcttctgcaatggccctatttccaaataaggtcacattctgactggaggttaggactttgacatatggatttttgggagacacaattcaaatcacaacagggaatttggaagaagtcagggtaatttgacactttttttttttctcagtcagaaaggggaggatcatctctgtgcatcagggcttatacaacaagaaccagttttctccagattctgttccttagttggaggccaaatcaacagatgtcatatgtttccatccttccccctaaggtgtctgttgcatatatagctgccatttgataatctcatcatctgcatgtattttgagaatgcagtggctatgataattctctgcgtgctaaggttttatctgatgatgactgcaagaattatttccccatgggtcagtccccttggggtagttgtataattacttgcctaattaatgtataaacataatttaacactgctaaatgtcagatgataggataaatatttggggctatctttactagcatctccattgtatggaccaatgtcgtagactatattgagtgaatctaacaccatccctggtgctccaaaagcagccatttcttctcacttgtacttttgacccaggggttcttgggctcattcacacacaaaattatacatttgaaagtagggcattaagcagactgcagagaaaggaagggcttttcagtttactcgtcgcttctagttggctaagggcatcttatttgagtaaatatgggtgtggtcattaggcttctgatttgaagaggatgcctggtgcccacaagaaacccaaaaaccctggaaaactaagtttagaatgctaagtttaagaagtcatgctgcagaaaagagtatggaagaatcactcaaaaatgtatctgattctatcttattatacacttcttaccaatgaaaaactccttctaatgagtggaacatcaaattttgaagagctttgggaatttatcctaaggagatgattggacaagtaaatatagatttatgtataaaagtgttcatttcagtatcttttatagtagccaaaccccagaaatcatttaaacacccagtggcaggggactgtttaaataaagtatgatggcatggccatctactggaatattacatggttattaaaatgatcctgtaaaatgtattgacattgacatatttataatattttgttaagtttacaaaatagctttataaataaatgaaacactttttactggatggaaatatggcaaaaaaatgacagtaattatcctagaagattgggttattaattaccctcttctttttcttttagagacagtgtctcgctctggcactcaagctggagtacagtggtgggatcatagctcacagcagcctcaaactcctgggcttaagtaatcctcccaactcagcctcccaagtagctgggactacaggtttgcactaccatgcccgactaatctgtgcattttttgtagaaacggggtctcactttgttgcccaggctggcgttgaacccctggcctcaagtgatcctcccaccttggtctcccaaagtggtgggattacaggcatgagccaccatgcctggccttaattaccttctattaaaaactattttgccatattttctgaatttttttgccataagcattttaataataaaaataacaatgaatgatatgaaaattgcctttggaatctcttgatggacacttgacatctggaagatttggttttcccaattccatagttcttgaacagttggccccattttagactctgacataataaacctccacacttttgatgaagaagcttacatttgataaagcttaaggatgaccttttgctaccaaaacagtttaatgcccattctacccagtcagccctgttcttccctaggttgctgactttgattaaattcatgggtctgagtccatctggatgagtccagagcagtctacctagttttcaaaaaagatcaatacctcaccatctgcttgtgagatttttgaagcatatggatcagctcagagcaccagcattccaggccctgcaagagcaaaccatcttgaattgtctgctcttcatcactttcatcaaaggttggctgagaaacgtgatatttatggaagatggtttagaatacatcctttccgctagacactacaagttctatgcttgaatcaagccaaactgacagaaatttccattcttggaatatgtgtctaagctgctcctgaaattaaatattcattggttgcattttagtaaaacaggaggtttattaaaaggccacaatggtgttatctcacagaactctctggaagaaagtccctaggcctcaaggagaccaggaagaggacccgaaggtcagaaggatgtctgtctccacctttagtttctgcttctccgtgtttcaaatttgttcagctctctctttgcagagccagccttctgagcatccctgatcctgtaaccacatgtccacaagtagaacaaacaaggtggctagggtaccctctttcccaagattggccagggtaggggagagaagcaggtgatggggggattgggaatggtgttcagagaaagagcatctattacattatagaactttgaaagaaaaaattgttgtcatatttttctcatttatcgggcatagactatgagataaaatcttattttatttacttttattttatttacttctatctactctgaccacccttggaggttatctatatttgtattacccggaatttcctttactagaagttcttgcctttgggataaccattattgtgctctagattttttattcaacaatttgttgagaaacagatatagaataccttttactaaatcttatttctgtaggaatggtgttgagagggctgtcagtgatatcgctgaatattctccaaaagtttcaaggacaaaattgctttaaaacattgaattaaatattaaattagaaagttcagcataattgatagtttcttttctctgtgattcagagacaaatattatgttcaaatgtagctgttatcctaggctcccttgttgcatataatttgtgtttttctttttcttggtctaaaattaccactcttacttatattttccctagtcctgatgctctcttcttattatattttatcaattattgcacatatttttattggaagtacctcaaatccttaggagggaggccagtcataaataaaggccaagttattaatatccaataagaatttaatctctgtctctctcatctacctattcatctatctgctttaagttggttttctaaattgctgcttcttgtaatctaatctagaggcgttagtaatgcagaaatgtcatatagggatagacacaggggagatgtaagggaactgtttttactgccctgcttctaacatgatatattaatagcaggtctttacaatacctgtccataagcttggtgatcagtgtatgtatttctgtgcatggtttttatgtgtaaaactgaattaacagataaaatgtctcatattgacagaagtctgtctatgtgataaaataaaatctacttgatgctcagtttgttaattcatatgatgccttttaaattactctattattttaatataaaactggaattttttactataaaactggaatatatgagtgtgtgtgtatctgtggcatatatacaagtaggttgtattctattaggctggtgcaaaagtaatcacagtttttgccattactaatatgtatatatcatatagatatgaaagtcagatgtaacacctgtcttcataatacctaaatataaaatctcatacccatcaataattctcaaatgctttaaaccgacattttataataaaattttcaaacttacagaaaagttggaacaatttgacagtgaacaacccagctggattatcatttagattctataattaacattttactatagtgtttcatcacatgtagatattcatctacctatccctctatccattcatcaacacatattatttttggaatatatttaaaagtaagttgcagattcatccttagacacttcagcatgcatatctctaactagatttaaataaatattttccatggttttttccctttgatgtcaaatctacatacactgaaatgcacatatcttaaaggtaccactgaaagaggtttgataaatgaatacagctgtgtaacccaaaccactattaaggtatagaacatatacattaccatcattccagaaagttccttcatgttcctccctagtcaacccccatcccctcacccccaaagctgttgatcatattttttcctatcatgtattagttttgcctgttctgaaacttacaacttgaatcatacaattgcttttgagaactaaaaggagtgttttctttttattgttaacactatttaaatttctgggatgatgaaacgtggcctcagtgtcctaaggtatatagaattatagattattataagtggggtgttatccagggcagagcagtagcttacccttgggtctcgttgacagagatggggtttcaccatgttggccaggctggtcttgaactcctgacgtcaaccaatctgcctgtctcggcctcccaaagtgctgggattacaggcgtgagcctccgcgcccagcctggatatggtgatatgattttttgtcagtcacagcctctggtgaggacagttggctaatttaaaaaatgcttggcacacacatgagcattgtatcctgctgacagccttccacagattcgtccttttgtctaacttagagttctcttggtgaagagatagcttgaagtatgttcttaggcaagtcacttccatgacatgttctcctttgtggagtgaaaaagtgaaaggcgtttggatgagaatctggtgagcaatcaaaaacacacaagtttataggcttcaggccaacatattttagtcagctgaaatcagggagacactgcctggttggctggctgcctccggaccggggcatcctgcagaggggccttcagctaggggaggggcagggaagaaaatctcaggaaagggtgggcagtccacttttgaccactccaccttatgcaattctttcttttcccttcttctcccttcactttctctgtcctcttgacctttcatttcctttcttttctgtcttccccgtggcagctgtgaacatgtggatcccttgtgcctgaggttctgctggtagctcctgcagcccgccagactccaggctcaaggcttaggggtgtttcttcccacagtcttctggagagtgtaccaacaatttctccacgctccctggggttgctcagctcagcagggctggggaagtgagagctgctaaccggctgtgtctgtgagtcagcatttctccccaccgactcaggtctggggagagaccctgggagaggatgtggaggaggcactttcctttcccagactggagatcaggcgtccccaggggcagggggctgggggtagaaggtcgaggagtgaggagttgtggagagtgagtggtgtctggagcataactgttgtatgtattcatgcatgcgcgtgtacacatcactgaatttgtttgtggtgactagagtcagttctaaaatgtgttcttgtaaagtcttaggctcctaaaaaaatcatttgaatatggattttaaatattctcagaagtttgagaaaatattcctactaactatgacagggaacaaatacatacaaattagttaataacatcatgctaaaacgtataatgtgattttcaaaacatgctaaagagttaaaaagtctttttaaaatttgtttattttttatttctcttccctcttagagcgtaaaaagttttaagagggttttttgttttttcttgatatttaaaattttggtttgatgctgagaaaagctttccacatactaggcacgtaatagatattcagtattatgtgatcacaggaagtaaaataagttagagagatcagagagattattctgtatttaaaggattgagattttctactatttttagccaaagaacaatatgcaaccttgagttaaaagattccttattactgattgggagtttgactgttttgcaaaaactgtgcttgccacatattgtcagatgatgatgaaaaatctaagtttaggcttgacatatagtgaattatgtggcttttccccaacttgaataaacatacttaaaaaaaatcccactggtttatttgtcttcatgtagcttgcttacctcacaaggtttatttcagtagtcatttaaaaccaaatttctgaattcttacattgtatagaaatatcccaggaaccatttttgggttgaacaagacttttatattagttccccagtcataacaatattttcttgaagttacagtaatatattcttgaaggcataataatacattcttgaatatattattgaaattcaacttatatgagaatatgttaagaatgtatgagaatatattaaagaatatattgaatggtggtattacttatatattatttatcaccatttctggatatagtgatatgcttttttttttttgagacagggtctcactctgtcacccaagctggaatgcagtggcaggatcgcggctcactgcaacctcggcctcctgggttcaagcaattctcatgcctcagcctctcaagtaactgggactacaggtgtgcaccaccgcacttggctaatttttgtattttttgtagagacagggtttcaccatgttggtcaggcttgtcttgaactcctgacctcaagcagtctgcccatcttggcctcccaaagtgctgggattacaggcgtgagccaccatgcccagcctggatatggtgatatgatgtttagttagccacagcctctggtgaggacagttgactaatttaaaaatgcttggcacacacatgagcattgtatcctgctgagagtcttccacagatttgtcctttggtctaacttatatttctctaggtgaagtttacactcatttctttttgttctacccttatcggtgactaagagaccagctgtattccaacttctgaatactggcagaattctgaatcagtagctcttccaaaagggcctagcttacctcagagaatcagtctgacccttgtgtccttgtctcctctatggagaacatggagttgcttttctttgcagttggttgtagcttaaaccatagtgcattgctgagtcgtgtgatgtgtgattcatcaggcctcaggtgacaacggtggatttccttcaggaatgagtagcaaacattttggcccctctttgggtgccaagcaccatgaggtaagggagtactttacagacccctagagatccacgggtgctctagatatagccatatttcagcccctggatcctttgttagtgccatattaggagaatgcctgtggaaatggcttcttttctccacataaggcttttctttttctatttttaaaaatttggaccaccaggcaagaacacatcaggaatttttctgtttaatttgaacacatgtgttaagaggcagagtatagaaagtagtctgagactagagaatctaatggagtaactaagagggtttacacctaggatattggaattagctatgtcctaggctataaatctaaggtatctttgttctaaaatgaaacatgacacagacatgacagatgacaaagagtacactttattgtagatccatataatactgagaaaattatttttctgcaaatctccttggagatcaggatggggttgaacctcacctgaaccttaagtcatggaaagtgaaggagaattttaggatggcatacagtacaatgatctttaaaatgaactgcagggccaggcgcggtggctcatgcctgtaatcccattactttgggaggttgaggcgggcagatcacgaggtcaagagatcgagaccatcctggccaatatggtgaaaccctgtctctattaaaaatacaaaaattagctgggcgtggtggcacgcgcctgtagtcccagctactcaggagtctgaggcaggagaatcgcttgatcccaggaggcggaggttgtagtgaaccaagatcgtgccactgcaccccagcgtgggtgacagagcaagactccgtctcaaaaaaaaaaaaaaaaaaagagagagagagaaagaaaatgaactgtagaacactgatgttcttctggcaagaccaagttgttttgccactaaaatattggaaaaataagtgtcttttcttgattttaagaaaaacactttcccagaattatgtatgcttttctcccaatactttttaaagctttggtgtttgtttctgtactagaatctagtgtaagaaagatctgactgagggcacatgttctcaggatctcctgagggctgtgtcacaggcaaaaacgtggaataaaataaaataaaatatccaattaagcataacacattaactttaaaaaaacctaagtgtagcagtatttaatagtgttttgcaaagatgctgttactttcatgacacctaccacctgaagaagtttgagaaggaccaggttctaattgtgcaactgccattaactagctagctgtccttggataagcctagaaaagctgcgtaaaggaggaaggatttgaattggaccctgaaagaaagtcagatcttagaaaagcagagaggggagggggaagttatttctaatgagagaagaggagggtaaggagatcaaagacctaagaagtataaagtttatgtgggtaatagagagaacatctgcttgccatgaatttctcttgagtttttttggccccagtgtagaactagtgtctctgttctctgctgtgacctcacctggaaatgtctattagtttatcatgccatgctggattaaagaaaaaccacagagagaggagttcagagatttatgtattatataatacatcataattatttttatttaaataattatttttatgaattaataaattagaaaagaatcatttgtattatttacgtgtatatcttccacctgaagtatgtttggcaatacattctctcagctttcttttgtctgaatctgtctttatttttgaaggagttttaaaattggatatagaattagacatagaattttaggttatagctttttttgcattgtttttgtgagaaatcagtggtacttcaagttattgctttcctatctgtaatatatcccttttctctggctgctttaaagattttcccattatcatttgttttcaacaacttgattataatgtgtcttggtgtttgagtctgtgtatttattttacttgtgatacattgagcttcttagagctaaggtcttgcagcaatccagggagcatttattcaagaaaaatggctgatttttggtaaaaaatacagagctttgtggtgctttaacttgtcctattacaatcccctccttctccaactccatagtagccttgaaaatcaacagcccataaatcacgatgaaaaccagcaggctggtagccacatgagagggaagaatagggttggagttccttcaaatccccattcctagagacttttattatttgacttgtctgattgttctctggaacatcccacttatggggctgtctttatttgacccgactcagaggtcatctaatgtgaacaggcttttccttaggggtgtttgttcaaaatgatgagaagcaaatgttgaaatttcaactgcctgaagcactgaataatagttgtggcaaacagtaggctaaccaaaaggcttaaaagaaaatgctggggaatgatatgttcataggggtctttggaaggctccagcatattcctcagaacctaaaaggtcacatgcacgtgtggggttgtttacaagcctagagcccatactcaggaaaggcctcaaaggtcccacctttggctttttgcttttatggctaatcaacaggttctgcacaagcaggaagtgaaggctaaggcagagttataaatggcctgttttagcattgcctgttgaaagcatgcctagacatgcagagttcttcagcaaagactggtaaactcattgattccagacatctaaggaagtctgtgtctaatcattagctgaccactattgtaactgagcagagatttcagtggcaaaacattacaaaatatacagactacagaattagttcaaaaaagtcactaaaccactaccaatactaccaccagcaaacagtaacaagcagaaaccacagggaaggaggggaatttgtattccaggctttccttattatattagttaaaatatatagttttcaacagaaaattatgagataaacaaataacaaagtatcagggaaaaaaagcagaccacagaaactgttcccaaagaagtttggactttctgaaaaaagactaaaaattagctattttaaatatatttcaggaactaaaggaatatatgagaacaatatctcaccaagtagagaatattaaagaaagatagaaatgataaaaggggcaaatagaaattattgagttgaaatttttaataattgaaataaaaaattcacttcagaagcaaagttgagtaagcagaaggcagaatgagcaaacttgaagataagtcaattgagattcagtctgagaagcagaaagcaaaaagaatggtgaaaaatgaaaaaactcagagacttatgggacatcatcaaaagtgccaacatatacataatgggagtctcagttcaggagagagttagagaagagaagaaaaaatattttaagaaataatggccccaaacctcccaaatttgaggaaaaatattaatctacatatccccaaagctcagtgaactccacataagataaatacctaaaaaaaaccccagatcataatctagggttgacagatcattatcatactatcaaaagccaaagataaagagaatctggaaagtagcaagagagaagtgactcatcatttacaagggactttcaataaaatcaacagctgatttctcattggaaaccctggatcccagaaggcactgagatgatatgtttaaattgttgaaagacagactgtcaaacaagaataaacaactatccttgaaagatggaggtgaaattaagacattcccagataaagaaaaacagaatttgttactatcagacctttcctataagaaatactacagggactccttcaggctgaaatgaaaggacaccagacagtaactaaaattcatatgaagaaataaagagcaccaccagtaaaggtaacaatataagtaaatataaatgtttaaatgtagtttttatttataacttttttctaacagatttaagcaataattgcataaagcaatgattatataactgtgttgatgggcataaaatatataaagaggtaatttgcatgacaacagcacaatagtgaaggggaaaatggtgttaaataagagcaatgtttttatatgctgttgaaattaagttgatattaatctaaactatattgttataagttaaggtattgtaatttgcagggcaacaactaaacaattaagttaaaaaatagtcaaagaagaacagagaattaaaatgctgtgttagaaaatattatttagcaagaaaaggtagtaatggaggaatagaggaacaaaaaagacctaacatatgtatatagaaaacaaataactaaattttaccttatcagtaaatacattaaatataaacagatagaacattccaattaaagacagatattgggaggcaaaaaaatcatgattaaactatatggcatctgcaagagacatactttagatttaaaaccacaaaaaggttcaaagttaaagggtggagaaagacataccacacaaattgtaaacaaaagagctggagtggctttgctactatgagacaaagtagattgtaagacaaaaattgctaccaggtacaaaaaagggtattttatattgattaaaaaggtcagtatatccagaagacataagaatgttacatagccacagagccccaaaatacatgaagcaaaacctgacagaattaaaggaagaattagaaaaatctaacaatatatagtcagagactttaatactgtactatcaataatagatagaacaactagacacaagatcaacaatgacagaattgagcaacgctataaaccaagtagatgtaacagacatctatagagcactccaccccaaaagagcataacatactttcttctcaaaatgcacatggaacatggagcatatgtcaagccatatagcatctcaataagtttaaaaggattgaaatcatacaaagcatgttctctgaccacaatggaatgcaattataaattagtaacaaaaagacatttgtgaaactcacaaatatgtggaaattaaacaacacactgataaatatctaaaaggtaaaagaagcagttacaaaggacataagaaaatgctttgagatgaatgaaaacaaagacacaacataccagaatttatgtgctgcaacaaaaacagtgcttaaagggaaatttacagctataaattcctgtattaaaaaagaagaaaaaatcttaacctaattggaataacctaattccttaagaaactagaaaaagaaaagcaaactgaacccaaaacaaacaaaagaaaggaattaataaagattacagtggaaataatggaaacagaggccagaaaaacaatagagaaaattagcaaaaccaaaagttagttctctgaaagatcaacaaaattaatgaacttttgtctagattgaccaagaagaggagagagaagactcaaattactgcactcaggaatgaaaggcaagacattactaccaaccttatagaaataaaaaggaatatacaggaacactatgaataattgtatgtcaacaagctagataacctagataaattggacaaattcttaggcacaatctactgaaatagactcaagaaatagaaaatatgagtagatctataacaaagaaagagtttgggtaaataatcagaaaacttcccacaaagaaaagcctaggcctgcgtggcttcatcagtaaattttaccatatgtttaaagaacaccaattcttcacaaacatttccagaaaaaccccacttatccactcattctaataccaaaactggacaaagacattacaaaaaaagaaaactatagaccagtaattcctatgagtataaatgcaaacatcctcaacaaaacacaagcaaaccaaatccagaagcatataaaaaggtttatatactcattagtaggtgagatgtattctaggaatgcaaggctggttcaacatgttgaaatcaatcaatcaatatatgtgtcattaatagaataaagttaaaaaattttatgatcatttcaatagatgcaggaaaagcatttgacaaaatccagtaccctttcataataaaaacattcaacaaactaggaacagaaggggacttcctcaaactgataaagaacatctacaaaaagcccaaaactaacattatacttaatacttatactcaataatgatagattgaaaacttccctcctaagattaggatcaaacaaggatatccactttcactgcttttatttgacattgtcctggaagttctagccagagtacttaggcaagaaaaagaaattggcattcacattgggaggaaagaattaaaatgatctctctttgtagacagcatgatcttatatctaataaaaattattagagcaaataaaacagttcagcaaatttacaggacacaagatggatatgcaaaaatcaattgtacagttgactcttcaacaatataggtttgaactgtgtgttcacttatatgattttcttctacctctgccatccctgagatagcaagaccaacacctcctttttctctcctcctcagcttactcaacatgcagacaataaagacttttaagataatctactttcacttaatgaataataaatatattttctcttgtgattttcttttttattcttttcttcttatttttagagacagggtcttgctctgtcacctaggctggagtgcagtggtggaatcatggctcactgcaaccttgagattctgggctcaagtgatcctcccaacctcagcctccccgatagctgggactacaggggcctgccaccatgcctggccagttttttatatttttttgtagagacagggtttcaccatttttcccagggtggtctggaactcctgggctcaagtaatctgcttgccttgtcctcccaaagtgctgggattacaggtgtgtgccaccacacctggctaagttttcttttttcttttttgtacagacagggtcttgcaatgttgcccaggctagtcttgaactccttcaacagcaggctattagtagtagttaagtttttggggagtcaaaagttacatgcagatttttgactgtgaaagggggtcagtactccaattcctagttgttcaaaggtcaattgtatttttatacactatcaataaatcattcaaaataatttaataaagcaattccttttttatgtttttgacagggtctacctctgttgctcaggctggaatgcagtggcacgatcttggctcactgcaaacctctgcctcccaggttcaagcaatcctcctgcctcagccttaggagtagctgggaatacaggtgcacacgaccctgactgactaatttttaaatgtttttgtagagacgaggtgtcactatattgcccaggttggaaaggaattccatttaaaagaggataaaaaaggataaaatacttaggaataaatttcacaaaggaagtacaagacttttatctttaaaagtacaaaacgttgtaatgaattaaagaacacctaaataaatggagcaatatttcaggtttatggattggaagacttaacattgttacattgttaagatggtcattctctcctattttatctacagttttagtgttatccttaaaagttcagtggtttttttcccccagatattaacaagctgatcctaaaatttatatggaaatgcaagggatttagagtagccaaaacaagattgacaaagtaaaacaaagataattcacacttcccaattttgaaatttaatacacagctgcagtaatcaagattatgtggtataagcatacatacagagatcaatggaatagaactgagagtccagaaatgaactcagacatttatggtcaattgatttttgacaagggtgccaagacaattcactggagatagaatagtattttcaacaaatggtgcaggaataacttgctattgatatgcaaaagaatgaagttagatccttaccttgtacaatatgtgaaaaataactaaaaatagatatcaaaaacctaactatgagagctaaaaatataattctcatagaaaaaaataggtttaaatttttgtgactttggattaggtaatggtttcagatatgacagccaaagtataagcagagaaaatatagataaactgaacttaatcaaaagttaaaacttttgaatttcaaaggacactatcaagaaggtgaaaataaactcacacaattggaaaaacgtttgcaaatgttttcacatctgataaagctgtagccagaatatgaaaaactgttacaacttaacaatgaaaagacaacccaattttaaaaatggacaatacatttgaatagacattcttcaaagaagtatatgaatgaccaataagcacatgaaaagatgctggacatcattagatactgggaaaatgcgattcaagactgcaatgtgatattgcctaatacctaccagaataggtaaaatagaaaagacaaacattagcaagtattgataaggatgtgtagaagttggaactctcatacattgctggtgggaatgaaaatgttgcatttactttggagaacagtttggtagttcctcaaaaacttaaacacagagttgctatacaactcaacaattccacttctacatatatacccaagagaactgaaaatatatgtccacacaaaagcttgtacaccaatgtcgatagcagcactatttattatagccaaaaagtaaaaacaaccgtatgtccatcaagtgatgactaaagtgttgtatatccatatgatggaatattatgcagccataaaaaggaattaagtcctcatatctgctacaacatgggtgaaccttgaatacattatgctaagtgaaaaaagtcagacacatgtcatatgatgccatttatctgaaaagttcagaataggcacatctataaagatagaaagcagattaatggttgataggggctgggcaatagggatatagtgagtgactgctaatgggtatcgggttttatttggatatgatgagagtattttggaattagatagtggtgacagttgtacaactatataaatgtattaaaaactactgcattgtatactttaaagggtcagttttatgacatgtgagttatatctcaatttttaaacaaccaattgagagacagtatacaaaatacctgatcattaatactcaaaactgttaaggtcatcaaaaccaaagaaaacctgagaacctgtcacaaccaagaacagccaaaggaaatgacaaaaaaatgaaatgtggtatcctggatgggatcccgggttagaaaaaggacattagtgataactgaggaattttgggtaaagtctctactttcgttgataataatgcatcaatattggctcattaatggtgacaaataaaccatactaaggggaagctcatgtaagagaactgtgtactaccatcacaatcatctaagtgttctaaaataaaaagattgcttagaaaaaaggctggccaggcgcggtggtttgcacctgtaatcccagcactttgggaggacgaggcggaggaccacttgaggtcaggagtttgagatcagcctgaccaatgtggtgaaacaccatctctactaaaaatacaaaaaaattagccaggcaaagtagcaggttcctgtaatcccagctacttgggaggctgaggcagcagaatggcttgaggtgggaggtgaaggttgcagtgaattgagatcacaccactacactccagcctgggcaacagagttatccccgtttaaaaaaaataaatgacagaggaaaaatataactaagagcctattgtattattcgacatgaactcctcgagataaatacaatcttgaagctccttctaactttagaaacctgtgatttcttgcatagtttggctagttgagttttgtactgtaagttccaccggtcagcttctcagccagacttgggtaatttatgtccagggtgacaggaagcactgaggaaagagcgttctcatcagtggtgatgtaataatatgtacaccaaaccctcatgacacatgtttatctatgtcacaaaccttcacatgtacccctaaacctaaaattaaaattagaaaaaaaagagtctctttctcagacccttccaaaccaacatgtgtgaaacatagtgagttgtccttttaaacttttatcatatcatgtaaaggtgatgtactccacaagtggcaggtatttactgagtgcctgtcatgtcaggcatctgggagagactagggtgaagccaggcacaaaaccacacattcaacagtgaattgcatgcatgatgtattaccattattatagtgagtatgatgaagaacaggatgttttgagagcatataacaggatctcacctgagttggcaattggggaaggtttctgaggcagggcagtgaagccaagaggaaggacctgtaggagaacctttggtgaagaggagggatgggcttttccagcagggggaatggcattgggatgttcccatgtctgaaggggacaaggagttgggaggaactgacaaaagaccactgaggcctgaggtgtggaggcaggtgctgcatgggcagttggagagggaagatgtgagattactctgagaagtagaaagggagctaggaaggcattgaaaacttttaagcatggcggtgtctgggctagatatgtattaaaaacaatactctgggccaggtgcggtggctcacacctgtaatcccagcactttaggaggctgaggcaggaggattgtttgagccctggagtttgagaccagcttgagcataacagagagaccctgtggtgtgcacctgtagtcccagccactcgggatgctgggaagatcctttgtgaccaggagttgaaggctgcagtgagctgtgaccatgctcctacatacagtgagtatgactgtactcctgggtgacaaaataagaccccatctcaaaataaacaaatgatactctaaatgcaacatatggaatggattttgggagcagtggtggagtgggagaccagttacaaggctaactgaatagccttttaaccagttaaaaggctaacaaataccaaaggcaaaaagtgatggggtggtggtgggggacagaagttgagttgagaacaaaattaagaggtggaattaacaaaaaagtttatggaggataaagaatataatttatagatgctgataaatacagaggtagctgtactaaaaaaaaaacctaaagtatttgttaaaaaacaaaagacaaaaccaccaactaaaacaaccaactaatcaacctaagattaaattaaaaccaagacccaggtctggaaaaaaaaaaaaagatcagctttaacaagtgaatacatggtatttttaaaaacacgattattccttcaaaatagtgcctacagtgtctttcaaaaagttgcctttctctttttcaaatcgtgtaagatgtgtcatataagatttgggtgttttccctttgccgatggttggagagtggtgatgtgtcttgcgaaattaaaccacagagaacgtcgatttgaaactttcggagtttcggagaaactggccctagctcagctgccagtgaccagtgagatggattcagaatgttgtcctagtgagggtgctcagtgacaacgcaggtcagaggcagggccggctgcgactccacagacagactcacagccacagcgtctacaatacacacagctgctgcctggctgcgtgacaaaggtgtcttggcagaagcattttggctgtctgaaatacagcctttgcacaatcctgagactatattttacaagttcattttctaacatccaggcacgcttttatggcatctggagcattttgctgaatgacttggtagtgcactgctgaccagacagcacatttccagatttagattataagagaaaaacagcaagtggtaagttcagctgcaggtcaatggatacttatactacagttccctcactgagcactgggctactttatcccatggggaccaatcctgtaaagtgtattcaacagagatggccctaggtgtttgcttttatggttgttagccacattcacactgggaatgtgctgttatcacattgtaaacattattcttaatatcagaaagaaaactggggagagtgtcaagaattggcatgcacaaactgatagaattgccagtggacgttcttattttctgagcatttatgagctgcaggaggtaggtgcagtctgtaaaacaaaggtggtgagaaacattaaccattttttattgattttatttcaaactgtgtacatcttacacgttttaggttctttgtaatgttgggataatttggaggggacataatgatgttcactgacaaatagctttctgaaaaagtcaggagttcatacattatcctgcattgatgaaagactttcagcctttcaaagcattattagacttactacttaaaatttttgcccagcttgttcaattttactcttaagaagaagggagggttaaaaaaatagtagtattaaatatatgaaatcttaattttaaatgatggctgtcatcaagtgtgccctcaatgagaacaaacatttttatacatttgtactagagatgcccagtattgcttgctcaccctcagtccctgttgtctttaataatcgtgttatatacaacacaatttcaccctgtctgttccttcagcctacccctgttccataccttccccagctattagacttgggtggtcccttgacttcacatccagaaatgtctacagctcagactgaccagttaccaggttctgtgtgcactggcctacacagatattatgagtccttcagaatcagaagatgggaaactgaagcctatgccagccaaccaaaaaggtcataggtagactgatagctaaggcagccattttggtcatgtgcaaggtatcagttggtaaagggaaaaaaatgaaactcacatgtagagagagatgtgattaaagaaagaaaagaagtaagtaactgcctgggatcctgatagtttctgagccagacctaggccatttatctttaaaataaatcgactttttccttgaggtaacctgaatgaggctcaatctttacagccaaagaaaaattatccttatcagtgatgtctgcctggtggctggtgaatggtaaaaactggcaggagagaccaatccgatgggaaatcaagttcaggtaggaaatttggttttaaaccatagagaatatttaagattgctacttccttattcagacctggtcactgtggagcaatcatcattactcccatttatccaaggcatagctgtacataagttttgtctcaccttgggtgagatttccttaaaataaaatactataatcataatggcttacttatgctttggctttcataaaacaaaacaacaactatgcaaaacctacctgtgtcctctgtggttggattgaaaaaaaagggggtaggttgtgaaattaagctgaggacgtgaccatgtgtctgatgactaagatggaacccatgtaggagttgagtcagtaataacatgcctcttgctgcagctcaagttgcctgcaaacccccacgctttttagcaaatattattttgaatgtcagagtgcacagagccgttctctagggttgggctaaatttgactctgtgggagaataaacctagaattccaaatgtggtgatcccaacagagtatgtgatgcaagaccaattttccacttgtgccgggtgggtttgttcaaatctcacacagaaatgagagatgccagacggggtgttgacttgccccaaacataaggtagtaatttaggttttattttaaataagaattagagtctgggtaatccaaaattttaatttagaaaggagcctgggagaatggcagaagacaagagctaggcagccctgtgaagaagggttaggagtggagcgatgaggcctcgtgtgcttcagtccagttctggaagagctgatttgtagtaaaaaagaggcaactctaaatctgtgtcttagcatggttttgtagaaaagcctaaaggtgattctgggtgctgtgatttgaggtagtagtttctttctttaatgtgcagataatagagtaaactttaatgattaaagcattataagctgactgcagtgtttaaacactgacccagtttcagcagtgacctaataagggtggcctgggagaagggggggctcaggggcagcttggaagaaataggtcaaaaggatttctcccagttcttctcaggcagacacaatgggacttggcattctttgtgcaaagcctggcggttgcatgaagaattttctcctgaaatgctcctctatgcaatttactcttggttcaagtcgatgcttgtgatgctgggtcattcttttggtttgaggaggatgtagtgtattcattcaacaaatatttattgagcacctactatatctgaggtaccatgtggatggctaagaatacagtagtgaataaaacagtgtctgttctcatggagcttactttctagtggagaaaagcctgagttcaaatcctgactcaatcagttatcagcttggtgagttacttaaccttgggtaagttaacctgtctgtccctttggtttccatatctgtaaaatgggatgacaaaattgtacttaccccgtaagactgtcatgaggattaaattgaggccacacatgtaaagagcttacaacaatgaatgctttgtagcaaggacttcatataaacaattacatgtcaaagtgagtgaatgagctttagttgtccaaagatggaagaacaatgaaaacattcatatggaattctcatgggtctggaataagcatttaagcaaggccttctactgaatatggctatcaggtgtggagttcaaaatgtgtgaaaaaccaagagacccagaaaccctcatttaagcaaacagcctttgaaacagaagcctgactttagctatcacattcatattcttatgccaagagagatcctgcatagaattagtaggtaatattaaaactttggtttcttttagggagggagatgttacccttgtcccagtggaagacttgtcatgtgaatttgctggtagcctccctggggttgtgagacattgacaccacattatactttgcatggggaagagtgatttgctaactcagtttttatatgatatcctgagaaatctgtgatttctcatcctgctgtcaacgtgcattagactgttggagctgaactgtcactccaccacctttcagctcaatttctttatctgtaaaacaaaagaagctgaaagagtgaccttcggttaaagccataggaccctaggaaccagtccttcataaatttatgtccacatagctgagatacctgcaatattgcatcccagatatcaaagcacacatatctcactttaagttgatgcttactcatacctggagtagatgctgatgggtgttggttctgttatgtctatagacatgatgctctttaaatagaaaggcatttgttcatcccagatgcttcagtttgtatggtcttctcccttgagatttccaaatatggttctggaggaaatgggtacatattctttctttttggagcaaaggctttttggaacaagggccatgttgctgatgaaaatgttatattgggtctcatggcaattcctttattgctttcttgaccctgtgtcattcagggagtgtcaaaaaccacatggtgcttctgagacctacaatttttgcatttagttctctgatttagctgacagatgttaaaacacagatatagccagataactccccagtgacaacacagatgcaaaaactgaaaagtgcagttactccagcttggggagggattatattggatattcaaaattttccctactgaagcccttacatttttcatgtgtttctgttaggctaatgtggcttaggttagaggaaactgagtctctttccttctggttgattcaatcattcatatcctcaagaaaatgtgccaatctggagctcaggagatcctgagaatattaacaataacagcaggctcaagtctcttttatggctggcagggctctgacagaacaactttgggtctgaagagaaataaaacaaaaaagatctgagatctggagggaaatttcattgggacttacccagtcattttatggattaggaaatacgaggcctacagtgactttctcggggtcacagataggagtaacagaaccagggctagatctaggtctcctaacttgcaattgagtctttccccattggttcctggcctctcgtgtgtcccctgcatctccctgaggtttacccttgagattggtgttggggactgtgacacatggtggaggctgcagtagggcctctggctctctccagtcttgggcgtgcctcatctcagcccattgcctttggggaaatgctagccacaaacatagtgagttaaattcttggactatcagatatagctcagactttcaagatgataaataaagaaactgaggttcaaagagggaatgtgactcgctcagcaattcagaaaatcaattaacaaataattatggagcacttaggatgtgccgggcctgtggaaactgctggtgggtgggtgggtaggtgggggcggggggcggcatttgactaagaataagacagacaggttcttaccctggaagaatttaccatccaggaacaagagagcaaacagccacaagtgggaggaatatttagaagcgaggagtccccttggagaacttgacctggtctgacaatcaggagcagactcgaatcttctgttccctctgtcgagatgcctcgtctctctaggtcttgctgacttgaatgtgtgtggagagttcaaagccaggaaaggatatgtttgaggtaacctgctttcctaccctatttagattttaggttaattttaaaaatgtttcccttttgtataagattattttgatgcttttagaccctatcattaccctattatttattacactgaagaatctatttaaatattggcctcactacaggccaccctcaaagtgggccagttcttagggctcataggggaactatgacccagtgtacccctacagaaaagccactgtctccatggcttctggttgcctctagatagaaatctaaaagcccactgatgagtttgtgacatttagcaattgccaacctttgcctagactaccatcatgtgtcctgggaagatgcccccttcctgatccacagacctcttttctccatgttgtatttctcgggatttggaacttttctagatgacagttgtttttcttgctcaaagggagggtagcatgcctttctctgagccatgttcccccgcccccttccacttagagcctgcctctttctgaccagctccacctgcccctgcagcagccctactgccctatgtaccagctgcaactggttttgtgtatgattatgtatttaaaacaatttgtgttcctgtctcttttcattatgtccatcctctctactcctctggattacaagtgtcgtgagaaggggggttgaggctcctatttcctgtagggcttagattactgaggcgcagttggctggcggctgggcagactgaaccctgctgttcaaaggcagatgggagagccggggcgggggatctgagccaccagcccagtggtccagagcagttgtctgaggcaggacaccaggctgcaacactaatttgccatgtgactctattttattttattttatttttgagacagggtcttgctctgtcacctaggctggagtgcagtggcgtgatctcaactcactgcaacctccacctcctgggttcaagcaattctcctgcctcagcttcctaagtagctaggattacaggcatgcgccaacgcgaccagctaatttttgtatttctagtagaaacggggtttcactatgttggccaggctggttttgaactcctgatctcaagcaatctgcctgcctcagcctcccaaagtgctgggattacaggcgcaagccagagcgcccagccgccatgtgactttagactggatttcagtttccttgtctaagtgtctcctcatgtcgggatcctgtggtgtgatgtctgggagagtaccctgaacttagtacttaaagtattaagactatgtcataatgtctcattcttagaccctgtcgagtatgtgtagggccggaaaatgtccttcaggcttctttgagttgggtctggatcctgaaccactaggttttaatccttgtcctcatcagagggacagacagtattgagtgacccaggggacaaagtcaaaatggctgtgggcactggcaagagaggaggctctcaaataaggaaacaatggcatgaaaaagttttaacattatatatatatatatatatatagttaatacacatgcttgtatgtttttgtgtatgttcatgtgtgtatgtgtatgtatataaaagcatcaaaattgatatatatcatagggaaaaccaaaacttggtaagatttcattttacccgttttacagtctaaaccttaaaactgcttgcaattttaattatcaatgaggaatggacataataatctgttcagtgctcaggggctctgaagcccttaaattcttgatgtaggaactctccctccaacccagagtgccagggttttgcttgccacctcttctgatctgtccttaccttctccgtgttttccattggtgaagatacatctatgtctcagctcaagccctgctcccattgcattggaacagtgtgtagctgtgcacactgtccacacttaagaaagggtgatgccagactcaaaaagccttggggaagagaaagctcatcccctttagatgaaagaaatcctggagtgaggccaggtggaatattctcaagtcattcctgatgtgtcatttgtctacagcagagcaaattatggctgccttttatgggcatttgaaaggccaaaggcagcgatccactctgagtatataccccaaagaattgaaagcagggtcttgaagagatatttacatagtcatgttcacagtagcattattcacaatagccaagaatgttgattgcaacccaacccaaatgttcattgacagatgagtggataaaatatggtatgtacatattctatacatatgtctacattaggctaaatgaattagccagtcataaaaagataaaaactgtaggattctagttgtatgaggtacctagagtagtcaaattcatagaaacagaaagtggaacagtgattgcttggggttgtgggaaggaggaaatggagagttattgcttaatggatgtggagtttcagctttgcaagataaaaagagttctgaagattgcacaacagtgtgagtgtacttaacactaccgaactgtacacttaaaaatggttaagatggtgaattttatgttatatgtattttaccacaattaaaaacaaacaaatcctaatgcccaggctgcaccacagaccaattaaatcagaatctctgtgggtggctttcagatatccttattttttcaatttccccaggctaagctaaggtggagaaccactggaccagaggcaggaaatgcaatcttgaggtggtagctgtaaaccaggggtgaaatgaaaagaatggaatcacagggaataaaacaaattggatggtttggacagtcagtcttcagcgatagatcagatatggaacgaaggaaagaagaaggaaaaagaaaaataatggatcaaagaagtttccaagggcctagactaaattgtggatttatggaaaaactgaatgtttattggtaggtgttgggagtgattatttattttagtttatggtaatgcaggtagaaatttcttagaggcagctggaaattttcattgccaaaattattcatgtatttcccttgtagaagccagagtttcattttacagtaaaaatgaacttttaaaaaaacatttgttcatttatttgtttctttttaagtgtttaattgttagaggcagctggaaattttcatactcaaaattattcatgcatttcccccatggaagccagagtttcattttacattaaaaattaacttttaaaaaatatttgttcacttatttgcttctttttaagcatttaacggacagataaagagtgaatacattaaaattatacaacatgatgatttgatataagtatacattgtaatgattatcataatcaaattaatgaacacattcatcaccacccatgctgtacattagatccccagaccttgttcatcttataaactgaaagttcgtgccttttgatcaacatcctcccactttctccagtcccctggccctggcaaccagcattttactctctgtttctatgagtttgacttttttagattctaaatataattggggttatgcagtatttgtctttctgtgtctggctcatttgacttagcataatgtcttccaggttcatccatgttgttgcaaatgacaggatttccttcttttttatggcagaataatattcgattgcatatatgtatctgtatccattcatctgttgatggatgcttaggttaatcccatatcttgggtattttgaataatgctgcattgaacatatgattgcagatatttttttgagccatcgatttcattttctttggatatttttatccaaaaaaccccaaaacaacaacaacaacaacaaaagaagaaaaattgcccagggagcattatatcttcaggagccaagaataaacctagtttcagagttccttttggcaaagccatgaagttggagagctttgtctgtggcaatccttctcttgctgtctcctacctgcctctgaatgttctgtgggcctccactttctcaggatcccattcaagtcacattgccctgttcctcctctctttctagaaattcctggtaaacaagtaaatcccatagtaaacaaatttgcgtgaaggcaatagaaactcccacactattttttctaagagcattcacatttttaaaataaatggaatgaagagatcaatacttattataaaataataaaactagaatggtgatatttcaggaaggagaaattttggataagattgccatttctggcctcttggaagcacctctgtaaatagttctgcttaggtgttcagacctgggtgggcaagaggggtattcagtgatttgcatggacccagagagtcagcagatgggtgctgggaggaggatactgagtcacatatgtggtctagacatatggatgatgggaaagaaaagtcatttatgacattaaatatatcaccttccagtgccactaaatcatgttttctgagcagagcagagtcacagctccctactttaccctgtggtattcagcaggccaaagatttaaggaaggacttaaaaagtgtcctttggatgccttcatcacagtgcctgaaattgcatgctgtgactacaagcctttgtcatgtttactgatatggtttgactctgtccccacccaaatctcaacttgaattgtaactcccagaattcccacgtgttgttggagggacccaggggggaggtaattgaattatgggggctggtctattcttgtgatcatgaataaatctcatgagatctgatgggtttatcaggggtttccacttttgcttcttcctcatttttctcttgctgccaccatgtaagaagtgccttttgtctcctgccatgattctgaggcctccccagccacgtggaactgtaagcccaattaaacctctttttgttcccagtttcggctgtctttatcagcagtgtgaaaactgtattagtctgtaatacagtaaattggtaccagcacagtgaggtgctgctggaaagatacccaaaaatgtggaagcaactttggaactgggtaacaggcagaggttggaatagtttggagggctcagaagacaagaaaatgttgggaagtttggaacctcctggagacttgttgaatggttttgacaaaaatgctgatagtggtatgaacaataaggtccatggtgcggtggtctcagatggagatgaggaacttgttgggaactggaacaaaggtgactcttgctatgttttagcgaagagactggtggcattttactcctgccctagagatctgtggagctttgaacttgaaagagatgatttaaggtatctggtggaagaaattcctaagcagcaaagcattcaaaaggtgacttgggtgctgttaaaagcattctgttttaaaagggaaacagaggataaaagttcagaaaatttgcagcctgacaatgcagtagaaaagaaaaaccaattttttttttaaggtgaaatttaaggcggctgcagaaatttgcataagtagcaagtaacctgttaatcccctagaccatggggaaaatgtctccaggccatgtcagagaccttcatggcagcccttcccatcacaggcccgggggcccaggaggaaaaagtggttttgtgggccaggcccagggtccccatgctgtatacagcctagggacttggtgccctgtgtcccagccgctccagccttggctgaaaaaggccaacacagagctcgggctgcagcttcagagggtggaagccccaagccttggcagctgccatgtggtgttgagcctgtgggtgcacagaagtcaagaattgaggtttgggaacctccgcctagatttcagatgtatggaaatgcctggatgcccaggcagaagtttgctgcaggggcagggtcctcgtggagaacctctgctagggcagtgcggaagggaaatgtggggtttgagtcccctacacaaagtccctactgggacactgcctagtggagctgcgagaagaggaccaccatccttcagaccccagaatgtcccgtcagcttgcactgtgcacctggaaaagctgcagacactcaacgccagcctgtgaaagcagccaggagggaggctgtaccctgcaaagccacaggggtggaacttcccaagaccatgggaacccatctcttgcaacagtgtgacctggatgtgagacctggagtcaaaggaaatcattttggagctttaaaaattgactgccccattggatttaggacttgcatgggccctgtaacccctttgttttggccaatttctcccatttggaatggctgcatttacccaatacctgtacccccattgtatctaggaagtaactagcttgcttttgattttacaggctcataggtggaagggacttgccttgtctcagatgagactttggactgtggacttttgggttaatgctgaaatgagttaagactttgggggactgttgggaaggcatgattggttttgaaatgtgagaacatgagatttggaggggccaggggtggaatgatatggtttggctgtgtccccacccaaatctcaacttgaattatatctcccagaattcccacatgttgtgggaggaacccagggggaggcaattgaatcatgggagctggtctttcccatgctattctcatgatagtatataagtctcacaggatctgatggatttatcaggggtttccacttttgtttctttctcagttttctcttgctaccaccatgtaagaagtgccttttgcaggcgcggtggctcatgcctgtaatcccagcactttgggaggctgaggcaggtggatcacgagatcaggagttcgagaccagcctgaccaacatggtgaaaccccatctctactaaaaatacaaaaattagctgggtgtggtggcagatgcctttaataccagctactcaggaggctgaggcaggagaattacttgaacccaggaggcagaagttgcagtgagctgagatcgcaccattacactccagcctgggcggtagagtgagactctgtctcaaaaaaaaaaaaaaaaaaacaactgccttttgccttctgccatgattctgaggcctccccagccatgtggaactgtaagtccaattaaacctctttttgttcccagtttcaggtatgtctttatcagcagtgtgaaaatggactaatacatttactttggacaatttaagcaggaaagtccaggctactcctggaaatgacgataacaagaaagagacaaagcacctgaaaaagcatgtagagttgttgagcttttatctttctttctggttcagcatctggcatagtaggtgctagactgacacttgttgaatgaatggaggtatagtagaaatagcttctctgggattaattttatggtttgtagttttgttgcactatgtatgggtggcatgttgaaggaaaaccctgaaggcctagattccagtcccactttcgccactcattacttctgtgacattggcccagacactttgacttctctggatctcatttcctacttgtaaaacagggacaataatgctgtccttctcatgcacatggttgttatttgcattaaatgagataatgggcatgaaagcaatggaaaactcttaaggtactctacaaatatagaatataatcattttgaaagcacctggctttgtagacaactgcgtgaactaatgtatattgatcaagacatgtgtctcgttaggtaaaaactgaaagtaaaactcatacacttaagatgtgaaaataaactcagcatctggcgtaacactaatttcaaaaagtagtatattaatttcaagtaggaaattaaaacaataaaactgtgatgtgaaaaatgttcaacattgatgcctctgacctacttctgatgtccaacatatttacaattctcccgaagacatttctattaggttaaaacccattagtatttgtgaacaaacacagagtttctaccattcactgggcactattaggtactaggtgtccggggatatttctattgctgttcttagctctattgttggtttacttggccagtggttgctagctttgccagtgtgtgtgtgtttgtgtgtgtgtgttacttatcacaagtttcgttagcttgacaaagagctgtgtatattcatttacatgacaaatactttttttggattagcaactctaataagtacagggtatttagaaactgtgtgtgtgtttttctacctgcagtcgtagtcttaagtatgtttcttaatagctattgaacataagtttaatattagctggatgaataaagtattagttactgtattctcttaaaaatagacgtagctttgttacagcacagaaaactgagctgacctcttactagattggctaaaatgaattctgattaaacattttgtaatggtttataaagttcgcttctctacagtatattaaaagatttgtttaaatgttgactgtaagtttggtaaaaatgacaaagcggtaaaaatgacatttggtaaaaatgacaaggcttacactttttgatgatgttcattttccccaaaagtacagctaaagctttatccattataatgagagttcagaaaaggcaaatgaccacctctttttttaaaccaatatgtctttgtgcagtaattttcttgtggcaagtggcataatctgggcgaaggtagtgataaaactcagatatatttcaagaaagcgagtaaacacactaatgacaatattcgtatattacatgcatctgctgcttatgtacttaaaaaaactaaataggaaaatcttactcatctctgtagaaaaacagggtagagattacaacttggggacttcgtgatattttgtctgtgtgcagtttgtcagaaggcaatttatctaaagctggaaaaggatatggtttggctgactaaactgtgtagtgatacgagtgatacgtaatgataaaaatgcttaggggaattttcggggcgctcaagtcaagtgtacagtgctgtgtgggtgtaaaaaccagacttctctctctgtgaaagttgctgacattttataccacatgctggaccgttaaatcacaatttacgtggtcacttgtaaatacgcctggtggtggagggcgagcttgtttgtgcacactttgacatgcttccctgttgtgtgcctctcccctttttaaattgcactggatacttttgttctggaatccttggctgtctaacctgaaagcagtttgggtgagaactctggaactgatttattttcataggtgctccctgaggggaggtttgaaggataatgcagaaaagcaagccttccaatcctccaactaaagttctctaacttgctattaacatgatttcaggcttgctagagtgcccgaaattctgacatgaagggattccttcttccaccactgggatttggaagtccctaggatgtttgaatggggcatattatttaaactcattttcagtctcctcattggtaaaatggggctactcatacttatcaaagagggtttttgtggagatcaaatgagacaatgcaagtcacttacttgatatatgcttaatagtgacaaacatagtgatatatatatattaatagtgatagttattgcaatttttctttttgttagggggaagaggaggacaaacaggcctttaacatggtggagaatttgtttcccttccaaatacagttggaggattacagaattgatgctcaaagagaaggctttgctttcattgcttaagagggtttcttggagaggttcagcaagagaaacacaaaatgagatgtagaaaggggatggggaaggagactgcatactaatgtgtttcatttccaagtgctttaacttttctaagcactaagtcatctgctaacttgtcttcataatatatgggtaaagttggcagggtgggtatccctttctacgggtgaggaaactggagtgtggacagataaactcacctgttgtcacacaacaaatcagtggtacagttgggattaggacccatgtctcatactctgagcacagcagtctctctattaggtgacattctcagagttcaataatttctttcacagttttgtgttcagacctggggtccccattgctgagcctattattggcaccttacaaaatatcacatatgagaaaggttgtagtctcttggtccaaaggactactttcacctggagatggttggagttgtagtatctgagttagataagttttcacttcacggtcatgggtggaggtctttcttggacttgggccaggaagaatcactgaccaggaaggtcacacaaggcctgagtcctttctaacaccatctgtgcactgtatttcagggcctagtggctgcattgaaaggaatggaaagtagttgctggttatgttgagaaatatcaggaaagtgtgatgcctttctcctgtattccctcttccctccctcattttttcactttattgataaaaataatcccaaaagatcagagaggggttctataggtgttaaaccactgtgttatgacttgaactacaaagcccttgggggcattcaatttcctcatgttttggggtagcagcaaaatttaattttaggtagaaaagggttaacttaggggcaatgtaattcccaaattatcagtgtgaaaatcatctaactgtatgtgaaaaatccaataatgttaaaggtaattatctgggaaagtaaaaataatacacaggtctttggccagaaataaggatttggaacatttctctatgcatagagagttctctagtaggcaaatttagattcatgtcagtcattaaaggtccctgtgaagtatttagtttatcaatttagcgctacatttttctacaaagaagagttggagtggtttaggtaagaacacagatatgctaaaaccaaaccagatgaacccaagacagaaactagaaagaaggcagaaggagaggatgaagatgtagcagtgagaagcctgttggaggaaagtttgagtcagtgaatgtaagcactttagcttccttgtggcctggagagcaggtattttttggctattttctttttttatacatgtatctccagcactagaagagtgcctgacctgtagttgctcaatcaatacttgctgaataaaaatatatgaaaatctgtcaaataaagggtttaaaaaagctggactaaaatgttgaaaatgattaaagctgggtgatgggttcatgggagtctactagactattctcctctacatttgtgtgtgattgagaaattttataacaaaagcttaaaaaaataacaaagaagactagacactgtaatcactggaaataaccagacattaaaaaatctttgtttccctttttgttacagggcaagcaagtaaaaagacattttatattactaaacactatcatatgctagacagtagtaaaactatagtccccaagtttatctttgaaggactccaatggcaagatttttaataaacaaagctgatcatctcatctgtatcattatttcttattatcactctattatcatggactcccaggaatcttggagatgaatttgttcacctcctctaagaggaatcatcatcattgtccactccctgtcagcacttttttttgagatggagttttactcttgttgtccaggttggagtgcaatggcatgatctgagctcactgcaacctctgcctccttggttcaagtgattctcctgcctcagcctcccgagtagctgggcctacaggcacgtgccaccacgcctggctaatttttgtacttttagtagagtcagggtttcaccatgttggccaggctggtcttgagctcttgacctcaggagatccgcccgcctcagactcccaaagtgctgggattacagacttgagccaccgcacccggcccactatttttttttttttttttttttttttttggagacagagtcttgctctttcaccaagactggagtgcagaggcacaatcttggcttactgcaaccttcaccccctgggttcaagcaattctcctgcctcagcctcctgagtagctgagattacaggcacttgccacaatgcctggctaatttttatattttctagtagagacggggttttgccacgttgaccaggcttgtcttgaactcctgagctcaagtgatactccagcctgggcctcttaaaatgctgggattacaggcatgagccactgtgcccgacccctgtcagcagttttgctcttcccctctctccctccaggccagaggccatgatctacatccaacttctctgcaaattcctgaactctgactcgattgtccctgtcaatcctgcctttgtgtcttccctttgaacctcactttctgattctcctggcttctcttcttgactgtcccttcttgtcttgccccgttcaggtgtaggaacctggcctcagtcctaatgaggctccttcaggatgcagcctctgtgagctgcttttggcttgtcatgtaacagctctggctaggactgtgctgtgtagggagtaccgtccaggcacccagggttgctggtcattactttcctcctggccccctgccctttgggtatgcatgacctgataaggagcttaaggaaacccacattaatagcactaaattaggctctatggaaagagaactccacagtcaggatctttgtgcactcaggacgggaagcatggacaccctggagagcatttgtattaacatgggcatttaaaaaggtcatacagcttggcgcagtggctcatgcctgtaatccccacactttgggaggctgagatgggaggattgcttgagcccaggaattcaagaccagcctgggcaacatagagagaccttgtctctaaaaaaagaaaaaagaaagaaatttactagatgtggtggtgcatacctgtagtcccagctacttggaggctgaggtggggaggatcactgaagcccaggagttcaaggctgcggtgtgccatgattacactactgtactccagcctgggtgacagagtgagaccctgtctctaaaataaataagtaagcaagtaagtaagtaaataaataaagaaataaaatgttatacagttgcttctcattattcatggtagttatggtctgtaaagttgccatgaatactgaattagtgaatactgaaacatcccatctggggtaaatacagcttctggtcacaacagttcctcaactgatcaatacgtaatcttgttttatgtgtatttctatttaaaaagacgttattacttatgtattgttgatttattaacattgaacttagagcctacagcactattcctgaaaagttaattccagaatgaagctaatctaacatacatattttctcctgaggcacatttcagccttcttgcacttagaaacactagtcagaatgttagcactatacttggggtccattttaaacagtgaaatcagcaaaaaaagcacaaaaatgcaaaaaacgtagcacagcaaaaaggacacttgtttatactacaagagctgaaacaagaacacagtgtgttgctttgtttgacctcagctaggaatgtgtgcattgggtgactcaaattttatgcggctctgcgcatgtctgcaaatgtccacgaaagtgctgtattgatttgggggttataaaaaaattttagtgagcaagggaattcacaaatacagaatccataaataatgagaatcaactgtatctccattaagttagcatgatatgtcattatatttaataaaacaaaacatgcaatttactatatgtatgttataaaatatatgtagccatgtaaaatcgtggttcttaattccatatctttgagccaggatatctgagatgataaaattagatttctagatgagctataaaaatttaaaatatataatctcaggctttacatctttaggctgtagatgtttatctacttctgtatactttatatacatatgatatcatatattttaccacatgtataagtgtacaatcttaaatcttcctttattgcagtggaaaaagttgaactgagacaattttcagtgattatctgaaatatcatgtttatatttaaagaatatattaaaatctaaacactataaatctgacctaaaatattttttatttcctccttcaccttggtgaagagttgtgagcagaaggtatatattattattatcacaccataaaaactatttccaaatttacgtctccaatctcttcaaaggacagaaaactttcacatttaaaatactatgaagataaagtgccttagctttaagcaaaaaattaaccattccaagggcagtgatcatatggaatacattattaggagctttcccagagaaacaaaagagaatttagtcaaaattttggttcagcaaaacaagggataggaaaatgaaggtttcagaataggaaggcacactgaactctgcagctggagtttcctcagatgtatttctgtttccctagtctcgagagctgggcttttgcaactcactgttatagggtgattatatcattgtcacttcatcttccatgggtgcagcaggatggtggaattttgggggtggcatgttttcagtgcattgtggtcatgagaagagtccctctttagaaactactgatgcttgatgcagtggtagaaaaaactatccaggaagataaactagggcgatatataatcttttcccgctagccatccaaaattttcctaaatattacatagacaaggaaaataaagcattaaaagtccatctagatactaaggaggagtagggaaagacattacaaaacacaaaataactacagtcatgtgccaaataatgacatttgggtcaacaacagacctcatatacaacactggtcccatgagattataatggagctgaaaaattcctatcacctagtgatgtcgtagctatcatgatattgtagggcaatatattactcacgtgtttgtggtgatgctggtgtaaacaaacctaccatgctaccagtcatataaaagcacctataattatgtacagtacataatacttactaatgctaataaatgactgttactggtttacgtatttactatactatttatcgttatgttagagtgtactccttctacttatattttaaaaagttaattgtaaaacagcttcaggcaggtccttcaggaagtatccagaagaaggtgttgttatcataggagatgacggctcacacatgttactgcccctgaagacttcctttgggataagatatggatgtggaagacaatgatattgataatcctgactctgtgtaggccaaggctaatgtgtgcttttgtgttctggtttttaacaaaaatgtttacattaaaaaaattaaaaaacagaaaaaagcatatagaataaggatataaaggacgaatgttttgtacaactgtacaatgtgtttgtgttttaaaccaaatatttttataaaagtcaaaaaggctaaaaaatgaaagttacaaagaaaaaagttacagtaaggtaaagtcaatttattattaaagaaagaaaaatcttttttataaatctagggttgcctaagtgtaggtgtttctaaagtctacagtagtgaacaatcattactaggccgtcacattcactccccactcactcaccgactcacccagagcaaattctggtcctgcaagctccattcatggtaagtgccctatacaggtgcaccatttttcatcttttatactgtgtttttactatcagcgatacatctctcatcccccagtgtgtggtcaggctcactgagcagattccactgaaaatagtcttcgttttgcacacttaaaaattctttccaaacaagtgtttctttttaacattcccaaagcagattgactttttgagttttgtattgcttccaactctctcaatgtcagaggcctcaaattaattccaacatccccttgctgttttcccttaagaagctgtgatggtgttgcattcactttggattcagtccatttgtgtttattggaaggccccttgaatcagcatttccactgctctcccacatttgtcatggtcctagaaatgcttatgattaggatggggatcttgatagtagtctccatcacctttacttcatcccatggttatgaacagttgtatccagttaaaataagaaagaagtcatgtggaaaaaagggggacaattgaatattattagagcctcaaggaaggaaggaaggccacagggtgaaaaccattgcatattaagtagctaagcctaatagaagccaaaggaaacagcagcaaactgttacagaaaattcttttgaactgccctccgcccactctctccccgctgctgttggtgacacgtggacagaaatccccctgcacgtagacacacatatgcctgccttgacttctgattgaccttatcccttgaacatcaggcttaggccactttcatggattctcatgtgaacgttcatgcctaatgcctgactgcatgccctccgcaccagccactaataagaagaaggaggcttcccctggccacccaagatgaggcagtgcccaccttccctcttgtcacattctattacatcatcacattttatttctctgcctaggacttaccactgtctcgtgtattcattagttgacttgtttattatctgtcttccccaaccagaatgtaattctgcggagaggctctgtctggtttagtgtaatctccaaggcctagcactgtccttggcatggagtagcccccaggaaatattcgttgactgactgactatgaaatggtggaagaggaactttgctccatgagttgtgagtgtatgcacagcacaggtgttcagagtgattttccctcccccacgttcactacaaaaagtaccctcagttacaggcccaggggtaatggcatcaccgcattgttgactcaacttgtaactgacttctagctctgtttctgacttagttttggcctttgggacaggtcaggagggtgcagcaaaaacaaatacaccagatgactagaagctgggatcttgggttgcaggcttggtttcagctctgactcactgtgtaaaccatgggtgactcacttaacctctctaattctgcttcttcatccatcaaatatagaggttagatagatgacacttcagatcccttgtaattcttccattctataatgttcccctttacctttctttaagtgtgagcacagcctagtctcttcatgcaggagtaaacgtacttacaaaatgtcctgcaacacttagggaaatgccaccacaaacattccgagagcagcattgctgtgaactgcaccactctccttttgttccattgaagatttcagaacacatgcttctttgctctgcactttaggaatctttgtacttgaagtggattatcctttatttttatatagcatttaatctgaggatatcaagatttatttgcaacctgccattgagtactattgttttttaaaaaatgaaaggatgacttgctgaaattataagaatcactcatactgtagttgtagctgtgtagctgttgatgctacacattggaaattcagttacaaaatagtgattgattgattgattgattgattgagatggggtctcgctctgtcacctaggctggagtgcaatggcacaatcttggctcactgcaacctccgcctcccaggttgaaacaattctcccacctcagcctcttgggtagctgggactaaaggcgtgcgccaccatgcggggctaatttttgtattttttagtagaaacggggtttcaccttgttggccagactgctctcgaactcctgacctcaagtgatctgcctgtctcggcctcccaaagtgctgggattacaggtgtgaaccatcacgcccagccaaatatttattttttaaattaatacatgcacagcagaattccatgataaacacctgcttattacatgaattaagtctatcacttgccaaaatgtctgagccccacaaatgactgggtctactgagtatgcttcccgacacttttatttttatttatttatttattttttgagatggagtctccttctgttacccaggctggagtgcagtggtgcaatctcactgcaacctccacctcctgggttcaagtgattctccagcctcagcctcccgagtaactgggcttacaggcgggtgccactacgcggggataatttttgtattttttgtagagacagggttccgccatattgcttgggctggtcttgaactcctgggcccaagcgatccgcccacctcagcctcccaaagtgctgggattacaggcgtgagccactgcccccggcgccaacactcatttgctcttcaaccaactgagatttgactctttctctttagtttgctgaatcttctgttgctttataatggctgttgccatctaaaatccaaacttacggtcgtgtgttaatttctatcttatttgatagattcacagcaggtttttgtgccttcttactaggtcccacttggcattcatgctgggttacacatctatgttctgtacactcttttctgtgtacctgggatgtgttctcaatctcatctgcctggcaaacccatttttgaagatactactcaaacatttcatcctctttgaagcctttctgacccactcttcctgtgctgggaacaactggcttctcttttctgaactaatgttatgccaataaacaccagagtaagggaatttattccatattccattatttctttttgcatgtctgtatcacctactgagaattcattgtggataatgattttctttttaatttttatattcttaggcattgcctagtgctctcaataagtatttgttgaataaataaatgaatgaattactgaaaatacagtgacttaatttctggccccaacacttacgttttagaaaggttttgatctctgcctgtgaaatgctctttgaaatggctttctgagtagtaatgggattggaagagttcggagaattccatgtatcctatggtgatgtctggagtgaaacatggtatgaatcaaattgcattttagtttaaattaactcatccaattaagagaagttaattagattaacctgccagcaagggattagaactggtattatgatgactagtttcttcctcataataatgaatgtgaaatttcactaatggagtgaaatttgtgcagccacccatggattgattgaattggcaaaaattcaaataagttaaaaaaatatggctctcattgcttttgactaatttataatttttaattgaaaaaatgatttattatcagtgttaaagaagacttaaagaaataaataaatcactgataaatctgtcatcctaagcagcagatgtttttgagttaaatataacttttgcatacatgtatatttttatatagttgtatcatggtatgtttttcatttttctataggcttcccatatgtgatcatctataatgaatgtatagcaatatttaccaaaatatattctacagaatgctattttcttgagatttaattgacattacttggggataataaaacatcactgaagtcaaataagtttgggaaattataaaagtaaacaaatttcttcactgtagtatttctgaaagcctataatattgtaaaatgcttttttaaaagatgaggatttgacacatattctccaaattaatatttacgtgaaatgttttctttttacactatgaaaaactgtcacactaaaaactgtttagaacatactttgggaatcagtgatgggtagaattctgtggtgctgcaataacctaatttactaccccattcctctactgttggacaaggatgttcaaacccaagtttcttaacgtggtcgacacatccatgtagggtctggtccctcttggcctcatctcccaccctcttcccccttgctcactgtgctcttaacaccttggtttccttcagtttctggaactcactaacctctgcccccatgtcaggcagggcttttgcacatgctaatttgcctcttatagataatagtacttttttttttttgagatggagtctcactctgttacccagactggagtgcagtggcatgatctcggctctacaacctccgcctcccaggttcaggtgattctcctgcctcagcctcccaagtagctgggactacaggcatgcaccactacactcagctaatttttgtagttttagtagagatggggtttcaccatgttggttggccaggatggtctctatctcttgacctcgtgatccacccacctcagactcccaaagtgctgggattataggcatgagccaccatgcccactctgataaatagtacatttatcatgtttccttttatcgaattatttcccaacttactacccattttcaggagacataattagtaacataaagaaatctagtactattggtttcattttgaaccagcactgtgctgcatggcattttcctgtctttccagtaacagccaatcacagctcactattatggatgtcagcctcaacaaaaccaaaagagcaaggcacataatcgatcacaatgccaagaccagtgactttcagatcagttattctattctctctgtggatgagatccattgagggtcggccagatgtcttttttcaggggtttttcagaatatatgtttcatgttgttacacatcattgctcacaaggattttgctcagtgtgacaaggaagtggcagtttgcttgctccttccacactcttgaaggcctatggtgctctaaaggaagtgaagggtgactgttgacctagttagagcagcctcccaagaatgcaaaatgagacctgggggacacacatcctactctgtattttgcagctcatcagtaattttattaggaaagaagatgaaagtatagaaggaataattatcaaaaagtataagtgaccccaaatcatagagtaaggtttttggtctaacccattgattttacagatgaggaatggcagatccagggctgagaccacaacacaacttcaggaggaggcattcgcatagacaatgggatgaatggggccccctggagttgttcagtgggttagccctgttcagagaagttaagagacttgtccaaggtcactttgtaggtttagcctgctgttcttttgtgtttgatgatagaataggcatgaactagagaattacaatttggactggctacagtgatagtctaaaattagtgtaaagccaaaagtataaactcagtttaagttttgaaatgaattgactcaatcaaggtgggggacatattggcttgacagcatttaaattaaaaaagtctcagtgaggagttagttggccataagcactgtgttaggcaacctgaggtctgcagtggtaaagtgatttattggaatcctatgctggagtgatagagacagtgcatcccacacccctgtactgactaggacgcaactgaaattttgcactgagttcaaggagtcatattttttaaagggacaataataaatctttgatctccaaggtcatgtgcagggcacttagtaccaactcaatggatgtttattcagttagtttgttgctaaactaactatgctgtatgtaaagtgcctgacacatagtaggtgcccagaaatgttagtttttattctcttttccggaggaggacaatgagattgctatagattcttgcaaacatgctgactaaagaacccgtgaggaagttaggaattactgtgaatctttgagtcttctaacactgagagcctgattctctgctttatttaaataataataaacaggatttattattaagatctcattggaactgtagaaatgtcagtgagtctccctccctccctcactcccttcctctctttcttcctcccttcctcacttccttccttccttcctcattattgattatcctggcaatgtgttacactctgggaattcaaaaattagtgatttatgattactcttaagggacagacatggaaacaaacacattacaatatagtgtgatagttgcagcaatagaagcacgtggacagcacagatataataattcaattcaacacatacttgctgtgagaacttctatgtaccaggcactgtgctaagctctgagaatacagctgaacacaagacagacacatctcttggggggagatagacattaaataattaattacatatgtggaagtattccacaagctaccatgagaatgagggttgtgagaaaagaaaggcttcgctgaagaagtagtgtttgagctgaggctgaataaagtgtagagattggccaagcgtgaagggaggggaagagaatcccagcgagatgtcaccagtgaacttccctaaagccccgtcatcaagcttccctgaaatcgtttttgtaaagaacctttttttttttttttttttttagagataaggtcttgctttattgcccaggctggagtgctgtggcatgatcagagttcactgtaacctcgaacttctgggctcaagcgatcctcctgcttcagcctcctgagtagctaggactacagccatgtaccaccatgcctgggtaattatctttttcttttccataaagacatgatttcactctgttgcccaggctggtctcaaactcctggcctcaagtgatcctcttgccttgatcttccaaagggctgggattacaggtatgagttaccacacctgctgatttccgtgaaatctaaatgttcttttgcaaagttcgtgtgtgaggatcacttcaagtttttctcatatttgctggagagagaaataatccaagatgcacatagaggtattatagtaaacttggagactcatgcttgttttggcagtgttggtgtgacttacagacaaaatagaaggtcttgtttgttatgaattaaagagtttggagcagatcttccacacttatatggagattcatttcttagggtgactttctctcaagggcatcttataaaattcatgtattctaagaaaatataatacattagcaggagtaagtgtaacattactttttgaaggaagagaaaggaaagaaggggcaaaggccttgttggggtcgggggagtgacctgaaattaaaggataatgaaggggaggccatggaataagataccacatttctctagactcaaactgtctagggctggccttgaggaatgggttaaaataaaatatagaaaaaaaagagaaaatattggaaaccaaaatgatttacatgggtgctctgaattcatgaatcatctacagagaagtaagagtgaaaaatcttccttgaaaaacccactcagtgacacttctctgaccaccctctcctggatgatgttaatcgccttttcttctgtactatctcacttctttgtattcatctcaaattttgcaaatgttacctactgtgttatatggtttgctcgtagtttttgtcttttattcatctctaaactgcttgagattggatttattctctcatgattctcggcacctagctcagtacctgagatttggtactttttttgggtgaattaacgagcaattttgagggaatggaagagagaagaatgatttagatagaggttagacaaaaattaaaatgttgtggaggacagatagggaatgaagtgtcaagataaaagagctatgacaacaaagggggcctgacgcagtttgggccctcaggaggtctctgagggagtgctgttgagttgagatctgaaagacgatcaggcatgtactaaaccaggagaggaaacctaagggagcaacccaaacaagtctcctggataatgatggaagtgagttaagagctagatggaaggtaaaatcaataaggctttattactcattcaacagatgctatattccttacatccctctagctctggagacacagtggcaaatgagcaagtccagcattcaaaggacttacattttagtagagagagatagataaacaaacatgcaatcattatttgttgatggtgccagagataattgacaaggatggcttccagctttctaaattgggcaactgatggatgctgggctatttgcagagacaggaaatgctgaaggaggaccaggtctgtccaggcagggtatggattccattttggacatactgtttaagtggctttgagatgaacaaatggattccaagtagtcagttgtatatgtgggcttgggtttgaagttgtctgggcctgagacacacatctgggagtcagtaacgtatagatggtaattaaaaccatgggggtaggaagagctatccttacaaccactcaaaccaggcacttcaattcatggagagccgttcacatagactgtggtctgaatagtgtctcctgcatttatacagagtggtgaccatgggtgtggacaagatgacctagtgaaaaaatatggagtgagaagaaaagtgagtttctaggactaaatcttcaattacttcaacatttaaaggcccggctaagaggaaagagttcttaagggagagtgtggtggagcagcagagttgggaggaaaaccaggagcgtaatgtcagtgaaacccaaggaagagagagctttgaggaggaatcggatagcagggtcaactgctgctgagaaatctagtaagatacgaactggacacatgtcatctcagctcattggtggcctcagtaaaagcagttttgcaggagtgataaaagtggaataatatggccagattggaataggttgagaaatgagtaggaggtgaagacatgtagacagctgatgtgtcctataacatgacatttgaagaatgtcctcacccagccatgtgggatgagccccaagttgaggcaattcagctcagatggaagtggtaatcttgcaagaaacccaatttggagttgtcgggcttagaagtgattagggctctgagaaatagatttttcttttttcacttcctctgccattttattctctcaaatatgacattgattagaatgccagtgtttgaggtgatgacaagagagtgtttttggaatagggactggaatttccagcacacacattgagttgattctactgttatatttgaatagcactaataaattgggaaaacatggtgcagaccacacacaactgttggaatgtcctccactgatgtaaagattatatgattatattccccagacccttgcatttaaatacaccctactcttcttgcccagtctgtccattggcctttaaggaaataccaatcttgtaatcactctcagcttatgatgtttctcggcctcttcaatggcatgtgggaattagtgtttcctgggtgaaggttaatttgggggaagagtctagataactcagtggctttaggactcatttgttgggaccagaggtcccacatttgcccttgaccttatgggatctgtgggttgtcttttccctttgttgtgggactgccatccaagaacctgttctctgtatctatagcatggagctgtcctccagagtgctctttagaaagagctccaataattgggaattatgcaaatttagaaaagggtatttcaagtctattttcagtcatttcccaagatatttaaaagtatagtatagagaaaaatcgttttgcatttcatataggcttgggatagcccattgtcaaaattcagtgcatgtcacaatgtaattcactggaggaaaatatgctatcaacaggatttccaagcaaaaagcctggcactaattattgccctctctttagtgtctttaactgccagatctaacatgtgttaaccttatacagcatagttgtaacaccaaaggttagtctctcattcatacaaaatttgtgtgagcttaggaattcaccactaagcacatctaagcaatgttaaaagagtgggcatatattcactattctgatataactgcacacagagttggtaacttgaaaagtgaagaatatataatataaatggtaatgtgaaacaaaaaattctactgaagtttatagaatgcaggtgtacctatcaacatcacctgtattcagccatttaaaaatctctcattttacacacacacacacacacacacacacacacacacacacacacacatctttgctctaatcaaatatttccacttaaaattcaaatgtttccttgaaggaagatattgtactgtttcaaagtagagttagagtcaatacagtctttagttttacacacaggttcactggaggctgttctgcctcggtagcagtcactcagtttgaaataaattagtgtttggaggccgggcgcggtagctcatgcctgtaatcccagcactttgttaggccgaggtgggcggatcacctgaggtcgggagttcgagaccagcctgaccaacatggagaaacccccgtctctactaaaaatacaaaattagccgggcatggtggcacatgcctgtaatcccagctactagggaggctaaggcaggagaattgcttgaacctgggaggcagaagttgcggtgagccgagattgtgccattgcactccagcctgggcaacaagagtgaaactctgtctcaaaaaaaaaaaaaaaaaaaaaattagtgtttggaaaagctgtggggtggaacaccttcttactctttgggagcaactgggaaactaaagagaaagagatatgtcttgtcttgaaggaaacttgttgacaattgcttaatagaatgatgataactgaaaaaaatatgtattcgttttttagtctctgaacattcccatctattttgtgttggataggaacatctaataggaacatccactagtagatagaaacatctgctatgtgttcctacctgtgttctctatttgaagttggagatctctcaagaacaagtattctttcaggaaagtaccactgctatcagtagtccttttttataatttttttttgttttattcatgttttcagtgtcacttttacaatgtactcctcttgtattctttctttgaatggtcagatgtcaagcactgtaggagttttggggcaggaaactggtctgctaaatctgtgaactattgcaggtcactgctgctgtgatactttgggaatgaagtcccaatgatacctctaaacagtcacagctgtttgagctctctcagctactgcaaataattcactgacctgcacagttagaactatcaagagttttttaaaagcaatgttgcctgcatagaattgagaagttgtagaagaaaagagagaaggcctattcaatattttaaagatttattatgtttttctgattataaaagtgatactggctgattacagacaacttggaaaagacatattaaatattaaaagaaaaatgttctatttatggagcgtttggatactatgtttttgatgttgtgcatgtgttcttggggacttgacttcatgtcaataaaggacagcagcatctcataatgccactgccattggccttgcacctctgctctgattttctttcctttcacaacatcataaacaaaaccacatgttacttgtgtggtcaagttaaaggaaagaatatctcaccaaaatgaaagaactacaggtgaaaaaaataaacccagccctatggttttcctttgctcactgttatgtttcttgtaggaggcttgaagtggcaaatgtgagccagtggtcatagcttgagctatctgttttctgtatgcactgcatccaaggctggctttcaactcactaaagaaaatttatcccaaacaacaggactttgattttccaagctccttttcaaactcagcttggctttattgatgttgaatatatttattcatggtgtttgcactagtcttggagctgtctgtgtgagtagacctgactacatattgaattatacattattcatttgctataatttctttgacagccattttctccttctaaattctgttgtagaatgcaggtgtacctatcaacatcacctgccttcatccatgtttaaatctctcttgtcttatgcacacacacacacacacacacacacatacccctttgctctaatcaaggatttccttttaaaaattcaaatgtctgggcaaggacttcatgactaaaacaccaaaagcaatcgtaacaaaagccaaaattgacaaatgggatccaattaaactaaagagcttctgcatggcaaaagaaactaccatcagactgaacaggcaacctacagaatgggagaacatttttgcaatctacccatctgacaaagggctaatatccagaatctacaaagaacttaaacaaatttacaagaaaaaatcaaacaaccccatcaaaaagtaggtgaagaatatgaacagacacttctcaaaagaagacatttatgcagccaacagacacatgaaaaaatgctcttcatcactagtcatcagagaaatgcaaatcaaaaccacaatgagataccatctcacaccagtcagaatggtgatcattaaaaagtcaggaaacaacagatgctgcagaggatgtggagaaataggaacgtttttacactgttgatgggtgtgtaaactagttcaaccattgtggaagacagtgtggcgactcctcaaggatctagaactagaaataccatttgacccagcaatcccattactgggtgtatacccaaaggagtataaattatgctactatgaagacacatgcacacgtatgtttattgcgacactattcacaataggaaagacttggaatcaacccaaatatccatcaataatagactgaattaagaaaatgtggcacatatacaccatggaatactatgcagccataaaaaaggatgagttcatgtcctttgcagggacatggatgacgctagaatccatcattctcagcaaactatcacaaggacagaaaaccaaacaccacatgttcttactcataggtgggaattgaacaatgagaacacttggacacagggtgcggaacatcacacaccagggcctgtcaaggggtgggagcctgggggagggatagcattaggagaaatacctaatgtaaatgacgagttgatgggtgcagcaaaccaacatggcacatgtatacctatataacaaacctgcatgttgtgcacatgtaccctagaacttaaagtataataaaaaaattcaaatgtctccttgagaatggtggctttctaagggaactaggagttttctaataaatggctaaaagagagacattcatggaatgatgtagaggatatatttttgagagtggagtataaaaatcagcatgaagcataggagatagaaatgggaagtagtagcatgtcaaaggcaagcctccattcatttaaaccagcacctagatcaagaaagagaccatcgccagagccccaggaggcctcctgcaaacctccttcttatcattaactcatcaaaagtaacttttaccctcacttctaataccacaggttggttttaagtgtctgctgggttctgctgtgatgacaaagaacccagttttcagtggtttatattctgttttggatgctggtatcgggatactgcacactcaatttcagctttgcctgccgtgcctatgtcaggttctgcatatagaggggactggggggagcctgcaagcctagagggaaagaaggacttgcttcctcctagccacttgctattcttctgggcattagtctagtaatccttctatattgtggtgatggcagttccttgctcttgcagcagctgaatccagtttgtagttcttcctaaacttgtgggtctggcttcatggcatccccatagagcactagctgagcagcaccacctccttagagctctgggtttcagccccatggggcctctcttccacgtttggagaccccagcaacaaacggtcacaggtctcctccaaaagtttcctttgttcacatagacctacctccttgatgcctaagagttctctttttaccctagctttacaaactcagctttgtgcctagttgacacatttttaatgtgaaaagatctctattcaaatagctggtaagatttctgccttttaagtaataaatttagatttcttttatcttttttgctttcactatgtagacactcatttctcatacccctattctactaatatagttggaccatttattcatttacctaaaatattgagcactaactttgaccaatttaatcaaattgtcttccaagaatacactagttttataaaccttctttccttatgctcacaaaagttaaatattctctcaattcattttcttgaagaagtatcttctggaacctaagaccagctccaggctgagcagggtctactgcatagctgtttccttataaatcttcatttatcaccgttttggagattccttctcttgtatggggtaacttgttatctagagctcatgttttctctttcttgctttgttcccttgttttgccagagcacaccttctggtagcttttgaagaaagagtgcatgggagaaaaaaatgttttgagatatttttcatgtaaacctctcaaagtataaaattcaaggctagaaattgttttctgtcaattgtaaagtgaatgcttcattgttttcttgcctctggtttctctgttgagaagtttattgtccttttgactactcctttttatgaaaatttttgtttctctatgttttcaggatcctcaatattggaaatcttcacaattatgtatatattggtgtgtgtatgctttcagccattgtactggacactcagtgggctcttttgatgaggaaactcctgtctttcattttcaggaaattttcttgaattatgttgctgataattttttcttgttttttttttttttcctctagattatatgtatattgaacttcctagactgattctccagttttcttaggttttctctcccattctccatctggtttttcttcttccttttcttttttccccataagtgcaatattctcctttatctctctgaagttattactgatagattttttgaagcttttttccccctacacactctgtttcctccaaggtgcttttttctttttgtttatttggtatttgtctttcataatagaagttttcctcgtatatcttatatccttaattgcctgttcatatgctaaaatgggacatagaaagcctattgaaaaccttgtgtgtgtatatgtgatacacttgagggtggtttggctagaatattcttttggataaatttctgatgctcataactttagtttctttttctcttgggctggttggattcctagagaagactcttccaacctactgccagagggtagaagcctgtcagtgttatgggagctgagtgagaaaataagcctgggggtctcaatatcttgcattttacttcatccacctgttttcaatatgatacatccacactcattagtgtttattgtcttgcaatccagagaccttctttttaccctctctagagaataaacctttgtcatctagtagggagagtaggaatttgaagacttttaagcaaaccaattttagcctaatattattctctctttcctgagatacctgaggttctgaggtaggaattgggttgcttctgggccttccctgatgtagataaggatttagctttctttgtactgtgatgtcagttaccactttttcatcagctaacttccaaaaattattttttttgctattgtagcgtctcccatcttcacatttgtccttatgggcttatgcctttaagcaaatctctgtactggcatttcattacagttttgggatggagaagaatctgaagtgtgagtccagtctaccatttttaacagaaaatctttgagatttcatggacgttcccctccacttttttttttttttttttttttttgctaggctgacactatgttgtgcactctaacacagggacattgatgttgcatgcgcatgttttcaccttagcatgaatcattttcaactggcttcttacttcagtccctcaaaccaatatgttcttttttttttttgagatggagtcttgctcttgtcacccaggctggagtgcaggcgatctcggctcactgcaagctccgcctcccaggttcacgccattcttctgcctcagcctcctgagtagctgggactacaggtgcccaccaccatgcccggctaatttttgtatttttttttttagtagaaatggggtttcaccgtgttagccaggatggtctcgatttcctgaccttgtgatctgcctgcctcagcctcccaatatattctagttgagtcactccacttatctttcagacataaccctacaagtctgaattctaaccctggacacagctcaggctcaaaccagaattcttttctctcacgatagccttctctttcactagaggagtcagaggtgggctgttcaaattggttctggtgttacactgttgactcattaatagaagcatgttttccctagtgtgattgttaaaatcctagttataaggcactcactttgcatataattgcatattttggtactcagtagtaggaaactggttgaggatattctgatattctagaacatttgtttcaaaagataccttgctatgatagaggcatcacatgcaatactatagctataaatatagttattttctgaattgtctttttagagaaacatacttgctgataggaaatttttaccttggatggctggttatataatgtcatattaacaaaacaaataatatctagagaaatctgtataatcttataaaaattatgatgatcaactctagtacttccagcctgcagaaatcttggtcctttgtatgacatgaagttgccaaaaagatacttagagtggtttcatcttaatattttcatatgtacatcaaaggaatatgaatgcttccaagatgttagtctgttttgttgaatttcacagctttgcatcccgagtcaggaagctgtcatggcgttgtgctggtacaccagtgcggatgccagcatgtgcatatgctgacacatatgctaaaccaggagtcaagactccagcactcagatgaatgttagacatctctcatctaaattcagagccaaggaggtccgtgtaggcaggctttccctaagcttcccttctggctatgatttgaaattaatcattttaatcataggttaacatcagggtccatgtagttaaaacatgagacttgacaaattttcatagcctaaggctacagtctttattgccagagcagtaagccacggaacatagtcattgtggtaggaaagatttttgtctgtctgacgtctttgtgggtatcattacttcccagttctcaggtatgggtattctgatggggctatctacaacctttggatccagaggcaggcacatgacccaagcctggaccatcaaagtgctcatggagttgatggcagtgatggctcaggagccagcacctgactcagcaggcttgtctgagcctgcccatgagctctttctggagctgtctgggataaagtgccatctctttgctaggctggttggctgtaaggacagcatgtctaaagctgctgctggtcatctttgctactcctgggagagagtttgagaaacaagttagtacagagaaagcagaaccaagggatggaggaaaggaggcagattccagatgatattctttgtaccccaggaatatctcaaatgaggaatgcccctggactttctaattttgagagtccaataaattctgtttttggaaagctggtttaattggattctatacctgcaattgaaggagactgactaatatggttatattggtcttcaccaactgtaatttttctgtaaactacgtatactggtcagattttagatggcaatcaagttgaattatccaaccgagctgtctgtattgatgagcttaactcagtattttctaaatctctactttgtacagtgtagacacctctaaacaagtaataacaaactgatattcaagcgcaagtggtccactctgactaattgtccacctctcagggtttagagacatcccttgtaaatgattatggaattacctatttcacagagacactgtggtaattatttcaaataagtcctttaggacccttgaatatacttttttttttttttgagacggaatcttgctctgtcgcccaggctggagtgcagtggtgccatcttggctcactgcaagctccgcctcccaggttcatgccatcttcctgcctcagcctcccgagtagctgggactacaggtgcccaccaccatgcccggctaatttttttgtgtttttagtagagaagagatttcaccgtgctagccaggatggtctcgatctcctgacctcgtgatccgcccacctcggcctcccaaagtgctgggattacaggcatgagccaccgtgcctggccgaatagacttaattgtaatagcaaaagttattttattgtcattataggatgcctgttaatttctctattgatcagaatgtagtaagaattttctcaaacttatctaactctaaacagatggatctaaatatatttttttcagtataaagtctgagaaaaattcagataggattattctattgtgtgttcaagttacaaatatggctgatttatgaaatgttgacagctagtattctagggttttagcctggcaattcttaaaatatttaaggaaaagagttttaaaaaataaatccaatattaaatgatgtaacataacacattgttaataagagacgttagggtctccaaagaatatgcatacaaaagaatcaaatatatttcatatattaattgacttgctaaatcctcttccaatctctctctttctctctctctctctctctctctctttctttctttctttctttctttctttctttctttctttcttctgacagagttttgctcttgttgcccaggctggagtgcaatggcgtgctctcagctcactgcaaactccgcctcctggattcaagcaattctcctgcctcagcctcccgagtagctgggattacaagtgcctgctaccacgcctggctaatttttatattttttggcagagacagggcttcaccatgttggccaggctggtcttgaactcctgacctcaggtgacccaccccggcctcccaaagtgctgggattacaggcatgagccaccatgcccagcacagtctctctttctatataacacatactagagctctttcttgtctacattaagttggtcctctgtcctctcaccctattattcttttgtaaagacagctttgttgagatagaatttatgtatcataaaattcacccatttatgatatacaattcaatgattttgattccattattattatacagaaaataagctacactgtttattttcttaattgcacatatcaaaatttgtagttacctatttacttgtttatttattgtttatgcaacataatcccaattttgtgagaaaaaaaatactgtgtgcactggacagacaaagatcaaaagaaatacaggattatggagaattttattttctttcttgaaattttctgtgttttccaaaatttctccaatgagcatcatttctttttatcagaaaatatacattactttaaaaatgatctttaagtacaacaatgtgggtgaatcttagcaatataatattaagctaaaagacgttccaaaagaacacacacaaaacgctatacttttatatgtcatacgttgttttatatgtcaaaaccaaccaaaatgaaaatactattttatttatttatttatttatttcgagatggagtttcgctcttgttgcccaggctggagtgcaatagtaccattttggctcactgcaacctctgcctcctgggttcaagcgattctcctgcctcagcctccggagtaactgggattacaggcatgcaccaccacacctggctaatttttgtatttttttttttttgtagagacggggtttcaccatgttggccaggctggttgtgaactcctgacctcaggtgatccgcccaccttggcctcccaaagtgctgggattacaggcgtgagccaccgcgcctggctgaaaatattattattttttgaataaatataaatgcaataaaacttacatcacaaaaagcaagggagtactgaacataggatttagaatgactgttatttcacatgggtagagccaagtgaatggaatcgaggaaccatataattaggcagaggttattgttaagaatctagtttttgttttatgagttcttgtaatattaaaatagaagatagataaatagatacagtccatattttataaacatattgtctccttattcgagtcgactgtcttgtgggttatagcagtttttgcaagtagattctgtcactaaaatgtgctggtgtcaccagggccagcaccacccaatgatatctctgtgtcctccttcccctgggaagaggaatgtgagatggggtacggcccaggcatgtggcatcccagcctgcaactgtgctgctgattgggtgtccatctgatcggctaaagccctgccttggttgttcagtgttttcagcatttttcccagcatgggcaaagccaccaagctcattcattaccaggccaatcagccgtatccacatgtagcagcacacccaccatcaacttgtactaagggcaatgattgcaaagagggggagaaaaggagatgattgtaggtgcatggacatagcaccttttctgatggtcagttcgatttcagtgtgaagaatttatttatttatttatttatttatttatttatttttgagacggagtctcactctgtcgcccaggctggagtgcagtggcgtgatctcggctcactgcaagctccacctcccgggttcacgccattctcctgcctcagcctccagagtagctgggactacaggcgcccgccaccatgcccagctaattttttgtgtttttagtagagatggggtttcaccacattagccaggatggtctcgatttcctgacctcgagatctgcctgccttggcctcccaaagtgctgggattttaagtcagaaactgcctcgacgttttgtggtgctcctgacgtctgcacagccctacttgcacagtctttcctgatgtcatcacgtcttgcctctgctactcatttgagacacataccttagatgaaaaggatttctgaagagaagaagtagaaagatgccctttaataaatccttccaattatagaaccaggtgtctggaatagtcctcagagaactccccactcctctcttcactacagaggcataagacgcaggccctgagggattgaatgtctcggcaccacccagccgatcctcccacaccgggaggtcacctggcctctgaccccctggctcccttcccagccccctttcactacaccatacttgtggcatgttctacctgtagagaaatgtggtttataacctccccagttatcatttatttcatggcttttacactgcctaatttaaaaaagaatttaaaatattttaccaagttatgataccctaaaatatagaataaaatctcaaaagggcagaaaccacttggaggtaagagcctgggctgacttggtttctgtggtggagccttgtgggtgtcccagtctccagggaagtgaaagtttgggagtatcttcatccatgtgtcaaaaaatagtgaaagcctgcagaagcacaaattcagcaaaagctcacttcacctaacagaaacactactgaaaaatcacttaatgtcaaaacaaatcctgtgttgtattggatatatatctaaggtctgcagacttggagaagataagtcatgtttgattttctgaaacctttgcagcttgaggggccagggtgccgggagcacctgacagggaagtccttgtcatacatgctaagaataaagcccccttccttttagaggctagccctagtggaaccggttccactccctcctttcctgttttattgattgattgattgtttgattgattgatttagagacacacctcattctgtcacccaggatggtgtgcagtggtgcgatctcagctcactgcaatttctgcctcctgggttcaagtgattctcgtacctcagcctcttgagtagctgggattaggtgtgtgccaccgcccaggtaatttttgtatttctagtagagacgaggtttcaccatgttgaccaggctggtcttgactcttggcttcaactgatccgcctacctcggcctcccaaagtgctgggattacaggcgtgagccaccgcgcccgaccccctcccctgccctgttgacacttaactgcaaacctgggagagaaaggcagaaaggaaggaagtgtatgtctggagttaactagataaaactacaagaggtactggtaagtggtggaaacaggtgtttggttataaagagtggtatctgctgttgtgctgggtttcacgtgatttatgttttctctggtgagccccgctagtatgaagacagtagggctttgctagaactggtgtgttctcggggtagtaatggtctcttactggagtcccaggaatctctgggtctcttccttttttaataacaagagctattccaataacctttttgaccctgtgatgttcatagatagtattagctttttggtttaattcttcaagataaagtttacaccctaacaggatcctttgggggtgttattccaaaggggagtgtgatgtgtgaatttcaggctgtttcaggataacgaagaaagcagtttgtggagaagggactttgaagccacagcacacacttcccagcttcttccacttttgcagaaagcattcttgggggtgggatgtggatggtgtgtgttcttacataaggtggtcttgttactgagagtgcaggaagttcctttgtttcttggtttgtggtctttagtaacgataactttaggtgaatggaacctttctgtacattttcagaaatctccaacgtttggatcatgccaggatgttaactttttacaggccgaagctgaacggcctgttatgagggagccccaaaatatgtaacatcattacctctgttaacaccagtttgtcagcctctagacccactgttcacagtggcatcaatcctggagaagatccacaccttagaatggttttgtttggttgccctgttgggaccttcactgagtcttacccaggggttcttatagtgtgtctgaggtgtgttccccaactggccctgggtgcagaaattatatttgcagccagataacttataatttgctacatatggccagtcttttttagcagttttctttcttttgcattttgccacacccactcccaatttactgttagcagccctcctggtaccttctcaccacaagggacttatattagatatctgtaggctccgagacagagagagagagattgagagtgagagagcccaatcacattgcttgcctcctgttttattttaatatcattattttttacattactgttccttgacccttgtacattaaacattaaatagaagtcaaggttatagtcatggggccagagagaggaatctaccttccttgatgactctaggctggaacaggattgaagggagcacaggagtggctagggctacagtctgtgcttctacagagaagcatgtggaacagaaggttgaggtgagaggccgagtggcacagatgaaagagcatgttattttggagttggacagaccttaactggaatgctaacttggccactggtcagctatgtggtcttgggcaaattacctggcacttccaaacttcagtgacctttgccttatctgtaaactggacttgcaagattgttatggtaatcaagtggaataataggtagtaagtacttattgtcccatataaggcatttcataaatattattttctctttcttttcattacgagggaatgagaaaaaaagccaaagacatgaaaatccccatgttctattaataacagcttccatttttctttctcatatttttataatgctttaaactatgtgggtaattgtttcagcatttaatctttccactgaattacttaattacatttatgacaaccacattttaattttgagtacatcgatggaactattaatttattctaatgaatttacaacatggctggaatttttttcaccattaattttgtggtgatagaaaactatgctgcctgccatagatttatcttgctttaatcatattttaatcaaatcaaattccttaaaagtctagataagggtccccctagaggaaaggagtaagaagattttctctgaaaagcatatttaagcctgatggtttatcagcttggttgactcccacttctgctctcaagtgttagcagaggaaacttggtggacatttttttggaggggttgggaactcgggaggaacatttttctggaggggttggaggcttgggaggaatgcatagtggtggaggagaataaatgagattagaaatttctttttccaaagaaagcggccattctgcacatctggagagggtgccgtcatttgtttggttcccagatgctttgcagtccacacttctgggaagacccctgcctgccaagtcatcattgccttcaaagggatttctttctcagcaaggtgataacgttcactgccatagcctcccctgattaatgctttaagattgattgctggtccagcctggcagacgggcgctgaatttcccatttagtactctcaggttttaaacattcaaaatggcagtaaataaaacacatgcctttcaacatccctttttcccctcagctcacagcttgggagtttaggttaactttttgttataacaggcgtttgagatgaacaaggaaagctccctaacagttctttctgtgatttgtttcttattaaattaaaaaatttgtcatttatttattggagaggagggaagaggtttggccatggacactagttgcaaaaacgaattgtaagcacaggtagtggcagattaaaaacactttagcaattagtattttccacttgatggtttaaaactgaaaaaaaaattatctccaactgctgctaatattacagcttaagaacaggctgatagatcttgcatacgaaacatctcactctgggaaaatcttcacccttctcattcttagttataataagacaaggcaatagcctttttagtttgtgtgtactgatatgaatttctccatgaagaatttatggaagctactaaataaacacatggagagctataagaaccctaaccctatgaaacacacaatttagatccacctatcatgtaaattaaacattcgtcagaagaaacagttagaggtgtgttagagctttaaataggactgtttatattaggatgagataaagactgacattccaaagttattaaccaacatgtgtctccccttctatggaatttgcctaataagaatttttttaaaaaattcaatattattttgaattaacaaatcttaattgtatatatttatggggtacattgtgatgttttgatatatgcatacaatgtggaatggttaaatcaagctaattagcatatctatcacctcaggtacttaccatattttgtgcagagatatttaaaatttactgtcttagttcttttgggatatgtaatacattatcattgaatatagtcatcctgctgtgcaatagacctcaaaaacttattcctcctgtctaactcaaactttgtcctccttgactaacaactccttgtttcccattcacccccccagccctcaacctctgattatcatcatctgataagaatgttttgacacttagaatttgaagaggtaatttgaatgacatgaagacttttcataattgttaatgttttatcataaatgcatcatttcattacatatatgatttcaaaggctttgtcatattctttaatctagttatatgtcttatgcacagatgtttattttatgggagtgtaacttaatgaaagctaagggcaaatataatttcatttatagaaatttactttccctaacaacattgagttatacttccataaattttattccctctcaactagggagggaggatgtggaaaacaaaacaaaacaattctggccttctaagttcttgaagatcaaagctgccatcttgaggagtgtctcctctcaactcaaacaagtggggacccttccagctgaggcccaggacacctttgtttgtcctagaatactcttctttgattctgccctgaggctacatctggggcactctaactgcccccttcagtctgtccccaagctacagggcaaaatcccatgggatccatggtgaaaccctaggctgggagataagactgcaacatgcaaaacagtcttctcagatcacattatgcctgaacacctgagcacttggggaaagaacaaagtaaaaagctagcatgaaggcagtttacatcaaggtaaagcttccagaatatatttcaagtcagcctgagcaatcaaagtgattggaaccactaaaataatttatgtcttcataggagttttcttgaaaagcagaagttccaaaagcaatgctgaaggcagtctagtgtgccggatgattctctggacacattgtaaaacaccacaagcagttagtgcaagggtgtgaaacacagcaccttttttgagttatatctggctgtttaaaagcatgattttgggaggaaagagagaagaggggatcaaaatgttttccctccttttttcagtgggagagcagagaagaaatgttggtcaagatgcccatggatggaagaaaaggtggtgggtggggggcagtggttaaggacatagaggggcaactgccttgagaaaagggaaacttagatggaaaaattaaaacttgaacttctgggggaacttactttgttttttaatctttgtatgactttctcccataagcctacccatttcccgaagtgatttgagatggattgttttcatccaggccagtcttggaatagggatgcccagcagggcccagggtctggcaccctctccttggccttaaggccagatacctggggtaagtgttgagtccaggccagaggtaggggtgaggtagggggagaagggatggtaacacctgctggtgctaaaggctctcatctactggccccatagagtttgtgtgtctgtttgcacacatgatgtgtgcacatacatgtgtatgtgtagggtggctggtgggaaccaactccttcattcctccacatgttctcccggggctctaggctgccattttggagaaagactcacctgtatttgttcttcctccactgaggaacacctctgccttcggtttattgctgttttctctggttacaattttggttccattgaataacattggccttaatgttcatttacatgagattttgcctgtatttgcctgcacatgtgtgtgagtgtggggggcacacatatatgtatttgcctttgtatcaggggaggtgcacctagtgattccctctgcattctacacctgtgagagaagatcccagctgtttcccagcttaaatttagcagggaggtaaatggaccctctgtgggtttagataaggtgtatggtcaagcagatgttgtttttccttttataacttgccaccgaccttctcattaggggctggaataaagtcatgagattatagtcttatgttgctaagaaggggaaacataacaaatctactagcattaatttatataccacgttgactcaataaaaatctttgtagatcttgaaccttaatcaaaggaataactcttatggtggaaaagttaggctaggtggagagcattcagtgtccttcagtcatacatagtagttatcacttgctgatcccaggaaaccggtaatgctttagagagaatggttgtcatggtgagtttgaattacctgtagctattcagatgagtatttggatagatagttaggagagtacagttgtggagcttgagaaggcagatgagggccagaggtgtgaatttgggggccattggtctgtgggtgatgatgaagcaatgaacatttgcaagattacagagggagaaatgagaggagaagctgcctacagtgagctgggatagaagcgtgggctgcacggatgcagggacccatgctctttgtgacttgtgagactgataacaaatatacacgcgccatgtttagtggagggttacgtggtctttgtaagtgttactgaaaatacatctatcagactggccatttcgtgcaaagatgaaagttcatagaattcaacttaccaaagatttactaactgtcaaataccatgttccatgccaacagagaaaaatcacacattcattagatcaattcttattcccaagaagtgagggagacagacgtgcaagcaccttactagaatataaggccaaatgaaatagggtaataacagctggagacagtgggaacttaacagaaagaaaaattcatctcaaagcggggcttcagggaagttttattgaaaaagtggagggctgactaagactccaacagacaaggaagtgaggggagagaatctgagagtgaggacccctctcagtctcaggctttctggtctaacactgagtattagggagatctctggtcattctccaagcgcagcctctaacttctacatgccaggccctatatgagaaaataagagcctccaaaatacaaacccctctccccaactggcagtgaatggtgacttacaacaagtactttccaatgatactctcaaacaatgaaaatgatacttcatggttccttaagcatggcagagagaaccaccagatcacataatgcaactcatctaatattcctattgaaatacagtgggaatcactttaatagcactgagaaaataccagtgagataaagtctattttaaaaagttttgttggctgggcatggtggctcacacctgtaatccaagcactttgggaggccgaggcgggcagatcacgaggtcaggagtttgagaccatcctggccaacatggtgaaacctcgtctctactaaaaatacaaaaattagctaggtgtggtggcacgcgcctgtagtcccagctacttgggaggctgaggcaggagaatcgcttgaacctgaaaggcggagattgcagtgagccgagatggcgccactgcactccagcctggcaacagagtgagactctgtctcaaaaaaaaaaaaagtattgttttagtagttgaaaaagaacaaaataataactgaccaaagccgaccatttttgtgaagtttattctggtggagacagtgcttgcaggccacatccactctgttcttgaagggagaaagaacaccagtgaaaagtgaagcattgctttcctcgagcttacatttttcccggcatgcacaatgtcgccagtgcatatgttgaggtctttgcgtttgaagcgtggatgctgtttagtccttactgcatatatttattatgtgagatttattttaaaagagtctgtgaagttggccatggtggctcacatctgtaatcccagcactttgggaggccaagctggacggatcacttgagcccaggagttcgagaccagcatgaacaatatattgagaccttgtctttataaaaattttttaaaaattagctgagcatggtggtgtgcacctgtagtcccagctacttgggaggctgaggtgagaggatctcttgagcccaagacatggagactctagtgagctgagattgcaccagcctgggcaacatagtgagacccagacccaaaaaataaaagagtctctcaatcttatatatggttctcccctctttgtatcaaatttagctagtacactggctaaattggaaatcaacctgggcaagatcttgtttcttttcatgctgtctccccaaaagttaagtgctaatcaatttgctgacgtaacaaaagaagcaatcagaatatgatataaatattaagtagaatatcttttcctctctcaagccttccttggctatcttagacttaatagttctcttctttttactggttttgtgctttctaattacaactgttacatatcatgttgggtaataagaattcaattactgccatctttgacctgagtgacctgagggcatgagctctcttgttcattagttccagcacccagcctgctgatagacacatagcatgagctccatgattcctcataggaagattggagtactgtagaaattatagcatcctaaaaacccatttggattttctaatgccattcttctctatattggtcaacctgctggagactatttgtgaatacaaattatgttcccaaatacatcctagtccaggtaagacaatgccaaacatagcttggaggagctgtcatctagtgggaaaaattaatggtctacataccactgggtcctagtcctggcattgtactacaatccttgcagctgaaggtggttttttttacctctctaggtgctgcgttgccatctttaaagtcatcccactggaccacatcagtattgcaagctgcttgggtatcattaatgaagacaaagtgggattattattttctatgatttgggcttttgtgagtttatttattaatgtagtctcaccatcacaccccctcttttttttaaataggcatgccatattactgcattgtagtaagcttctgactaattagaatttctggattattcaaattgaactgctgttcatattttatgactttgccatgtactttttgggacctgaaaaggtcttcacaatgacccagttaaatttaattctgttagttttatctagcatttcactggtgatgatacatttgaatcttgattctatattctatcatattagttatcctgcccactttagggtcatctgtggatctgataaatgtgttttctatatttttgtctaaattattaacttgaattactaactagaacagatttaaggacagacccctgtagtactttgtgaaagacttttttgctggttgataaatgattaattaacaccctggttttacttgtttataactacagtcatgtgttgcttaatgactggcatatgttctgagaaacatgttcttaggtgatgtcatcattgtgtgaacatcagagcgtgtatttaccaaagctagatggcatagcctaccacacacctaggctgtatgcaatagcctattgttcctaggctgcacacttttatagcatattactgtactgaatactgcaggcaactgtaacacaatggttaagtatttgtgtatctaaacatatctaaacatagaaaaggtacagtaaaatatgatataaaagataaaaaatggcatgcttgtataaggcacttatgaatggagtttgcagggctggaagttgctctggctgagtcagtgaatgagtggggagtgaaagtgaaggcctagtaatgattgttcactactgtagactttagaaacacctacacttaggctacactacatttataaaaatatttttcttcagtaatagattaaccttagccttctgtaactttttcactttacaaacttctaaattctttatactttttactcttttgtaataacacctagtttaaaacacaaacacactatacagctatacaaaaatattttctttatttatacccttattctataagttttttctatttttaaaattttgaatttttatttactttttaaacaattttttgtacaaactaagacacaaacacacacattagcctaggcctccacagggtcaggataatcaatatcactgttttccactgccacatcttgtgcccctggaaagcactgaggcaataaaaggcatggggctgtcatctcctatgataacaaggctttcttctagaatatctcctgaaggacctgcctgaggctttttcttgttttcacattagtgaagacactgaagatgtcactaggcaataggaatttttaacctctattatagtctcatgggaccaccctctctctgtatgtgggctgtccccgaccaaaacgttgttatgcagtgtgtgactgtagttgtaagtcaatgctactggactagctatcagtcaatcatatgcttataaagattccaatcctacctggctcaagaatttcagaggggacttactgagttggactggttttaatttgtactacttgaaaattcaatatcaatctaaatgtgaacttcccctacaggagtaatcaagacaccccagggggccctgggacccctttgtcctccagtacaggttctatgagtttgcaggatcttaaaatttgtgtatgtaaggcctcgaagagctcggctgcctggttctgtcctgtgttcttgaaacaaaactgactttggggcaaattagaaagtagattcaaattatttcattctagtttgatggcagctttcccttcttctgtgacacatcttcttgctattggaggtggctggggtcttcctggtttcttccagcttttccttttctgtccctcactagcgaggtcacacactctcctctggacttctctcttcttatcaagagtttgtgtctccttttcattcctcggtgaccattgcatgtggctaggtaatagaatggaggtacttgcttgcacaagtgcttgtgtacacaaacatacagagatacacacacagacacaccacacagacatacgtctacaacagaaatacataaagatgcacacagagacatacatgttcaaacagacatacacacagacaccaagacacacacagacacccacacagacatgcaggcacacacatgcctcccccaccacccagacatacatgctgagtcactgatgggctagggaacctctgttctcccagccacacgcaatctctgagaattgcccttgggctaacgtccacaccaccctgccaggcccattttcctgttgtagatgaagaaagagcagggctggcctcgtgggcgtgtgactgtgcctacagttagaagggtcctgtagttgttttaatgctctgctcttgtcaccttgaaatccgtaattccttttgaacaagggatcctgcattttaattttgcactaggcaccacaaattatgtaaccaattctgaggaggagttatgtgttccgtagtgtgatttacctgtgcactatatctggggactccgtctgcatgctagcagctgctggaagagtctatttcacattaattttcctgctgcatattttccaataaactatcttccaataaactatcttttaaagctgttaacaagtgttttctaagaaagttcactcaagaattcaccctgatggaactatttgttttactctcctgtggttgtaactgcccaatctgttctccttgcctgctgcctagacagagccaatttatcaagacaggggaattgcagtagagaaagagtttaattcacacagagccggctgtacaagagactggagttctattattactcaaatcagtcttccaaaaaacgtgaggattggggtttttaagggtaatttggtgtctagggggtcagaaagtagggagtgctgattgatcggatcggagatgaagtcacagggagtcgaagctgtcctcttgagtttgttcctgggttggggcggcaagaccagctgagccggtttattgatctgggtggtgccagctgatccatcaaatacagggtctgcaaaatatctcaagcactgattttaggttttacagtagtgatgttattcccaggagcaatctggggaggtttagaatcttgcagcctccagctgcatgactccaaagccataatttctaatcttgtggctactttattagtcccacaaaggcagtctagtccccaggcaggaagggggtttgttttgggaaagggctgttaccctgtttttcaaagttcaactataaacgaagttcctcccaaagttagttcagcctacacacaaaaatgaacaaggacagcttggaggttagaaacaagatggagtcagttaggttagatagcgttcactgttattttctcagttacaatttttgcaaaggtggtttcttggtcacagttgtctccaattctgattttatttaattttaatgtccatatgatacctactttttcttttttctttttccttttttttttttttttgagatggagtcttgttgctctgtcacccaggctggagtgcagtggtgtgatcttggctcactgcgacttccgcctctgaagttcgagcgattcttctgcctcaacctcccgagtagctgggaccacaggcatgcgccaccacacttggctaattttagtatttttagtagagatgaggtttcaccatgttggccaggctggtctcaaactcctgacctcaggtgatccgcccacctcagcctcccagagtgctgggattagaggcatgagccaccgtgcccagcctgttctctaatttttaaaaactccaaccagaacataagtcatgaaaagatgcagcaaacatttgagagtcaacaaatatttactttggacctactaaatgctgaacactgttctagagtctggggatagagcagagaatataatagcatccctgaccttgtataacctacattctggtgaggagagacagaccataagccagcaaaacagaagtaataaactagcaagcatatagatgagtgagaaaattgcatgcatagacaaacgctaaagagaaggttaaatagggtgatgtggtagagggtgactggaggtggttttagcttggtggtctgaacaggtctctctgaggagttgacttctgagttgagacctaaatgatattctgggtaaatgtagttttggtagggctttaaagtattagctgtagctcaagcatgttcactgtttttgtgaactatgacatccatttaaatgatgttcaaagaggaatggtgggacatctcaagtcaaacaaacatcctgaactcagtggatgaagtctccaacaggtttcactccagggcatttccatgaagttccacctctccttcactttgctgtcaaggcaccaggctttgttgtgtgccctgtagggggtgggagtggagcactttagtaggagtgatttgtagtttcagcgaaagtggaagcttcagaacctacccctccaatttgctgaagaaggtgggacagaaccaaggaaaggcaataaaaccgtgaaccacagaaacacctgcatcaccaagtacatgccccggggccaaaagggatgttagtgccactgggatcagatgggatcaatttctccatgtgcactgattcagtgcttgctacactgcttcaagctaacctcccactctcactgtctccatttcagaacccagttccttttccctctttccgttcatttcgagaagacaatgtcagaaaacagaatgacgtatgtgtccaaaggctcaagggcttggcaagcgctggctctagtttttagcacttaattgacaattattcattgcctcttgtgattatttaattacacccccaactgaacttaccattttaccccagtgctcctcctctgacttcaccattctattcttccttctttcaaatcctgaccagcaggtcactcatttgcaattcctacatatttaaagcaacgttcactctcccgatttctgacctttcaaacacccttgtaactaagtccttgtattatattccatctgtttgaaatttatggtatgacctctggtttcttgattgtgtgataatgtaagcgatttctttcttcaatgacttctttcttttttacaattgtgatatatacttttatttctcattgataaatggttacaaatcatactcctaggtttatatagcactaacacttaaacacattgtaaagcttctggaaggcttataataccttgtgtcttccagctttatctcccagactggatctcatttttttctttctacttttcttcccttttttttcataaaaattgtatatatttaaagtgtacaacatgatgttttgatatacatagtaaagtgattactgtagtcaaaataattgattatccaccacctcacattgttccttttttgtcttgtggtgagagcaattgaaatctactatattagctaattcccagtacgcaatacaatattgtcaccattctgtacatgacatgtctagacttactcatcctacacaactgtaactttgtattctttcaccaatagtgacatttgtttcttgagtcatcaatttctttcctttttttcttaacttttatttaggttcgagggtacatgtgaacgtttgttacataggtaaactcatgtcacgggggttggttgtacagatcatttcatcactcaggtattatgctcagtacctaacagtgatctcttttgcccctcttactcctcccaccctccacccttaacagaccccactgtccattgtttccttctttgtgttgattgatcaatttaaaacactttttattgactccctgccatgagtagaagcttaagctacttacacaacacccgtctgtcccctctcttccaaattttggtaatcattattttaatttttcagtgtttctttaaaaaatatacctgtaaacctcaaattttgtgcaatcaactttagagatggtctcttgactcctcaccatgttagatgagaccatccatattcttatccttccttctaactcttccatattatcccgcctcccatcttctgactatgaactttcatttctttaattatcaaagttgttaacattgacattttgttctataacaatttaaaatcttgtatagtagatggattctaaagctaaaagctattttattattatgcgtgagaataacatgttgccatttcacagccaaaaattatattttctaagattgtatttccacaagctaaggttatgttttcttctctttatgtctagcatcacaagctcttgaccctcaagagacactatgctcactatacaggtcaaaaggataaatgctttttattttcttataatttataaactattcaaaatcacgcagtattttagtattttagtttgtttcgtatttgggccatgatttttttaagatagtgtttttcttggaggttctaaatgtgaattcgttattgagataggacacttctttctctctctcttttttttttctttttttcttttttttctttttaccatgtcactaataacaagcatcattgtcattctgtacatttgtacattgcttggaagctgtaagttttttcttggacataccatacatggaatgtgctgacatcctgttccagttggaccaattgctttctcagcctcacacacagatatcatcctagaatttctttttattggacacttggttgagtttcattcttttttttttatttttttttgaatttcactctttgtgtttagctgtcatttttctggagtaaatcctcaagtaattttctcataaaaattgcatagagggtaaacactctgtatattctctgtgcaaaattgttatgatgatgtatgtaggcattgccattttgctctgcttagatggtcttccttctgggtatctgctataaaaggaaggctgacttgagctctgtgtttgagggtggaatatgttgattgtcaggcttcactctatgggaagctggtagggagtcagcctttagacaaagaggggccttggcattcttgaatgaggagggccactggagtgtcattgtctcctaagcagccttaattcttcccaggaggttgactgcacttcttgagagaggagtcctctagttgctgttttgtctgggggagatgaaggtgaagacagatgtccagtgagcctctggctttgttctcctctttgccatgcccatgccaggcttgccagcaaacagcctgcagggctagttatcttccttctgtgtggctcttctcacccttctctcagtgtcactcatcctcacttttcatttgctgtcttctctactcctcacttgtttgcttctcatacaatgtttaagcatatttctgctttctttggtgataccctatctgatgtcatctgcctctactggttgcttatcttcttattttttaaaatgtcttttctgttttcctccatttttcctataacttgagacagattttctcaggcaagaacacgtgtcattgccctaatgggattctaagcctgggcatggcgttaaaggtggcttgtccaaatctccttggtacgggtgaaggcactgaggactcaggagactgagttgtccatgttcacacagctaagctcatgacagggccagggctgtgtccagctctcccgcacgtcctgcctgtgcttactccctagattgcagatttcttcctgtgcctgggagaattcatgtgaaattttgtcaccttaagtggaagatctgtttatgatgaaaagtgccctttagtgtaagagattccaaaaggcaggttcttagactatgttggatagatgtagtagcaaaattttaggacttcccatagctccaaattattaaacctttgtgtggaaataatagagtttggggattagagatacaaaaggaggatgaagaatctgcccttattgaacagccctgctaccgtcatagttttcttcttgtttgacctgatttaacagtgaagcaagctctgatgagacttatggactatttgcaaatgattgcaaaactgcagccctcccagaagctggattttttttttctgtttagtttttttgtgtgaccttgtgacagaattatatggaagtagaagttagtttagtgttattcacatgtgtacacttttgagaaacttcgtgtggagaacctgactgagatactttgcacaaaactgttaggaacattaactgaattaaatggtggggggaatgcatctgttttataacaggtgccggaaaatggactgtcaccaatattgtatagtcaaggatggaagcaggaggataatagagttgcagtgcgtatgctaaacaaaagacgactttcattccaaggaaatgagatagagacagcacgagtcttacttctgttgttttccatggaggaccttgacaggaagagcaagttttgtctcagtgatgtacagagttgatctttaagttgcatgacaacatcattatcttgctctggcttaaaaaaaaattatcagctttgggaacaattgtctcttaacagtaactcagattttaggtttctccttccctgccagcccagggtgatatgaacattttgaaaaaactagaggtagctttttatcagtaaaaaaaaaaaaaaaaaaaaattccctcctgcacatttgtttcttgaaggacaggtttctgcttctatctttttgttttctaggttgaggatgatgaatggcagtttccaaatgtatttctgaaaaagatgaataagaaagagctgtttctgattcaaccttccaattcctgggagaaatggatgaagtaggaagtagagagagctgtagattacagaaaggccaacatgaggagttgcttttcttgtaaatgtgtttcatttagaaggcatgtgtgcttaacaaaggatttaatttgtgtggaattaaaaaaaaccaaacttttgacaatacatgtgaacaaaacttcaaactgcaccaaattatttacaaattttcagttaccgtctttggcattctagctggattattccacctaaaatgcagatctaactttgttatttttctgactgcagtcttgtgctgctccacaaactcctaagcaatagtgtatgagccctttgtacattgccttctctctctgtccgaagtcttattttccaccctccctgcttgacacctgatgcattatactctagtggttccttcatactctgctgctctgcacttcacaaagatccttctctctggaatacccttcctatttttatttggccaactcttactggataaactatcattctgtcctgaaagtcttcccttaaactaggtgggactaagacccacttttctagactctgtggcttctggcttgctactgagtatcttatatttctctttaggtgtgagttgaccttttagactatgagcgtcttgtgagtggagactatgccttattcatttttgcatgtgtcgggtggatgcagtgctgaacatgtaatatgtgcacagtaagtgtttgccaataacctctaaatatccaactcaactaatatttcagttacttcctatttagtactaagactgaactgaaaacccacaagaaagtttcataatgataggtggtaaatagcagttagttcaggaagtaagtaacagattattatttttctcccagtggcagggtcacactatttttaatgaatttggataaatctacctgtgcaaagcatatgtgtccatacagcaagtgcattaggaatcacagataatacttagaatcaaggactataagaattgcaaaatgtccttagatatcttccaggccaatcctctttgtgatgcaagagtccttcccacaatagttctgataaatagtcatgcattttctacctaaacacctcctgtaatggcccctctttatctcaccaggaagctcaatccatttttggaccactttaattttcagaatactttctatattggctcaaatctacttcttataacatttatccattggtcctgattcttcctcttgaagaggaggaagacaataaatctaatttctcttcttcctttaaccttgcagatattggtgcatcatcaaatgtcccgtaagacttctcttctccaagtgaagttttcttaagttctgtaattgttcttcatattctgtgcattctgttccccttactatcctagtcactctactgtgctttagtttgtccagaagtgaacacgagagtccaggtttccttatcagtgcgcatttgagcatgactgggcccacattacaatgaacactctactttagtttctgaagcctgagatttcattaccttttttttggcaaccatgaaactctgctgacacatatggaactttcaattaataaaaacctctaggattgtttcccttgtactgttactaagcctttctgggatctggttatactgcttataccctctgaatgatgctacatgaaaaatttcaaatcaacaaccattgaccaactatttgataatattcatacttgtagatcaaaactagaatgtaatagtgcccatacctgaaggtctaaaaagtactttccgatagttcttattatatttatttatttttctctgggcatgaagacaatcagattatagtcagcaaacaatttaaagactaaaattttcataatttatctatttatatcagtattgctatttagaacactgaccctgcaaagttatatacctagtccaacaatgctttctttgttgggtgattaggacaataacatttttgaggggtgcctacttagtgcttagtattcaaaccatttttcaaacttcaactttcgaattacatttaaacccagtgcatgaaccacacagaaacattattctcactattttcagtcacatttcttcttttcgagtccaaggttctagtttagtggtcttgtctcctatgacctttagtcacctcctgaaatcaattatatcctcaatgatggctattactccgttcccccttgaatatattactacatgtccccatgcaggcccctggagcagtcgtaccactcagatggcccaacagcctcaccaatgtcttgcctgcatcctctctgtttaaaaataggactcccagagattctaccttgaggccccagatcctgccaaaaagagatttgtttcctcctctgttcttagaccaattaccaaataaagcactccacagagaatccagatgaaatatttctccacccagttggtaagaaaagtaattaaaccaacctgctgtgctgagcaggcctgcagcaatgtaacacttagttatagcaacagccatagataggaactcagctgcaggctcctgtcagaccgatctgggcatttctaaccactgtccttagcaacgttcacaaagggccccgtcttagactcagaaaggcagctcacagcccttaggggtatggtttgaggtaaaataaaaaaataaaaaatttaaaagcatgcattaagtgtgcttctcagtctggctgtttgcagagcttagataaataagaataagggcctacctagctggatctagcatttgcttgctctcagaagttgcagtgacaggagaagaacttttgtttggccagatgtagcctttgctcttatcagccactctttcccacccttgttggtaccatgaagtttaggtagcatatgacgtctcctaatagaaatcactacacattctgtaatctgcagttcttattcagggcaattcaaatcactgtaatttctttctactaaccagattttgctgaaattctggaaaactatggaatactttttttttgtttgaaaaatcaagcaacacatatttcgtttcaaatggtagactgaacgaagtagtataactcattttcctatgtcatcgcataaaatttggttaaaaatctacttaatctttctcatattattagcaaatgaaaaggaagaagaaatgtcaagctgtctagctgcaacaaggaatatatcgcattttgtcaataatagtaataataatgatgattgtggggctgatgacagtaatgatgccatgggtctctttagctgggaaaattgacacagttgcatagactagaggtatgcaagaagttagtctgagtaatgtaagttttaaaattagtgaagcaagaattttaatgattttaaaaagggtagtactaatactgtgtatgtacaaagcactgtgaaatgtataaagcattttcacatttcaacaagggatattgaatcgatattccataagggatattgaaatgtgaaaaatcccttactgaaaagggatttttcattaagggattttggaaaaggaggaagcagtgttcagatggattaagtggcaagacctggatttgctgttctgtgtgccaccaattctcaattcagtaaaactgactcagtcaatccaagttttcctgatttggtagatttataaaagcctatatattgagctcatctgtgacatgcagactgtttcttaaaaaaattattttttattttaatggtttttggggaacaggtggtgtttgaatacatgaataagttctttagtgatgatttctgagattttggtgcacccatcacccaagcagtgtacattgtacccaatgtgtagtcttttatccctcactctcctcccaccctttcctccgagttcccaaagtttattgtaacattcttggttttccattcctgagttaattcacttagaataatgatctccaattccatccaggttgctgtgaataccattatttcattcctttatatggctgagtaatactccattatatctatatatctatatagatatataacattttctttatccactcattgatggatggacatttgggctggttccatatttttgcaattgcaaattgtgttgctataaacaggcatgtgcaagtatctttttcgtataatgacttcttttcctctgggtagatgcctagtagtggaattgccggatcaaatggcagatccacttttagttctttaaggaatctccacactgttttccatagtggttgtactagtttacattcccaccaacagtgtgaaagtgttcccttttcatcacatccacaccaacatctatttttttttttttaaatgttttgattatggccattcttgcagaagtgaggtggtattgcgttgtggttttgattttcatttctctgataattagtgatgttgagcatttttccatatgtttgttgacaatttgtatatcttcttttgagaattatctattcatgtgacatgtaggctcttgatcctaatggtgacaaaaatatctgtaatggagatgatatattaatatttttcagatatatttctattataaattttggtatcttgggggcttctcaattattgaaacaatgagctcaaaagaccaatgtaaaaagcttttctaaatctctgtagcctctcagtgatatggtctggaggactcagattatttagttttttctagaaatgttcagaagattcctgctctgcctctgtaggctgaaccaaaggtcctcctggatagaagaaagacatgatgttgaggaaaatgaacagttttcccttctattctgagaagattatggaaataagatggtcaggtgtcggagcccttgtttttcttttcttagggtccaacttgggatagggaagggactgtgggtttagaaagcagtatctgtattggtatggatggtctgcagaaacctttgctcctttgagctactgtagtgaagactcaagcccttagggaaatcataggtgtaggcttggcaccgtggccatcatggtgcctgagtgagtgtaggtggtaccaggagcccaggtctgccattctggaccccagggacttatgtaactccaagtcccaaggaggagaggtggagatgctgagggccctggtgaaccagcagaggccctcatgcaggagagagttcattttgggtgaggacttaaagatgagaataaatagctcggatcttgggttccagcagtcggtgccagcacatgatctcaaatggccagacaggtccatttgttcctctgtggtcagcagttcagggagaaactcagtctggctcctctgcagcagaggcccagtgagaattcagatgaccaggtgaagctctgaggaccccctttcttcctctatcacgccatcattaatgagcgtacctggcccctccaaccagtcaccttcttgaattggaggatggggagggaaagattttacacaaatagatcaagcaattaattaaagagactgccataattattgcatcagatcaaggttgatggattgaaaaagcattttatattattttttccaggtttgctctgggggtttaggctttgtgaggatgatcagatgagttacgtagagaaagtagaaatttccatatttgatcaaatttaagatacaattgattattagaagaacctttgttttatcaattactgagaaagaaaaaagttaccatattagtcagggttcaagcaaagacatagaactagtaggagctatgtattaagagatatattgcaaggagttggcttatatgattgtggggggtggttaggcaagtctgaaatccaaagggtaggtcactaggaagggcaggctgagactcccaggcatgagtccataggcaaaattcctctttcaccagggaagtctcaactctgcacttaaggctttgcaacagatcgaatcaggcccaccaaaactgtctaggataatcttccttacttataggcaactgattatggactttaatcacatctacaaataccttcaatgcaacacttagattagtatttgattgaatagctggagactgtagcctagtcaatttgacacaaaaactgaccatcacagctaccaattaaactatggcaagttctggtgagacatatttcaattttagaggtgttaaaatgtaaaaaaaatttagagtttatgacatgtggtacattttctgggtatagcgcaagtaattgagaactgtattacctaactttatttagtaattctggggattagtagtgattttgtaatcttgtaatgacttgtaattctagagattggtagtaattacaactacccctttgcagagagaaagcctgagtaccaagaaagggaagtcacttcctgaggattacatcaggcagggctagaattaggatcctgttttccacccccatgttctttcagtccagatccctgtattttattagaatcacaggcaaagaagattggtggaatgtgaattgtgtttccctggctggtgtccctgatcacctgagagttccaaagtgtgtaaaatgatttcgtggagcctgatggaaagtctgcatttcatctgaggcaaagtttcatgggctaaataagatgttaagttgctttgcttttggccagagttttatgtagtccctttggtcacttttctgtcatatgctcatcagaagctgtgatgaccagttatttaagttgtgtgggtcattctcctgcttcctctcaagttcattctctaccttccctcattttgcatcaaagggaattaactttcctagggttacttgccaatgacttctgagtagcttcagcgaatgggaggcaccagaggaagcctagagggtgggagaagggagaagccagggagtgagtggctcccttcttgctctgccctgggctgggtctccctcagtggctgtgtttctgcagtggctctaactttgcttggatagtcactgcctccacagtcccatcccaccaggcagcctccaccatagttctggctcccactgatggtcgtggcttttggaaggcaatagcaacgtctcctctcattgttccttcggctctaggaatggcaatggctttctgctcttgtctcgccactccttagggactctttcaggtctcccatcacttgcataatgaattcctcatagcaaatttcctgtatttggaatagctatagtggtcccatgttcctgatatgtaggattaaaaaattaattattctgggaaaagtaaatcagttattacttgagagatacacatttgggtagataccatcattcaaaacatggcttctgtgttaggctgtttttgtgttgctataaagaaatatccatctgggtaatttataaagaaaagaggtttaattggctcatggttctgcaggctttacaggaagcatgtctccagcatctacttctggtgaggtctcaggaagcttgcaatcatggtataaggtgatgggaagccagtgtgtcacatggggagagcgagagcaagaggtagggggaaggtcccagacttttaaacaaccagatctcatgtgtactaactgaaggcttccttgcaattccttaaaaaagaatagaattgattgccatttgagagcatgtggactgtttgaagggagggctagaatttgctgttcaatgtttagcacattctgggagcctagtaagcactgattcgaggaatccaagtcttccagactcataagccattcgtgagtcatgttatcaccaaggaaatggagctaaaccattcctgagggatctgcccccatgatccagtcacctcacaacaggccccatctccaacactggggattacattttaacatgagatttgggggggacaaacatccaaaccatatcagcttccaagaggaaaaatatgaaaaagaagaaaagggaccttggcagtgaaagggctgtagaggcacatatggtagtgctgaagggagccttagcagccaccagagaaataggggtacttgtcctgggtcacttagcagttcataaatgaacaaccaggaccagaatgcagttgtttttgcctccagccacatattacatagcacagttggaagcatttggaatcagagagaaccaagttaaaaatcccagctccactgtgcgtttcctctgtgacttcaggcaagcctcttactgtctctgaatgtcagtgttctcatcttgaaattgaaactaaacttcccagtgttcatgaaactgtaaggagtcacttgtaagtgtacttggtggagtgtttggccagagtagccactaaatatgttacatttccttcctcccattcaggacttttctataacactatccaggaacaattaaaatttccaagaaggtagtttctttcttttttaaactttcttaaaatctctgccttccccttttgctgactttcaacaaagcaaaataaaggagctgaccaaatgctttaataatgtaacttggctgggcacggtggctcacgcctgtaattccagcactttgggaggctgaggcaggtggatcactgaggtcaggtgttcgagaccagcctgaccaacatggtgaaaccccgtctctactaaaaatacaaaaattagccaggtgtggtggcaggtgcctgtaatcccagctacttgggaggctgaggcaggagaattgcttgaacccaggagatggaggttgctgtgagccaagatcgagccattgcacttcagcctgggcgacagagtgactccatctcaaaaaaacaaaaaacacaaacaaacaaaaccctcaatgctttaaaaaaaatcttgcaattccttaaaaaagaatagaattcattgccatttgagagcaagtggactgtttgaagggagggctagaatttgctgttcaatgtttggcacattctgggagcctggtaaacactgattcaaggagtccaagtcttccagactcataagccatttgtgagttaaaacaagcctcctttgaagtgcttggacatccttctctacactatctttagttgccattttgccccttacattacagtaagaagtacatttgtatggagttatacatgccacaggcctgctctaggacacttggcaatcagcaatcgttcagacctgctttccttcattttccttattggttccaggttgaacataggtcttgttaccgttcaagggcctgctcctatgggcccatgccccaggagccctaagccttttggcccagttgaaaagctgagttacatgagaaggtgacagcctcataatggcccgtgttccagccccagcattgttaccccctacaatgctgttgtaggagtgtaaagaagcagtcgcttagactcctaaatgcagttcttctctctcgagaccaccttggattggagaacacccaaatgagcaggattgcttttgctttcaaaagagtgatacctggagcacaggtatccacctccccccatatcccatgctttgaaaactatgttgtattagtgttttattaactgtgcttgaatattgggcatcctcctatattgcaccttgatattcttggctgtatataaagagttgcttcacttttaaggaaggtggacttaaaagtttattgtttgtgttgtgatttcctttcaagtagttccactctgtgtaacaatgatgcaaagcaggcggagagctgacctagggctttcaagtggggcagaggtaagcaaagagatttttccctgattaatgctatcagtttaattttgttgaataaatgggtggaattaggttgaggagtgtaggttcttgccagatccaccagaaaaggtggtagatatagttataattagagtagtaatcagaagggtttaaattctgtgcagattgctttaactctccattttaacatgttttttttttttcttccctagcagattaccagaaatggggtttcagaaatgcagttctaagcatgacctggggtgatggggcgcctctatttatggcaaatggctttgacttctgtgggactgggtcatattgttacagctgcaagactaaaaagcatttgaatgattatattttgattagaattcttcctacacttttaaggaacatggaaacttcagtctctttttctctctcaatctctctctttactttctctcattctatttctcttctactttcccacatcccctttttggagactgtgttgtactaatcttttttttcttttaattatactttaagttctgggatacatgtgcagaatgtgaaggtttgttacataggtatacacgtgccatggtggtttgctgcacccatcaacctgtcatctacattaggtgtttttcctaatgctatcccttccctagcttcccatcccccgacaggcctcggtgtgtgatgttccccctccctgtgtccatgtgttctcactgttccacttccacttatgagtgagaacatgtgctgttgggttttctgttcctgtgttagtttgctgagaatgatggtttccagcttcatccatgtccctgcaaaggacatgaactcatcctttttatggctgcatagtattccacagtatatatgtgccacattttctttatccagtctgtcgttgatgggcatttgggttggttccaagtctttactattgtgaacagtgctgcaataaacatacgtgtgcatgtgtctttatagtagaatgatttataatcctttgggtatatacccagtaatgggattgctgggtcaaatggtattgctggttctagatccttgaggaatcaccacactgtcttccacaatggttgaaccaatttacactcccaacaacagtgtaaaaacattcctatttctccacatcctctccagcatctgttgtttcctgactttttaaattattgccattctagctggcatgagatggtatctcattgtggttttgatttatatttctctaatgaccagtgatgatgagcttttttttttcacgtttgttggctgcataaatgtcttcttttgagaagtgtctgttcatatcctttgcccattttttatgggtttttttcttgtttatttaagcatttaagttgtttaagccatttgtttaagttccttgtagattctggatattagccatttgtcagatgggtagattgcaaaaattttctcccattcggtaggttgcctgttcactctgatgatggtttcttttgctgtgtagaagttctttagtttaattagatcccatttgtctattttggcttttgttgccattgcttttggtgttttagtcatgaagtctttgcccacacctatgtcctgaatagtattggctaggttttcttctggggtttttatgagtttaggtcttacatttaagtctttaatccatcttgaattaatctttgtataagttgtaaggaagggatccagtttcagttttctgcatatggctagccagttttcccaacaccatttattaaatagggaatcctttccccattgcttgcttttgtcaggtttgtcaaagatcagatagttgtagatatgcagcgttatttctgaggcctccattctgttccattggtttatatatctgttctggtaccagtaccatgctgttttggttactgtagccttgcagtatagtttgaagtcaggtagcatgatgcctccagctttgttcttcttgcttaggattgtcttggctatacaggctcttttttggttccatatgaaatttaaagtagtttttttctaattctgtgaagaaagtcaatggtagcttgatggggatagcattgaatctgtaaattactttgggcagtatggccattttcatgatactgattctttctatccgtgagaattgaatgtttttccatttttttgtgttctctcttattttcttgagtagtggtttgtagttctccttgaagaagtccttcacatcccttgtaaattggattcctaggtattttattctcttagtagcaattgtgaatgggagttcactcatgttttggctgtctattattggtgtataggaatgcttgtgatttttgcacattgattttgtatcttgaggctttgctgaagttgcttctcagcttaaggagattttgggctgagacgatggggttttctaaatatacaataatgtcatctgcaaacagagacaatttgacttcctctcttcctatttgaataccctttatttctttctcttgcctgattgccctggccagaacttccaatactatgttgaataggaatggtgagagagggcatcatccttgtcttgtgccagttttcaaagggaatgcttccagcttttgcccattcagtatgatactggctgtgagtttgtcataaatagctcttattattttgagattcgttccatcaatacctagtttattaagagtttttagcatgaagaagtgttgaattttatcaaaggccttttctgcatctattgagacaatcatgtggtttttgtcattggttctgtttatgtgatggattatgtttattgatttgcatatgttgaaccaggcttgcatcccagggatgataagctgacttgattttggtaggtaagctttttgatgtgctgatggatttggtttgctggcattttattggaaattttcacatcgatattcatcagcgatattggcctgaaattttcttttttgtgtgtgtgtgtctgtgccaggttttggcatcaagatgatgatggcctcataaaatgagttagggaggagtccctctttttctgttgtttggaatagtttcagaaggaatggtaccagctcctctttgtacctctggtaaaattcagctgtgaatccatctggtcctgggctttttttttttttggttggtaggctattaattactgcctcaatttaaaaacttgttatttgtctgtttaggggtttgacttcttcctggtttagtcttgggagggtgtatgcgtccaggaatttactaatttcttccagattttccagtttatttgcatagaggtgtttatgatattctttgatggtagtttgtatttctgtgggatcagtggtgatatcccctttatcatttcttattgtgtccatttgattcttctctcttttcttctttataagtctgcctagcagtctatctattttgttgatcttttaaaaaaaaccacctcctggatttgttgatttttttgaagggtttttcgtgtctctatcttcttcagttctgctctgatcttggttatttcttgtcttctgctagcttttgaatttgtttgctcttgcttctctagttcctttaattgtgatgttagggtgtcgattttagatctttcctgctttctcctgtggacatttagtgctataattctttctctaaacactgctttagctatgtcccagagattctggtacgttatgtctttgttctcattggtttcaacgaacttatttatttctgccttaatttagttatttacccagtagtcattcaggagcagattgttcagtttccatgtagttgtgtggttttgagtgagtttcttaatcctgagttctaatttgattgcactgtggtctgagacactgtttgttatgatttctgttcttttgcatttgctgaggagagttttacttccaattatgtggttgattttagaataagtgcgatgtggtgctgagaaaaatgtatattctgttgatttggggtggagagttctgcagatgtttattaggtctgtttggtccagagctgagttcaagtcttgaatatccttgttaattttctgtctcgttgatctctctcatattgacagtggggtgttaagttttcccactattattgtgtgggtgtttaagactctttgcacgtctctaagaacttgctttatgaatcttggtgctcctgtattgggtgcatatatatttaggatagttagctcttcttgttgcatcgatccctttaccgttatgtaatgctgttctttgtgtttttttgatctttgttggtttaaagtctgttttaccagagactaggattgtaacccctgttttttttttttttttttttttttttttgctttccatttgcttggtaaatattcctccatccctttattttgagcctatatgtgtctttgcacatgagatgggtctcctgaatacagcacaccaatgggtcttgactctttccagtttgccagtctgtgtcttttaattggggcatttagcccatttacatttaaggttaatattgttatgtgtgaatttgatcctgttattatgatgctagctggttatttttaccattagttgttgcagtttcttcaaaatgtcgatggtttttacaatttgatatgtttttgcagtggctggtaccagtttttcctttccatatttagtgcttccttcaggagctcttgtaaggcaggcgtggtgctgacaaaatctctcagcatttgcttgtctgtagaggattttatttctccttcgcttatgaagctgagtttgactggatatgaaattctgagttgaaaatacttttctttaagaatggtgaatattggcctccactctcttctggcttgtaggatttctgcagagagaaggagaagtctgatgggcttccctttgtgggtaacccaacctttctctctggctgcccttaacattttttccttcatttcaaccttggtgaatctgacaattatgtgtcttggggttgctcttctcgaggtgtgtctttgtggtgttctctgtacttcctgaatttgaatgttggtctgtctcgttaggttggggaagttctccttgataatatcctgaagtgtgttttccagcttggttccattctccccatcactttcaggtacaccaatcaagtgtaagtttggtcttttcagatagtcttatatttctggaaggttttatttgttcctttttattcttatttctctaatcttgtcttcatgctttattttattaagttgatctttagtctctgatatcctttcttctgcttgattgattggctgttgatacttgtgcatgattcacaaagttctcatgctgcgtttttcagctccatcaagtcatttatgttcttctccaaactggttattctagttagcaattcctctaaccattttttaaggttcttagcttccttgctttgcgttagaacaggctcctttagctcagaggagtttgttattacccacttgctttccattatcttatttaagcaatgcaacaacattttgagataagaatttatattagtgtatgggacatatagatcaagtgcttagcacacatgcccatatacatgtacacacacatccccatgccgctgatagaatttttcaatttaaataactgaaatggcagtgaaataccccaattttcagcctataaggctattgggcatttttgttttggcatggcaaaataatcccaatatagcccatctttcccactgattacaactataaactctggacaaaatacaaacaaaacaaaatactatctgaggattttgaaaagtaaaccgaaacaggcagattgttgaagagggtcaaaacttggacaagtaaccactggtggtgagtttcacattttttccattctttcttaacagctgtacccaaagggttctcattatggagcagcgagggaatggtggcagcgtgggcagataaaatctcaatagaaacccagtcctactggctagagtaactaagaaaaggggctctagggggatggagagtgaggagagaataccagagtggagagaactggagaaaaaattcccaattctgtatatgaatctgcacaagtctcaggctcattctcaaagaaaaagaggagtaatagatgcaactagcatagtacaggttttgacaaccaaactgaggtttgaaccactgcccacagatggcaagatagaacttgcagtctaagcctaaacagttgattgccataaaacaagaacatcaacattctacagaggattataataggatccagtgcctgtaaaatgtaaatccacaatgcccagataccattccaaagttatatgacatataaaaaagcagaaaaatgtgttcacatttttaccccagtggaaaagataatcaacatatgaccagatcaaggtgacccagatgttggaatcatcagacacaggctttaaaatagctattatagctgcataccatggagtaaggaatccatccttgaaatgtatgagaagatagaagtggatatcttaaaactgcaaaagaataaaatgaaaaatttagaactgaaaaatgcagtatctgaaaactggatgggctgaatagcaaaatgaaaatatagaagaaacaccccagtgaacttaagaatagatcaatagaagttatccaatctgaagaacagagaaaaaatattgaaaaagaggaacacaaccttagcgacctgtagcataatatcaataggtgtcactggaatctcagaaggaaaggagaagaagactgggatagacaaatatatctgaaggaataatggccagcatttttctcaaatttggtaaaagacacaatttacagatccaagaagctccatgaaccctgaacaggataaaatcaaagaatatgatacctgatactcatggaaataaaagctataaaaaccaatgatgaattttaaaatcctgaaagacattagagaaaaaaagcacattacattcagaggaccagtcattcagatgactgcagatttctcatcagaagccatggaaggccagaagacagtcaaacagcatcttgaaagtgctgcaagaagagaactgttaacttaaaattcttcattcagtgggtatgtcttccaggaatgaaagcaaaataaagacattctcagattaaaaaatttaacagaatatattgccaggaaatcagcattatgagaaatgctaaagtaagttcttcaagctgataggaaatgataccagagcaaaccttggatcttcaggaatgaaagaagagcaacagaaatggtaaatatttttccctgtgcttaggtactaccactgaaaacaaatttacatttctggagggattttcaatatatgtagatataatacatataacagccgtaccataaaggttagttgaggagataaaagttaaggaggtagaccgggcgtggtggcttatgcctgtaatcccagcactttgggaggctgaggcagatagatcacaaggtcaagagattgagaccatcctggccaacaaggtgaaaaccccatctctactaaaaatataaaattagctgggcgtggtggcgtgtgcctgtagtcccagatacttgggaggctgaggcaggagaatcgcttgaacctgagaggcggaggttgcagtgaagccaagattgcaccactgcactccagcctggtgaaggagtgagattctgtaaaaaaaaaaaaaagttgaggaggtaaaagtcttatggttgtaagacttctacaatttacataaaatggtagcataggaactctgtctagaatatgatatatgatatatatacctggggtgtgtgtgtgtgtgtgtgtgtatatatatatatatatatatacacacacatatacatatatatatacatacatatacatatatatatatacacacatacatatacatatatatatatacacctggccttcataatattatattgtatctatatatgttatataggctgggtgcagtggcttacacctataatcccacactttggaagtccaaggtgggcggataacctgaggtcaggagtttggccaacatggcgaaaccccatctctactaaaaatacaaaaattagccaggtatggtggcaggcgcctgtaatcccagctactcgggaggctgaggcagaagaatcacttgaacctgggaggcggaggttgcagtgagcagagtttgagccattgcactccagcctgggacagagtgagactgtctcaaaaaaaaaaaaaaaaacaccaaaacaaaacatatatatatatattatatataccacatatataaataaaaaactccaaaaaaccaaaacaaaaagatatagtgaaaaaactgaagataaattaaaatagaatactaaaaaatattcaaagaatccaaaacaagcaaaaaaataaaaataaaaaaggaatggaggtaagagaatagcaacaacaaaagcaggagacaaatagaagccaaaaataaaaatggaagggctaaattcaattatagcaataattccattaaatgttaatgatcttaatactccgttagaaggcaagggttgacagagtgcataaaaatcaagacgctactactatatgctgcccctaagaaatacactttaaatataaatatacaaaaaaggttgaaaataaacaaatgtaaaatgtatataccatacaaatagtaagaatgagaagattggattggttattttaatatcagataaaacagacttcaagacaaagagtatttctagagacaaagggggggatttcataatgattgaagggtcatttcgtcaggcagacacttcattcatacgtgtacacacacctaataagagagacttaaaatactgcagtaaagattaaccaaattacagggagaaatagaaattccataattgtgacagaagattttaatatcctttctcaatatttgatggaacaactagacaaaaaagcagtaaaggtatagttttaacattgtaaacctccttgatttaattgatatttatagaacactacatccgacaactgcagaatacctatttctttcaaatgcacataacattcaccaagacgaacaatgacggctaaaaaaaaaaaaagaaaaaaaaaggatggtaagctataaaacagatttcaaaatgtagaagaagcaaaatcataggaagtatatttctgaacacaacagaattaagttagaaatcaataacaagatatctaggaaaacctcaagtattatgaattgaatagcatacttcaaatatttcataggtcaaagaaaaaaatgacaagagaaattagaaaatattttatctgaatgataatgcaaatatacaaagtttgtgaaaagagctaaagcagtacttaaagtgaaaactatggctttaaatgcttatgttagaaaaggagaaagatttaaaatcaataacctaaggtcctaccttaagaaactaaaagaagagcaaagtaaccctaaagtagtagaaggaagtcaataataaagatagtagaaataaaatagaaaacagacaagcgaaagagaaaaatcaagaaaaccaaaagcgaagtttttgaaaagatgaaccccaaacctctagctagattggccaaggaagagagagaaacaaattaccaatatcagcaataaaaaggaattctaaccacagattctatagacaataacaagataataagaaaatgctatgttatcgaattctaccacttaaataaaatggacagatttcttgaaaaatgtagcttaccaaaattgatgcaagatgaaataaaaaatttaaatggtgctatttttttgagaatataattattttaccttttatttaatgctttgtgtattgtttgaatttttcttttgttcaactatgtgtgaatgtatttgacagttaaaatgaaaaaattttaattttttaatattatattttctttttttaaaacttgtattttaggttcaggggtacatgtggaggattgttatataggtaaattgcatgtcatgggggtttggtgtacagattgtttcatcaccgaggtgataagcatagtatctgataggtagttttttgatcctcaccttcctcctgctctctaccctcaagtaggccctggagtctattgttcctttctttgtgttcatataaactcaatgtttagcccccacttataagtgagaacatgttatatttggttttctgttcctgtgttagtttgcttgggataatggcctccagcttcatccatgttgctgccaatgacacgattgcattctttttttatgggtgcatagtattccgttgtgtttacgtaccatattttctttatccagtctaccactgatgagcacttagattgattccatgtcttgctattgtgactagttctgtagtgaacataacatgtgaatgtgtctttatggtagaacaatttatacttctttgggtatatactcaatgatgggattgctgggtcaaatggtaattctgctttaaattatttgggaaattgccaagctgctttccacaatggctgaattaatttacatttccatcagcagtgtataagcagcgtacaaccttataccagtgtataaggttgtagtgtataatctctgtaatcttgccagcatctgttattgtttttttcagtaatagccacactgactggtgtgagatggtatcttattgtggttttgatttgcatttctctaatgattcgtgatgttgaaaatttgttcataagcttgttggctgtgtgtacttttgaaaagtgtctgttcatgtcctttgcctactttttaatggcattgtttatttgcttattaatttgtttcttatagattctggatattagaccttttttggatacatagtttgcagatattttctcccattctgttgtctgtttactttgctgatagtttcttttgctgtgcagctctttagtttaattaggtcccatttgtcaattttgttgttgtaattgcttttggcatcttcgtcatgaaatgtttgccaggccctatgtccagaatggtatttcctaagttatcttccagggcttttatggttttacacttaagtctttaagccattatgagttgatatttgtatatggtgtaaggaagggttccagtttcaatcttctccatatggctagccacttatcccagcaccacttatagaatagggtgtcctttccccattgcttattttttgactactttctcaaagatcagatggttgtacatgggcagttttatttctgggctctctattctgttccattggtctatgtatctgtttttgtgccaggaccatgctgttttggttactgtagacttgttgtatagtttgaagtgaggtaatgtgatgcatccagatttgctctttttgcttaggattgccttggctatttggactcctttttgattccatatgaattttaaaatagtttttttctaattctatgaagaatggcattggtagtttgataggaaaaacattgaatttgtaaattgctttgggcaatatggccattttaacaatattgattcttcctgttcatgagcatgaaatgtttttccatttgtctgtgttatctctgatttctttcagaagtgtcttataatttgtgttgtagaggtctctcacctctgtattcctagatattttattctttttgtggctattgtaaatgggttgcattttttatttggctttcagcctgggtattgttggtgtataggaatgttactaatttttgtacattgattttgtatcctgaaactctgctgaagttgtttatcagatctaggagcttttggacaaagactatggggttttctaggtataggatcatattttctggaaacagggatagtttaatttcctttcttcctgtttggatgccttgtatttctttctcttgcctgattatcctggctaggacttccagtactatgttgaataggagtggtgagagagggtatccttgtcttgttccagttctcaaggggaatgtttctagcttttatccattcagtatgatattggttgtggggtttttcatcgacggcttttttttttttagactgagtttcactcttgttgcctaggctggagtgcaatggcacaatctcggctcactgcaacctccgccccccgagttcaagcaattctcctgcctcagcctcccaagtagctgggattacaggcgcccaccaccatacccagctaattttttctatttttagtggagacgggggttttatcatgttggccaggctggtcttgaactcctggcctcaagtgatctgcctgcctcggcctcccaaattgctgggattacaagcatgtgccaccgtgcctggctggctcttactattttgaggcatgtgccttcagtgcgtagtttgttgagggtttctttttaatgtgaagcaatgttgaattctattgaaagccctttctccatctgttgagataatcacatggtttttgtttttagttctgttgatgtgatgaatcacaattattaatttacttatgttgagccaagcttgcatcccaaggataaagcctacttgatcactgattaactttttgatgtgctgctggattctgtttgctaatattttgttgaagatttttgcatcaatgttcatcaaggatattggcctgaagttttctttttttgttgggtctctgccaggttttggtatcaggatgatgttgtcattgtagatcgagttaggggggagtccctcctcttcaatttttcagaatagtttcagtaggaatggtattatttagattttgggcattatttgaatttttttctttttcatttttttctcttttttaaaaaataattttaacttttattttagattcaggtgtacatgtgcagatttgttacctgggtatattgcatggtatatccaggtttgggatatgcttgatcccatcacacaggtactgagcctagtacccaataatcagtttttcagccctcgcccgcctctctccttcctccctctgctaatccccggtgtctgttgttgccatctttatgttcatgagtacccactgtttagcttccacttataagtgagaacatgcagtatttggttttctgttcctgcattaatttgcttagaataatggcctccagctccatccacattgctgcaaagaacacgatttcattcttttttatggctgtataggactccatggtgtatctgtaccacgttttctttatccaatccactgttgacgggtatctaggttgattccatgtctttgctattgtgaagagtgttgcgatgaacatgcaattgagtgtatctttatggtagaatgatttattttcttttggatatagatccagtaatgggatcgcggggttgaatggtaaggctgttttaagttctttgagaaatctccaagctgcttttcacaatggttgaactaatttacattcccaccaacaatatataaccattcctttttctctgcaacctcaccagtatctgttgttttttgagtttttaataataggtattctgactggtgtgagatgatatctcattgtggttttgatttatgaccctgggtagtcaaaggtttcttaggtagaacacaaaattcattaattgtaaagaaaaaaattgattacttagacttaccagaattaaaacattagttccttgaaagacaccataaagagaacagaaatgcaagccacacactgggagaaaatattcttagctcatgtattaaacagaagacttgtattcagaatatacaaagaactcttacaactccaagaaaatggttaaaaggtttaaacagatacttcacaaaaaaatggtatataaacggtgcaacaacgcacttaaagatggttcaacatcaccccttagaatagcaaaaatcaaaaagacccaatgctggcaaggcaaagctgtggagcaactggaactcccacaatttgctgatgggactttaagatggtgcaaccatttttgttgtaccatttggaaaacagcttggcagtttctgaaaatgttaaacatatgcctatagcatgacccagccattccactcctgggcatttacccaaaagaaagcatatgttcctacaaaacctgtacatgaatgttcacagcagctttatttttaacggttccaaattgaaaacaactcaaaggtccatcaacaggtgactgtataaataaatagtgatttatacaatggactactactcatcaatacaaaggaatgaactatggatgcatataacaacatggatgaatctcaaaatcattttggtgaataaaagaagccaggcacaaaaggatacatactgtttgattctattcatataaaattctggaaaacacaattttattctagatcctttattctttgaatagttgaattttaattccttttatattttccatgtaaagtttaagccctttaaaacatccatgtgcagaagttgagagagggaagaagtgtaggccaaagatgtagcattggaagtcaagaagaaaatagtctttataatctcaggagtgacatatttaaataaggaaagtgtagcaaaaagaaagtttaggactgagttctgaggaacacaaacaattcaaggtgggtaaatgaggtaaagccagtacaggaagctgaggaggaacagctaatggggttgaaggaaacccaggacaatgtatgatcagagaaaccaacagagaaacatgcttcaaaaaggaatgaagggttaactatgcccaactccaccaaaagctgagtaagttgagggtataattagtgcccaagaactatgggagtttgaatttgcaaacagaaaaaaaaaataagtagagctttgcaactatgcaagtagttacttgctagtatataacaaattttgcttaacttattcttgaattaacaggttttttatttcaaggagtacaaaattagaaataattaaaataaaaataaaaaataggttcaaaatacacaaaatcctagttactatagaccgtttcgatgtttcaccgggtacagaggttattaaattacattattaacttttaactctttgatagtcaccatctttactgctcttgaaattttaattataaaccattatttatcttattactataatttttactgtcataatcaaagaatttctgagattttcaaccaacccatatgatgaaggtatgaaacatctttttatcaccaagatgggaaaacaatggcaaactcttgcatcaatcaagttaaatgaattggttatagatggttcttagtgttggattttcacctgaagtatctgccatcagcctttcatgggaaatattttaatttaattttgaaattaaaacagtggtgtagtttcattttgatttgtatagaaaagggcttagatagtaatgcagtataaacaaccctgacagaaatcttgatttatcggttcttgggggattcagcaaaggctttagggcatgaaaggcataaagaaaacttggcaggaaccagagcagaggaaggcaagatactagccagctagcatggtgttttttccctgttctctgacagaaggaggacagccatgtgaggaagataatcatggcagcaaaagttgctaaagaaagttgcttaagctaaaatcatcaaggaatttgaggcaatgacagttcatcatctagagagatggactctaactggatgaatatacaaagctctgctttctgagaagcaggatacgtctgctgagagacagctgggagtgaactaagcttcattctgcaatctttttgctgacatttgccataatattttcagtgatgtgtaagaaatgcaattctgtaattacatggtctcctggctgtggtctccatccaaagcatgatagtgtctggacccccaccctaagagtttaacacctcctgagtgtacaggctcattttggccctaatggagagaaaaccagcagtgcagaaattcctcaggtgcagcacggtccatgataggagcccactgagtaataaatgccagaggaagttagggtgaaagagacaaccctgccagtaatggtttttaaaggctccatggaaactcttaacctttcaccaccttaaggcaaagagggactgctctgtcctccttcatatgcagactctactttcctttgtggtttccttttctctgtgcagttgccttcagtcgagtttgatagagtggaagggtggggaaatagaggaaatggaagagaagaaagagagtgattttcttcatcctgtcctggatctggatcccttttaataggatctctcctggacagttctgagcacttcgaagtgcatccaattcaggtcacagtaggtgggcaaaggacttcagaccctggagacacaaaggtaacagctcctctttacactgccaccgtctgctttttagtaggaaacctgggagccccgggcagctaccttaatgtagataagagctggcggggtgaggaaaagcgctgggctgtgagtcaggagatttgagcccctgcttactaattgaatgattctgggccagttacttaagtttctctgtgtcagcttctcatttttaaaatgggaaaaacagtactcaccctatctctttaaagggccatcctaaggatctgaagatgatgtacatgcaagtccctattggaccataaaagtttattaaaagttaagtataaaggctcttaagaagttacattaattaagaatattttaatttaaagatctgaaatatattaggggactttcttcttgaaatcccatggtgattctcgtgtaatatgaagaaggaaagttgatgggtgtcttctctaacgagaactctgattagtggaaggttaagggggtgatatcaaataggtaaacagagaaagattgtttcaattgcaggaactagaatgtgtgtagtgaaggaaaaaccacagactgaactttggaaggagtcccatgcaggtttgtaatcttcatgtagggcagagcttcccaatgggtgggtgtgaatagattacaggcatgaaatattggtctggattagttgccttgatggagaacacagtcgtaggtggccaccccgaatctctgccttcacacattgataggtctgttcctgcgttattgttatcgatatgcccatggagtgacatctatgttatcttcaggagcaccgcactaataatgacttgtgtgcactctgcccattagaatttcattattattttgaaattcttaacgtgaaaaaatttggttttgcaacacatttatattatcagctaatattttaatttaaaagaagagcttagattctttaaacagctttaataattatgaatttctgaatgattataagatgtttaaacaattttaatcacttgcttgtgcaaagttttgcttggtgttactgagaattttaaagacagcatgattttaagaagcctagtgaagaagcacatgtagccattttatgcataaaaccttataggaaaaagttagattcaaaggcgtaagctgaaatttttaaataaaaatttgaaaagatcttatttggaagtttaaaataattcaatacttaatagcttccctaatactttcagttttcaatcataaatatataagaaagtcatagtgatttctctcagctttcttccaatttactccattgtgtcacacaagtattatcattgcctctgactgccatgacatgacaccattggagagcagtaaactaaagaaaggcccatcacttggttattggctatctaattgttattgagtttcctgtgagctggtagtaccttgcttcatcagcttaacccactgccaaaagttctttatgcttcttctttgtattatgagcacattttcctctaaagctcttaagtacttgtaaatcaaggctggcattagggtgtttggatacagagattatggatagtaaatgtgaatttcttaattcattgcaattccaacactacccctgagaaaacagcccaagccacatggtacttagaggtaaaagttctctcttgatcaaagacaggtttcttttatgagctggtttcttagagccttctcttgattttgcaggaaaatgggggtggctgcccccatccagtactcagggctctcctgaaagtgctggctgtgggctggtagatatccactttccagagcctactgggatgtggagttcttgcagcaaggaaaccctcctgctgtccctggggctagggaaggtgtctggtgggaattctaggtatctttctgccagtagtaaattacttcatgtttgacttcaagttcttaggttcaattttttaggtattaaaattggtgagggtaaatgtagtaacttactgttttcttccaacaataaacactcaactctggatgacacagttggggctttttataatgactttggcaatttatggcagcatggtatagtgaaaagaacatagcttctggaatcagacaggcctaagttcaaatttgaactctgtcacttactaggtggccttaacctctctgagtctcagtttctttacctgtgtaatgcaaacaataccctaactcctgggattgggacaagatttaaaatgggagaacatatggcaagcacccagtttaatgcttggcacgtagtattcagtcaatgacaggtattattgttattgctctattattagcccgtaattacattcaaaaggacatgtattcagataaacattactagcagcttgagcaggtgatagggcatttgtaatttaacttgtgtgcttatttcagactcaaaaattactttatctcagaagtaaatcagaactcctttcccttctcaccctggactaggggtagataaaggggtggggctgcttcactaaccttctgtgggttaaagactaaatgaagactttctaaaaaccagaatgctaacagtggttccctctggtaagtgggacttcaggtgctttttcctttcttggtattattctgaagtctaaaaagtcaagctattttcattttgtaaacataaaccagaccaaagatgcggaatggtaaatttttttatttctttgaaaacttcgttcagcagctgcacacatcccacccccccaccccatccaaccccacactccccaaccatgtatcctactaagtcggtcaactcggtccctggctcctaccaggggcatcatggtgctggaaaggttttctcgttttcctccaggcaggagggaacatgatctacaggcaatcaatgaaaagcagcagcaaagtaacgcgggtaatgttcaaaaataagacaaaacaaaaaacctaactgcaagcttcagaatctgggaaaccagctagaagaagagagggagggaagtgggggaagcaggacggataaaaatacagttacaacaagaaggaaatggaaaataaataaaggaaattccttcacccaaactaagtcccttgagggagatttgttagaatggatggtggttggggggcaggggagaggggataaaattcatgtaggactgtacaatttgtgggggattcttctaaaatcatttcaaaaaggacagccaagcagaattcatacaggactcatttggatttattactctcttttgcagtctacactttctgaagtgtggatttatgagttttagatcatttgtttcccgtcccactaaggtaaatagctcagtgcgtttggtgcatttatgattgttgtgcagaggagtgcagctgatgaattacttcctttcatttatcttttgaccagaaaatgtatggttttctagcaatttaacttttaatctgtaacatttttcttctcagttttgttgcaggtgcagtatagctgtttctaatctagggaggttgggtggcccagaggttagatctatgctatcaaatatggtagcccctggctggtaagcacttgaaatgtggctagtctgaatagagatgtgctacaagagcttagtggattttggagccttggtatgaaaaaaagaaagtaaactatctcattaataatttttatattgatttacatgctaaaattataatattttggtcaaagtgggataaatataatatgttattaaaattaatttcatctgtttcttcttcttactttataaatgtggctacaagaatacttaaaattacatatgtggctcgcatttgtggctggcattatatttctattggacagtgttgaattaagagcaagagcttgggaagttcaagtcatttcctgccttatgaacttggataaattatgaaaactctctaagcttcaattttcaactagttaaacaggaataataatatctacctaacagggttgtaatgattcatatgttgtgattaatatataattatatttataataatataagtaacataaacatgtcattatttatggtattacttgaaataattcctgtgatatctggcagataatatgcactgggcaaatgctgattctcttccttgtgcattttacttaccactagtaaatgtggccactttgtttataatgaattgtttgggatcaggataaagtagcctgtacttgtgtatttctcttcatctaaaagattagagtccttgacaaatagacagtcacacaaggtctcagaagggaagaccaccattttcagctagatggagaatgagtttgtggctgaacattatacctgtggcatctcccatatatcattagctgctgtgattgttagacacacttggaggcattgattaaagttgttaatcttttgaagtgtctgaggttgtcttttaaagcccccacataagtttctgatcatctccaagagttaacaagtggagtacgcctggagatattatgaagtagacaattaaaaaaacagggccagtctcatcacaacttctctttctccttctactccctattaattttcagccattagagagtaaaattatgtggtttggagttggtttgccttttcaagccccaagggattataacccttagttatagattaccttcaggtgtcaggttttcttcagggatggcactcttttatgaatagaacccctaccaatagaaccaagcacctgtgaaatccaccctctgtactgctcacccagccttctctacttgcaagttgtcccaaaatgttacaactaggaaatgtgagtttttggtggcaacaaaggtggggttttttttgcccacaaaagtgaattcaagggatttattttggttttaaaattaatattcactttttaaaggtacaaatttgaaaacctagttattcctttagtttttaaactcagcttacagctcttattattttatttatgtcaacacatttaacaatcactcttaagatgggcttcgaataatgttttaatttacaaattgtacttctccctatttaacttctctttacagttaaatattttgattttctttaacaaaacttttctgaagatttaaattatgcttataagtttataaaataaatttatacatatgctgattcttaatttctcttaaatattctaatactatacataattgtagtaagattgatgtttaaaatcacaagtctatatgaattattcaatgaacaatttaaagctggaattacaagtctcatctattgctctcttagggcaaaactgcttaaatcctttatgcttacattccttctaattctattgggtaaacgactttggaagttgcaacaagatagatgaataaatgagatacgtccagaattcaaaggggttatcattttaatatccattcaaattgcatgaccctaagactggaagcatatgaaaagaatacagcaatcttttaagagtctttaacatagaaaatatatatgttatgagacaatctcatggacattaaaagtataataaaggaatgctgtgaacaactccatgtgacaaaatttgatatcgtagagaaaatgaaccaattctttgaaacataaataatcaaaactcacaaaaggggaaatagataagctaaatagtcttatatgtattaaagaaattgaatcaataatgaataacctccaccaaaagacagcatcaggaccagtgaattctaccaaactgtgaaggaagaaaccagccttaccctaataccaaaaccagacaatgtacaagaaaggaaaactataggctaatatctcttatgaacatagatgcaaaaatcctcaacaaaatattagcaaattgcatccatcaatgtataaaaagtaatatattactatcatttgggattcattccaggtatgcaaggctggttcgacatatgaaaatcattcaatgtaatcaattacattaacaggctaaccaaagaagaaaaatcatacaattgtatcatttgatgtagaaaagtcatttgacagaatctaacaccccttcatgataaaaattcatcaaaccaggaataaaggggaacttcctcagcttgataaagaccgtctacaaaaatctcaaaactaacatactaaaatggtaagagactggatgctttccccataagattgggaacaagaaaggatgtcctctttcaccactccaatttaaaattgtactggggctgggcgaggtggctcatgcctgtaatcctagcactttgggaggccaaggtagatggatcacttgaggtcaggagttcaagaccagcctggctaacatggtgaaaacccatccctaccaaaaaatacaaaaattagctgggcgtggtggtgtgtgcctgtagttccagctactcaggaggctgaggtgggagaattgcttgaacccaggagttggaggttacagtgagctgagattgtgtcactgcactctggcctggatgacacagtgagaccctgtctcgataaataaataaataaataaataaataaaattatactggaagtcctatttagtgcaataacatgagataaaaaaataaaagtatacaaattagaaaggaagaaataaaattgtctttattcatagatgacatgattgtctatatagaaaatctcaaagaatcaacacaaaaactcctggatctaaaaagcaattatagcaagattgcaagatatgaggttaataaacataaatcagttgcttttctgtatatcagtaataagcaattggactttgaagttaaaaaaaaaaccctttataataacatccaaaaatgacatacttagttatatatctgaaaaaactaggtataagatttatatgtggaaagccataaaacactgatgaaagaaatcaaagaaggtccagataaatggagagatattctgtgttcatgactggattgctaaaatgtcaattcttcccaatttgatctatggattcaatgcaatcccaattaaattccatcaagctattttgtgaatatcaacaaatggactctgacatttatatggagacacaaaagaattaaaatagcaaacatactgctgaaaaagaacaaagttagagaactatccaattgccaggcctactgtgcagctacggtaatcaacacattgttttcaagaaatgacagatatggaacagaatagagaacccagaaatagatccatacaaatatggtcaactaatctttgacaaaggaataaaggcaattcgatggagaaataatagtctttgtcatttcaataaatagtgctggaacaatggaagtccacatgtagaaaaaaaaaatgacacagatcttacatttttggatagttggttttgagctgtgatttttaggttgaaattttaattagcttatatttggtataaaatcaaaattcaccatatttacaaatttaatttatcagatatataagaattactttaagtacagaggaaaatttgttggataaatacaattgcaatacttaaaaagtatactgaatatgttaaatttataaatttagttgtaacacttgaacattaagaatcaatattatccaaagagctcttaaaagtgattgttaaaatctgctacagttaccaataaaataatacttgtaagctgaacttaaaagtttaaggaataatcaagtttctgtattcttttttaaatgtgtgacaggcgttcagaggatcatttagaatccttggttcataacacattctcatcattggtccattcttggtatttatttggttggtaactttaataaaattaactcacttactattaatttttatatccaaagtaaactctgaatagtcttttctttattccaaaactgtctgtgagcccataaaaatctcacatattcataggatgaaggtgggatgtggaaagggtctaaaatgtgttttcgtgaataaaaatgattgtttagaaatagtagcatttagcctagttattaaagacaggacatttgagtaatttaaaaaaatagatgaaatggaaaaacactcacccaataaggtttctattgtaaaaaggccaaagggaacgacattcagaataaaaagtcttatacttggaagtgaacagataactaaatttaatgagatggtctgggacacataggaaccctcaaaatgttactagaaggttatggtgagcctagaatattgaggggtgagtttgggccatctaggtgaaaatgtcagctagacagtcatagatataatactagcactctcggggaaattggaattgagaacacaatgtgggaaccaccagcttagaggcaagagctgaagctctgaagatagtgaaggcctccctgggggagatgggaagagaggaatgaaggcagaagaaaagttgtttttctttcaaatcctctatattttatattattccctgcttccttttcctcctgcttcctgggttgggatggggatatctcctcttggcttataaaattatctagagaccaggagccaccttgtagagtaggggtccccaacctctgggccatggaccagtaccagtccatggtctgttagcaacagggccgcacagcaggaggtgaatagcaggcgagtgagtgaagcttcatttgtatttacaaccacgccccatcactcccattaccctctgagctcagcctcctgtcagatcagtggtggctttagattctcacaggagtgtgaaccctatggtgaatggtgcatgcaagggatctagattgcgtgctctttatgagaatctagtgcataatgatctgtcactgtctcctatcacccccaggtgggactgtttagttgcaggaaaacaagctcagggctcccattgattctacatgataaagagttgtatacttcattatatattacaatctaataataatataaataaattgcacagtaagtgtaatgcgcttgtatcatcctgaaccatccccctccactctgtgtctgtggaaaagttgtcctccatgaaaccagtccctggtatcaaaaatgttggggatcactgttgtagaggacacagagaggttattttgagaaccccaaagctgttacaaacacacccaatagacagcacacctatataactataggtattcaagggcagttactacaagacaagttttcaggaccaacttttcatctttgagcggatgcacagtccggactggttttcttccgtaagagagaaagagggagagcaaaagtgagaacttttggggcagggaggaaaagtcaaagggggatggtcaggttcaagcatgaggcccttggagactgctggccaggggtgctgcagagtcaccgtttctattgtgtaaactttcctatgctgacagattgcctggtgtgataacttcactcttgtgtgcaaatactcttccttaaagacacatagagaaaagctggccaagacccaagaaatggctgtagaaagatattcattctcagggcatttctgaaaacacattttctctacattttcagctttcaaattgtataaattttctcttgacttctgactcaaaaatcttctcaaaccaggcatgtcagtttcttaattaaaaatggtgtcttagtctgtgaggcctaccataacaacataccacagactgtgtggcttaaaccacaaaatgtattttctcacaattctggaggctcgaagtctaagattaaggtgtctgcagatttggtttcatctgaggcttctgtccttggcttgcagatggctgccttcttgttgtgtcttcacagggcctttttctctgtgcctgagtatccctggtatcttttctttttgtaaggacaccagtcccaatgtattagggcccattgttttgatctctttaaccttatttacctctttaaaggtcccatctccaaatatagtcacattggggatttgagcttcagtatatgaatttgtgtgtgtctgtgaggggggaaataattcagtccataataaatagtaagctgagatttgtctactatggactccctgtcacacagtaagtacttagcaaatatttgtagaatgagtcaggctgtgactgggtaactcatttatcaatgtgctgccatattttttaaagtctcataaaccttagtcaattaaataaatttttcattttgcaagagttggtaatgatggcctagtaactttataaatgggctaaaatcaatatacttatctttaacatgagccctagagggtcagatcaagccatagtgcaagaccctagtataattcctttcctttactgaagtgttacgctggaacaacattgcagtgaaggtttaaaactaaatattgaagatgaggtggttttgcaaactttctggatgatgtgtgttaagaggcacagaaggcaagcatcttgctcccttcttacaaagaaacagaagtggtgaagtaacttgcctaaggtctcatgcaggtgagtaccagaactgggattagaattcagtcttgtgtcactccagggtgctgttttttttctttttttgatgtgcttcttgtttagcccatttagctagtgaatgtgaagattcaaggagaaaaggcttttccttctgacattgaagtacctaaactctttagaaaatctactcaggtgcatttcataaattgattacagatgaagtccaatagtaacattgtttatatttgtgaaatctaccatacttgtcagtttctagtttacagattatataaggaaatcacttacatccaaaatacaatctttgccagtacaccagcacaacctcttgggaatcttgaactacacatatactgaattgatactgcaaatcaagtcatttgcccaaatggaaggatttagggataaattcagccaacagttacatgctcagattcaagaatctgaaataaccactatattgtatagctaaaaataaagcagtttgcacaacacttggcattttcagttgacctagtcaatactagctaataatttttataattcttgagtgaagtgagttttttctttattttacatgtacaactggaatcctgaaaagttaatagattatcttttacctaagtgctacagtaggtaaggtagtattgatagtcttttactgaatctacaaatatttttttcttgaacatgacataatttcttttaacagttttattgagacataaccaacaaacaataaactgcacatacatatagtgtacaatttgatgttttaacatatgtatattcttattaaaactaccaccacaatcaagctaataaacccactactcctaaaagttttcttgggtccttttgaaattcctctttcctaggtaaccattgatctttttttctgtaactacacattaacttgcattttctaggattttatataaagtgaaacatacagcatgtaatctttaaaaaaatctcttttctttcagtcagaatacttactttgagactcatcaatgctgttgaatatatcaataattcactcctttttattgtggagtaatattctattgtatgattatatcacaatttctttatccattcacttaattatgggcatttgggctgtttccagttttttgctgttacaaaaaaaaaaacgcagctatgaatatttctgtacaagcctgtatatgaacatatttattttcctcttaggtaaaaacctatgagtggaatggctggaacatatggcaggcgcatgtgtaacatttttgaaattgtcaaactgttttctaaagtgattgtgccattttacattcacaccaacagtgtatgagagttccagttgcttcacttccttaacatcgctgggtgtggtcagttttctaaattttagccatcctaatagatttgacttcatgctttattgtggttttcatttgcatttccccaaagactaattatgttgaacatctttacatgtgcttatttccaattgtctacctttggtgaggtgtctatttgaatgttttatttttttaattgtttttatgttttcttcttaatgagttttaaaatttgttctttgtgagatatgtagtttataaatattttctcctagtttttgcttgtcttcttattctcttgtcaaaattaaaagcttctgctcttcaaaagtctattgagtttcaaattatcaatttttttcttttatgggttgttcatttggtgttatatctaagaaatctttacctatcctgggatcagagagattctctaacagaagttttataattttaggttttacatttaggtctatatttcattttgaattagtttttatatacaatttaaagtatggatcaatgtttatatttttgcatgtggatatacaatttttccagcacaatttatagaaaagcttattattacttccctgacttacctttgtacttctagcaaaaatcaattgtttgtatatgtgtggacctatttatggaccctctattttgctccactgatctatttgtctatccttatgccagtgccacactgtattgataactgtagttctataataagacttgaaatcaaggcatgtaagccctccagtgttgttcttttttcaaagtttcttcagtattcgaggtcttttgcatttccatatgaattttagaattaaattctcaatttttatggaaaaatttacttttgactattgaaaaattgaattttgattgagattgtgtcaaatctttatagatcagtttggagaaaatagacatcttagcaaaattgagtcttctgaggttgctcataacctaccttattggacacaacaagaaagaatggcactgccaatgctgtgcagcccccactctgcccttagtatgtcacatgtggcatctgatgttcaggctgagcaaaatgtcagtgtcaagtcatataataaattagtcacaaatgagcttaattccttgccttctaaaaataaaaataaagagaagattaagttatagtattttcttcctataccccagtgtataattttttcccgactaagtagaccactagtaaaatgcctttctacctctaagatgctagaatagaaaaaaaatattgttccctgctcatcccaatgatcaaaattaccttgtattttgtgatgactgctttggatttccaaggcagtagccaccatgtctcacctcatgccctgcatgacttaagggaaagaagagatcatagacaacatctggctgtctagtaagtagagcttgacagtgtcagaaacaagatgcgatgcagctattactttgttagctatagtgctctgattgttatttgttgatgaaagctgtgggaagaaatggcaatgcatataaacaggagaaatttagttataatttatgcttctttagaaaatgccagcagcaaacatcatttccaaagcattcaaaccacctatgactaatcacaggatgaccaatgttccccttgtgacgtggtaatcaagtgcgttgaagacattccacctaattttgagcattttaagcagtatgatgccatgattcagattttcctattgcaggtgtccacaatatttccaaatttatgatattttggagcctatgcatttttccctatgggcattgatgacccacactgagtagaatgagcaatgtgggtgttggattgctgggcaattcttatgctccctggagggatccctttctcaattgccacggcagctattccaaacctttacattcattaacatccaataaatattgatggaagccttctccataacagaaactgtactcccaccttctacctatgttttcttcatttttagcagataaatcaaatttttaacttttcaactacactttctctttctacttccaaatgtgcccattgtctcacatctttttacttctatcctttctatctctcaagaagacgcatccttctcaaatacatcctcaccccctattctcattctggctgatctcctgtgtctctaggaactttgttcagatattctgcttcctcttattttccatcttttcaactggacccatctttccagattgcaaatctgatagtatctccccgccagcctccccactcccacacactaaaccctgcagtggtcactagtactcttaggatatattgagaaaaaattattccatttggcctccaaagccctacatagtctggcttctgcctgcctccccattcttacttttttttttttagacagagtctcactttgttgcccgggccagagagagtgcagtggcactatctcggctcattgtgacctccacctccgtggttcaagagattctcgtgcctcagcctcctgagtagctgggattacaggcgtgcaccaccacgcccagctaatttttgtatttttagtagagacagggttttgccatgttggccagctggtctcaaactcctgctctcaagtgatctgcctgcttcagcctcccaaagtgctgggagtacaggcatgagccgccatgcgcagcctccattcttattttcactcattcctcctctctctgctctacacatactggattttcaatccctgaaacacatcttggggtttctcctatcacagggccttgcacaagctcttccctctttacttaagttccactcatctttgctgtcttacttaagcataatttctgtaggaaaaccttccctgacaagttgttattctgccagttttttccctgtagactcccatggcttgatttatgtcttattcttagaatttgccataattgacatattctatttagtgagaatgattatttgattaacatctgtctccctcacgaaggtataagcttcaggagggcagaggcttgtcttgttgtgcccaccacttaataacagaggctgggccaggtgcagtggctcacacctgtaatcccagcactttgggagggtgaggcaggaggattgcttgaggtcaggagttaaaagaccagcctggccaacatgatgaaatcccatctctactaaaaatacaaaaattagctgggcgtggtggtgcctgcctgtaatcccagctactcaggaggctgaggcacattttcttccttcacttttttctcttactactcttctctcttccttctttgttttgtttactatcttttttctctctttttatcactttatctaataaatacttattgggcaaatgaatgaaatgctagtcttcctgagggttttctggtttttgacttttttttctctttttcgtctgcctccttttccttagtaatcttatccaacaccatggcttcaccaccatccatatccataatgccccatgatgtccagacctgtattttcaactgattatcttcctggaattgtcctctagttacttaaactcaacctaactcaaaccaaagtggttatcttccttaaatatttttcttctgcttaatcctaccctttgtaaagtttgccactacccatttcaaacggcttaaacccaaaacctaaggtcatttttcttccttttccacaaataccaaattctgttgatgcaaatgaaatgtccctttccaaaatccccacttatatgcccctaagtactattgcctagttttgttcttctctaacttttccagaaggagaactcttttatgtaagaggaatatgtaaaaattatgacatgaggtggacggaagggagctgctctagctgaaggtgggagaagggatctgaaagcaatcccttgcccactgaggcagtaccagaagttggtatagtttgaaagctactagcctacgttactgcaacaccctttaaaaaaactgcttttacattttttttcacatgtaaaacacagaaataatagagatttatgaaatatctactatgggctaggcattgtagcaggtgctgtgaatataatggtgattgaaatcaatatagcccctgctctcaaggaggttatatctaacagggatggcagagagaaaaaaagcaattataaccaagtgaagtaagtgctatgatgtgggtggcaaggagctgcgggctatgtaggagaagacctaatgtagtgcagggacaggttgggggtggaccacgggtagcttcctacaggaagagactgttaggctaggacctaaaagatgagttggagttcagcaggtgaagagaagagaagactgtttcaggcagaggaaacagcactgttggttgttccaagggagctagctcagcactgtagggagaggagcgggagtgtagagtgagtattcacgtcagggctcatctttagcttaaaaagaaccagggaactctggagagtctagttcagagtataatgctttctccatccctttcttgccccgtcctgcctggtttcttctttcggctttggtactcattgggattagttcctcactgccaagcttgaagccaataatttgatctgaagcagacgactttcagcaaaccaccggaagcctccctgctccccatctccatgcgacaacctcaaataattcagagctgtgtaaaccttgaaaccacctaagccccacccagagacctcataactcttaaaaaattcttcctcaaacagaggaatttcgtaggcttgtttgatctttttatgttgctgttttcaggatataacttttctcttttcctctcaagcccgggctctaggcagttatccaagagaagagaggtctggagacttcagcctgtctcagggcacacatcaaggcagagatgaaaatataggtgaatagtctgggatatctttatgaacacttctcagatgacttggctgaaatctttctcttacatcagaactcaatggttttaacaacacagtttgataaaaaacattttctttagcagtcatgttacagtaattaacatgtaaccttgggaactctatacgtgatttaattcctctctgaaccaatttttcctagttttgtagacatatcttgggtttctttccaggtacaagaagagttttaagaatgatggccatatggattttctgtttagcagaattctctatattttgagtatctttacccaaaggttagtattagacagacagtgaaatgaaaattaaaatggaaataatagtacaataggcctgcatgttcttatctgaaacttttgtggccagatatatttaataattcaaaatatctgagatattagaaagataatatggtgcctatattacataatattataggtggggtctggagtgtgatcacgcataacatgtctgatacggaatatctgaatatccacactgcatagcatagcctcacgttagttcaccaaatgaactttggtgccacacttaacaaaaataccttagtttccgaagcattttggattttggaattgctgagaagtaattgtatacctgtccttgtcttgcttcactgagagagttgctgtatcaagggtgtttaatcagaaaaatgttatttcatcataaaatgttattttatagcctagcctaacagcattggagaatctttgtcccccttttttttttcggcacatgtctgtttgcaaaatcttttttggttataattaaagtaattcctctattggaagttcaatatactattctatgatctgagtcattattttactttcagtccaccagctgctgtttgccaagctgattggctttccaatatatatttcatttactataggttgcaggggtatctctttccagatgatctattggacatagtcctttatgcctctattacttgttttgagaaacttttcctaagttagttgtttagttgactgtgttggtccggtgggcatctcagatttatttgtctagaaactatgctacctggaggcatagaaagagtaaagtacttggaatacccagaactcctggatttgcatttcatttctgcttctttctagctatggtggtgatggcttacaatccattgaacttgtctgagctttaatttctcaacttcaaaatggggattaataataacagcttttgctacttctcaggcataatgtgaagtaaaatgagaagaggttggtgcaaacaagaagatacagtgcaattcacattcaacgaaagggaacggtctaaatgcaaggtctatatgcacttaaggtgtttttattgataaatattgggttacatggctttacttctgctcagatctggatagggaccatttattgagtggctgctgtatcaggaaccacaggaggcaacctcgattaatcccagtaaaacccctttgaggtggctgccatcattctctatttgagagaggatagagacctgaccaaggtcacatcaccacttagcgcctgagccagattgaaaaccagatttgtttgatggtaaagtcagcactccattttaattgcaaagactattgtgcaatggtgaatgttttgtggtgtttttttgtgtgttttgaaaattgagaacaagatgggattcataacaaattagatagttcacttttcttatatgtaaattccagacagtagcaataaatcacacactttggatgctcaggggaaattagttataatttaatgctttggaaaatcattatttatccccctttgtggtagaatttattctcaacatccttataaataaacaaaatgttttactagctaaaaaaattaccaatccattctttcttcacaaggcatggagacagtagaacaacggcatttttctttactatcctcttggcctaattgttcgcttgtcctgaatcagttactgaactgagaaacccaggtaagcttcccatagcattctcctttcttatttctagtatttggttcagtccgcgatactcttttagccatcggtgactgctcttactgagactgtggctgtcctcgcccagagttgaggtaggggtaggttggggatgggagactcactactaagcactgtggagtctatttgagtccctggcagtatctgtccgatatggtctggctctgtatccccatccaaatctcatctcaaattttaatacccgtgtgtcaagggagggacctgtaatccccacgtgtcaagggagggaggtgattgggtcatggggacagttaaccccatggtgttctcgtgatagtgagtgagttctcacgagatctgatggttttgtaaggcagttttccctgctcttgtttactctctctcagcagcatcatgtaagatgtgcctgctcccccttccgccatgattgtaagtttcccgaggcctcctcagccatgtggaactgtgagtcaattaaatctcttttccttatgaattacccagtcttgggtatgtctttatagcagtgtgaaaataaatgaatacactgtctatctgtctgtctctctctctgttatttaagatcagaacaggacttactgtatgacagaaacacagctgaaggggtgttagaaagtccggagcttatgaagacgttccctgacctctccttttgttaactggggcttcattccagagaataagagcttctttatgggttcagacacttctggctgcaattagccgattgttaatttatgtctgagtgttggaggctttagttagataaaatatttaaaggatttagtctcagtgaaaagaactttaagtaagaatggctttgaggaaaagagaaaagttagattccagctttccttctgggtgctgactatggtgagtggggaagtaggttatgagataataagagctttattgtcaatttttgcattcttttagaggcccccacgactttagatttccttaatatctttctccctttatagttaatttaaaaaaatattgagcactttatatgtgtccacgcattctattgccctggagcaaactctagtgatcagcacgtccataatccttgctcttatggaactcacagtctagtggggaactacacaaaaacactgcaaagttgtaaccaatgtttatggtttatggtgttatgagcgttgaggttgttagggaagactgtttttgtgtgatgcattcatcagtgttggggttgctatagcccatttttttgtggctatcagctttaggtacttttattaggtcttaaaaagaatattctagtaattaatcatatagattgtagatgggttgctggattgcattgatttttaaacagatatatatacacacacacatacatggaagcacacatacatataagtatatatatctgtgtatatgttacatgtgtatatatatatgtatatacatatatatgggtgtgtgattacataagcaatgtaaagtgattgtagagaatttggaatatcataaaactacaaaaaaattaaacttacccggaaataattaatgtctatctacatacctatctctagtctttttttctagacatacatagatttaaaaatataatttggatcatattgcaaagatgagtttgcattttcattgaatcacgaccatttctcttgtcataaaataatctttaaaggaaatttttttacttcattatactctatatttctatcagaatttatgtaattattcctttattgaacactagtaatgtgtcccatttgctactataaataatgctgtgaagtgcaagtttctatagtttatgacaattttcttttttcttcttttttttcttttgaaacattttatttttttcgactctttttttattttattttattattattatactttaagttttagggtacacgtgcacaatgtgcaggttagttacatatgtatacatgtgccatgctggtgtgctgcacccattaactcgtcatttagcattaggtatatctcctaaagctatccctccccgctcccccgaccccacaacagtccccagagtgtgatattccccttcctgtgtccatgtgttctcattgttcaattcccacctatgagtgagaatatgcggtgtttggttttttgttcttgtgatagtttactgagaatgatgatttccaatttcattcatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatgcccagtaatgggatggctgggtcaaatggtatttctagttctagatccctgaggaatcgccacactgacttccacaaaggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatggtgagcattttttcatgtgtcttttggctgcataaatgtcttcttttgagaagtgtctgttcacgtcctttgcccactttttgatggggtttttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcgattgtttatgacaattttcttaggctagattttgagaagaaaaataacagggtcaaagggagtgaaattttaaggcttgtgatatgtattgcaaaattgctttccaaataggtaatataaatctagctcccattagcaaagtacgagagtgattattttattggttaccctgtcattgctgaatatgattattgttaattagatggttgaaaaatattatcttctttttatttctattctggtctactagtggaattaaattcttttttttttttctttgagacagtctctctctgtcaccaggctggagtgcagtggcgcaatctcggcttactgcaacctccgctgcccagattcaagcgattctcctacctcagcctcctgagtagctaattaaattcttttttatacagttattagtaattagtacttttttaatgaatctcagtttatgttctttgctcgtttctttattatggtttttagtacttgtttcataaaaactttttatttattaaggatgccaataatttgtcatatgcaaagttttccgagttatttaacagaagtttctaatttgtatgtaattagatctacttgtcttttctttttgatttctagcttttatatgctcagaaagtccctatcctattaatcagatattttgtctatgtgtttgaaagctagatgaatttttaatatggtgcccataagatacttcagcaacctggtgcagtgcctaataaatacggcacttggggacatgatgtgtggttactagaagtttgcctaatagttagatctcaatagtcattggtcactgggatgaatattcattaaaccatgttttgaaagaggaataaatattacccagtcaaacaaaagggagaagaatcttccagataagggacccatgacatgaaagggtacagagggaagaaaccaaaaccatgatgtgcaaggaatgcctgcagcaggagctcagcatacatggtagggaaggtgttagttaggcatggccagatcatgcaattttcaggccatgatgagaaacttaattttacataataaaaaatgagaaatcattacaggggtttaagtaagaaagtgatgtgggccatattgacattgggaaatttaggtacattacttcagtttactaaaaatagtggagaagagaattggagtagatgagatttgagtcctggcaatccattagggaaaaaagcaagttacacttagcagcatttaacaagtgtgggctgggcatgatggcttacatctgtaatcccagcactttgggaggccaaggcaggaagattgcttgacaccaggagtttgagaccagcctgggcaccatagtgagaccccttctctacaaaaaatacaaaaaattagttgggtgcctatagttccagctacttggtaggttgaggcaagaggatcacttgaacctaagaggtcgagactgctgtgagctatggtcatgccactttattccagcctgggtgagaaagtgagaccctgtctcaaaaaaaaaaaaaaatgtggaaggtagtatcatttgagctagagaggaatacattcaggagatatttagatggtagaatttttccacttccccttgatcctcaaaggagggccaggctcatgcctgtaatcccagccctttgggaggccgaggtgggtggatcacctgaggtcaggagattgagaccagcctagccaacatggtgaaaccccatctctaccaaaaatacaaaaattagctgggtgtagtggggggcacctgtaatcccagctactcaggaggctgaggcagcagaatctcttgaacccgggaggtggaggttgcaatgagccaaaatcatgccattgcacaccagcctgggcgacagagtaagactctgtctcaacaaaacaaaacaaaacaaaacaaaacaaaacaaaacaaaacaaaacaaaaaacaaaggacacagcatagcatagagaaaaaaagatctggattggaaatctgaagcctggctccaccaccagcaccatgatctttactagttacctcccctctgagggcctctacttccttatttgtataaggactttctgaactagatgatctttcaagtgtctggcagttttaacacttctgtgttcttgtagttttagacaccagcttagtgtttcgaaactgtaaaatagcctgagaaatcttgtgaaaataggaacttgcacttttctaggatttttgtttcctgtttttataaaatttgagctagtgaggactagatatcaggatgagcccctgcctgcctcttggccagctttgtagaggggtttctgatgcccagaggagaggcagtttgagtaagggcagccgacagcaagcatggagctcgcacacagctctctcgccttccaggcgtggctcagtggcaccatccttgtggcctcctgtcttgtgaccatgagcagacacgctcgaatatgatggccatgtagccaactaactacagctgttggaagctcaaacccgtggttcaaatccattggcaattttggtaaaatctagggtttggctcattcagtctaacaatgctcacccgactgtgtggccagtaatttaccaaaaacagtatagcttgttgccattttcatctttagtggaggcagaaaaatggaaggatatagaaagagaaatgtctcgcctttcagaagctccttgctctttggtatttagtttgctattttctgtcatttttgtcttgagtcattagagttgggtttctattctgctgtctgccttgcaatgttatctaaggaatctataagcagcttaaccctgtcaacggaagattgtactaaaacagcctgttcaggaagccctggaattccacgcttcaagccattagctgtgtcttgcttacatgaagcttatcacgccaccctcagaaaatttccatcttatcatgggcggcattgtaaataatggaaaaaactgtctgaaactgtttgaatgttttcttagattatttggaaatttccagctttgtgcactagacagaagacctttgacctctgggatgacagcataaaggcgaggtatgccttctcttacttagccagggagggcccataatgactgtgcagacactttctattatttttgtcatgaagtctctgaatttagtcaccgagcctatgggaaacaaattcgctttaggaaaaaaagcttagcaagaagaattcattcctcaagtgtaacacctttttttttttgagatggagtttcgctcttattgtccaggctggagggctggagtgcaaatggaatgacctttgctcactgcatccttgcctcccaggttcaagcaattctccttcctcagcctgtggagtagctgggattacaggcacccaccaccacgcccagctaattttttggtatttttagcagagatggggttttaccatgttggctaggctggtctcaaactcctgacctcaagtgatccgcctgccttggcctcccaaagtgctgggattacaggtgtgagccaccgcgcccagcaagtgtaacacttttaaaggtcttttatttatctgcctataatcttaagagtgagtttttaattaaattttgtcactgaaaatttattattcctttaggaagcaattttgtggggggtgcttaggttaatatgtaattatatacttaaaattcttctaggttcatttaaagataaagtaatatatcagttattacaagatgccaaaggctaaaacatgcaattttctcagtccagctcactttttgtttccaaagccctttgcgtgcattaacaatctttacacattatgaagtcactgtcgccatttagcccacctttgcatcatgggctaaaatggatgcaaagggttggttaactcaaagccatgtactttattccacctaaattttgttcattctgttattcaacctgaaatatcctttcccctcaatttctgcccgtgaaaattgtatttgtctcttaagattcagatcaaatattacctttccttacctcctagggtagatttctaaagaaaaggatctgtgaacatttaggaaagcaagcagtggtcaccaggaatttgtgtggattgctgataaagaagtcattctgcactaacttcatctcttctttggcattatggctcatctgataaataaatgcaatagacatatctttggatttcagtaagtctttgatagagtctctcttgataggcttttggtctatcaatagtacaattagggggattagtaactggttaaatggctaaagccacaaatgactgaataatggcttttggcctgtgaaatatttcccgtgaaatgctggcatgcatttgtccttggccttgtcttagagaaaaaaattattaatgatgaatcagtcagaatagatgtagataatgttgtagtattgaagaccccccaccccatccccactgccaatttagtggtttaaaacaataaatattgatttctctcacactacttgttcatcttgagatgatgggggctggatgggtggggtctttgctttgggttattattgcagtcattatttggaacatcgttggctgccaaggccatgtgaaaagagatggtgaggaagcccatatggatgcacaaccatacacacctcaagtgaatgggtgtgcaaggcggcagtgtgcctgcaaggagagaaatgccatgtttgtgaaaagccctaatgaccaccacacccattgggatggaaacaaggtgttggtggatgacacaaaattaggtgtatagtgaataggattttccctcagaggacctgataggaggttctgaactttttcagtaattatttagatgactctgggcagatcacttaactttcttcagtcttggtttccttacctatagaataagaccatcagtgatattaatgtgtctgggtgatggtgaggtgctgtctggctggtactggtgtctctgagcttggagtcaggtttctctattggtgctttattcttagatgtataaaagttgttaattgtaaaatttttattatgactggtaccattatcaatttttaaaaattggctttttaaagttgaatgtaatttgttttgaattgtatattacatttgtctgatatatttttgccaaacttaaaaaacaatgtgtcaaatctcttatagatagctcattgttttttattcagtctgaaagcctttttcttttttagtacagccatttgattcatttatatttattcccagcactttaaattaatttttctttcaggcatcttaacttacactttcgtgtctatatttcccttttattctgatttgtgctgtatatactacttgctttgcatttgcctctctgtaaacatcctgattttcaatctacaaatatataccttaaataaagaaaaccctaactcataaagctcatcttttttgaaatataaaaatcaagaataaaaataagcatttatgactccaaattttgaacgctgagctatgtgggactttaaaagtttaatgtgtgattataaatgccacatttaattttttaaagtggtcaatatgtatctctttataaaatatttttctttttttctgttaagatttgcagtgattattcagacctattaagctggtgcaaaagtaattgcgtttttttgctattacttttaatggcaaaaaccatgattacttttgcaccaacttaatatatctgtaatttaacaggttttaatgcttcctgataatcctttttagttacaacttctctcttcttgagttcttttttgttttattttgttcttgttttttgggacaaggtctcactctgtcatccaggccggagcacagtggcgtgatcacagcttgctgcagccttgacatccttggttcaagtgatcctcccacctcaccctccccaggaaccatgcctggccaagtttttatgttttttgtaaagactgggtttcatcgttttccccaggctggtctcgaacttctgggcccaagtgatccaccagcctcggcctcccaaagtgctgagattacagtcataagccaatgcacttggcctcttcttgggttcttaattgcatttcatttctgtgtactagggactgtgtactgcaggaactttattcagaaagatattaggagattttctgagcctctgcatctgaggatgcctttctgctgtctttctacaagaagatcaatgactctatatgaattcttgggtcatactttttttcacttaaattccggaaatgctgctccattgctttagtgtctagtgccttgtatgaagttggcatgctttgccaagcttatttaaaattagagttgccgaggataagtctaaagttgacttttgatcctttgtaggaaaagcagccacctcccattctctaggcctaaccagtctctggggcccctggcatttgtcctgccccaggtgctgctgtgacgaccagctttgtgtggcctccagtggacttcatatggacatagccgaccatgccttgccttgtcagtcccacatccctcaccttcggacctgggcttccctgttgatacagaggcactggatatcttgagacttgctcaccatgacgtatgtgcacccagaaatgcatggaagtttacatcaccaggggcacatttttggccaacacgaggtggggaggtagtgggtaaaatgttttcccttccttctcaggacagaattgccatggctcaaaaggccccgtgaaattttgagaaatctgttatgcttgatactaaggataccttggatatttgctcttccttgctctcttcctttctcccaacttctgtttccctggggttgttttacacccaccaaaacaatagcacctaaacctttgcctcaggctttgtctttacagaaacccaggctaaaacaacaggtaacaaaaacaggtggtttttgcttgaatacttctagaattttttctttgtttttggaatttagaaaatttactaaaacaaactagatataaacttcaaaactgctgcctggatcattgtgagaactctctacatccagacttggattaaaaaaaaaaaatcaggatagttttttctagtattttatctattcgtactgttttattgtttatttttagaaatgcttattttggttaaatccttactcaaatatatatagacatttgaatagttctgcttttaccatggcttctccttttgttcacagattatgtgcttttgtattttattagcaacatgaagaatgtgttacaattgttttcttctttgtgcttgcaatgtgtgtgctttagaaggcaatgagtccctcagagtcctctggcctttcttctcatctctgtgcttgggaatgtttccacatgcccaggtttattctcctttacttatccatgtgaagagaggtctgtgaagtcccaatttttaagaacagataagacacaggaattgctcagtggggcacagtctgactttggtaaggtacaaagggtgctgtctggggctcaaaaaaggactgaaaaggacgcatggagggtgctgagttggcaacctggaagagggggtggtgctggaagaagtggctgcagctgtgggacctcatttcatggaagctgctcttgagcccctgcggcccagatacctgggagaaacagggtcctgggagaaaaggcttactcttatgccttcgatcaacaaacaacagtttcctggaccacgagcaaactggaccagctgggagcaggtagagacagatgtatgggtagagggaagtcaatatacctgtagtttcctgcagaaacagaacagtcttagggcagtgcaggatggaaagacacactccagagcctgaggcaccaaagcggaacaagcataggggctggctgcctgccgtagatccggggggattatttaatgttgtattggaatcgagagtgctgtaatttctaagactttatgttattgcatggacagtttttctcattttatgatatttcctttgttcatgtaggtgattttggtggggtggtttttagaatgttctcttgtttgttagctagaagcccaagggcatttctttgtccccaaggacaatgctccaatccaaaggatttgcatttaggaatttcaggcaccagttggcaaacaggggaatctgtgagctctcctgcccgaattcaggatggacctaagacattttagaatccagccttaggtgagaccactaggtgagtttctgagaaatgatcccggcagccgaccaactcagtctctgcagccttgtaacacatttgctagattcaagcactctagtgaaacacaaatgcacattatgtagcaaacagaattgggataggttacgcagagctaaggcattaaacatcccccttccctccccgactccgcaacgattctaatagccaggcacaagcagcgtcaggatctacgagtagcagctgcagcgtttaaagaaacatcagcttctgcacgtgcgttcgtggcgggcctgtcagtgtgcttttcagccacacctgcttgcccagatggtggcctctgtgagcggcctcagctccttgaggaaggacagtcccggattgtttcacagagatttactgatgggaaaataaccacccatcacctcagggaacattctcacacattttctttatcatgcattaaaaaagttaccagtttttctttttttcccccgtaagacaccagaacttcaagtcttttgcaataagcctggaacacaaacccattcattggttccaaagtggatttgcacagtctccacgaaaactgccaggggctaggtggggccctggtgacccaggccaggccactgaaccagagctggctctgggatttgaaatgacgtccactccttgtgctctttgggctaaatctaaaagggtagctcagctgcctgtgttttttgactctgggaaactcttttccctcatggctttcccagcacagccttacctctgttcctacacagtctccttcatgcgttcttttctgggccctgaaatgttcctgtcttcagagccacgtccttggccctcaccctttccccctcagcacttttctggggtcatccagattcctgacttccatacccatgctactgcctccctttgggacatctcctgggtctcctacagccatctcaaacttctgttgtcctctgttttctgcctcagttactaatttccatgtctcccaaaagttgacctcatgccccagtctcctcctgggattatgggtctttctttgttctagccttttctcctctctccttggtttttcactgtttgcaaaacttttctgccttttcatctggaaaaatccttgcttaaaaacagtcctgctcataggctaaaacctttgtggaacttcacccaacccctgcttcccatgctggaattaattgctgcttttgttggtaaaataagcatgacctagaacctgccggatgccaaggcactagggaccctcagagtctggtgtgggggatggaccgtggttagttagcatttgaagcagtacaataaagatatggcctaagagctgtgggaatacaaaggagggagtcactaatgctccattttagaaatccccatgtaggggaaaattaaatcagagagatgggagcagcatgtgtccctaggtgacatctatggtccactccaagcagccgtgtttcaaatgcagatctgcacctggcaaggctttctttttgtttacctcacctagccaccaatcctcccttacttccaaacacatctatcatctattatttccatcgtgaggtgccacagagcaaagacagtatcatttctcctttttcctcttttgagatctcagcatgaactcatggctataatatccttaactccttcaacatgacattatgatgttagcaaaaactatgcctgaaaaataaaaacaatcttaagtggcacccactcataatgaacttctgggttctgcaccctttacagaccttctgatcagagattgtccctctgccctggggtccttgcatttctttcctgtgggctttgttgtttaccacatgctgttctgatcatgctatctttcatttaaatagaaagatagcatgatgatgaaatgaaaatgatcctagggttgctgtgagtgtaggatacaccagtacctgatgctcacagtttgacaggtcagatcaaactgttattccagagctgaggggagagaccaggcctcctctgggaactgggacagtgaggagaaacaagcatctggtcacagccccatcccatggactctgtcagggtttaggagctaacttgcagggtgaacctgtggacagtgaattttagagatagaagggagtttggcaatagtctagtctaacactattattttacagatggtgacatggaagctcagagaggtaaagaggtgtgtttatggttcatggaggatttgtggcagccagtgtggaagccagtgtgcctgaggccctctctgtttagtggtgtccattccacactacactgtcatccctggagctctgcttgttgttgcttggagctatgagctttggtcatgagtacagccctatggggtagatatatcctaacttatgggtgaggacacagaggtataaagaaaaagaagttgcctaagatcacagggaatccttctaaaactggacagtctcacctacaagatgggaatagaaataccaattgatggaattataagaaattatgggtataaaatttgtcaggatatcatgagctattaattcatatgtttttttcttcacatttcctttcagcttgtgacattcttttatttagatagctagattagagggaatcagagagaattaagccagggacaaaagaagtcacattcttccttcttagttttaaaagtctttttttatggctgcatattccatatggaatgtgcatataacagtattccatggtgtatatgtgccacattttcttaatccagtgtatcattggtggacatttgggttggttccaagtctttgctattgtgaatagtgctgcagtaaacatacgtgtgcatgtgtctttatagtagcatgatttgtaatcctttgggtatatgcccagtaatgggatcgctgggtcaaatgatgtgttctcattcataggtgagaattgaacaatgagaacacttggacacagggtgggaaacatcacacatgggggcctgtcatggggtgggggacagggggaaggatagcattaggagaaatacctaatataaatgacaagttaatgggtgcagcaaaccaacgtggcatatgtatacctatgtaacaaacctgcatgttgtgcacatgtaccctaaaattttaagtataataataataataataaagtcttggtccttgctgtggatattagcctgttttcatctctcaagagttctgaggcccttcctattttggggattcctccatcacatgagtcttggtggaaggcagggtcctatctcctacttgaaaatatatggggctggatgttccattttttcatagaacagatttccagaacagagaagtgacaaagccctctgggtaaggaagatggggtagagaattgaagaggatggtggcgggatctcagagaaggctgtgtgtcttgcccctccctctcatccagtggagttggctgtaaaagggaatgatgtcagaacatactgagaagtctgagttcaaggctagaggggatgtgtgcagtattctcctctggagccctgggagaaggctgcctcccatagcatcctcatggagccaaaagtgcttacaaacactatctcagtgatatttctttctttttttttttttttttttgagatagattctcactccttcccccagggtggagtgctgcggtataatctcagctcactgcaacctccacctcccgagttcaagcaattctcctgcctcagcctcctgagtagctgggattacaggcgtttgccaccacgcccagctaatttttgtgtttttagtagagacggggtttcaccatgttggtcaggctggtctcaaactcttgacctcgtgatctgcctgccttggcctcccaaagtgctgggattacaggcatgagccactgcgcctggccaacatttcattttcaaatgttaaattaacatatatgttctctactgaccatgagaattcttaagataactgtgtggcaggtttaatgtaatggacaaagagtgccagcctgctgttggacttcaactcttttgggcatgctgaggccaaaaagtcagacataaagacttaagtcagtcatccaaagactggcagcttgatatcatgcaggcaagttatccagatgactgaattttgtctttttctgcttgtgttttgggatatagctgtttatgtatgtttgtatgttctgttgtgtttctgtcaggcatgagtcactaaattttacatgagctaaatccttcttggagatgtgttcaggctcagagctcaactttgtggcaaattctggcttcttggtgctagcattccaggtgctgattctgtttctcatctcttcctaatgccacaccccttcctgttcttatgcctcctgccatgtggttagagagtgacgggctgaagaggttagtcccacagacgcctgggcaccagccctgcctcagcagcacctgctattttttatttcttgtttttcccaacctcagccgctggcaagtaccattctactttctgtctctgtgagtctgactactctaagtacctcatctaagtggaatcatgcagtttttgtctttttgtgactggcttatgttacttagcataatgtcctcaaggtttatccatgttgtagcacatgttagcatttccatccactttaaggccaaatgacattcctttgtatgtatacaccacagtttgtttgttcattcatccattagtgaacatttggattaaggactacaacttacacgtgagtgcaatatttggggaggcagtgtgtgtgtgagggaaaaacaccatgaactttatggtcaacaggcttgggttccagtcatggctctgctgcttattagcaaaaccttgaaaaagttacttagcctctctttaaaaaaatttttaaaaatttaaagtatatcttgaatgcaaaagagaatgtaaatgtccatgtccagtttggagagcaataatataataatacaaaaatagagcaagcagccatatactgaccacccagactaagaaagtgaacattactcggacctttgaaagtcttcagcacccctcctggttgactcttttcacttctgtcctgaactagtatcctaaatttcatgcaaattagtcttgtgtttttctctgcagttttaccatacctgtagatctctaaacaatgtattgtttgattttggggtgctttttggactttatattaatgaaatttcactgttatttttcctttaagctttaattttttgagactcacccttgttgaaatggatagctatagttgattcatttttattattataaaccctccctccctccctccctcactcccccctccctccctccctccctctctccctccctccctccctcccttccttccttccttccttcgtagaaggtaggctcctgcctcctacttgaaaatatatgagacttccttccttctttccttgttaatttttatactactgtaaactatgctgtcatgaactttcccacacatatttcctggtacatgcatgagagtatctctagggtatctccataggagtggaattacttgggcttagggtaattgcatgttcaactttattaggtattgctcagttgtttcctaaagtggttaacccaagttgttctcccaccaggagtgcatgaaaatctcccttgtgccacatctttgccaacatctgccatgactttaaaaatcttctgtcaatctagtggatgtgaaatggctttaccttccctttaaaaatatttagtctcagctcttcttattgtgcacttctgtggcgatgagtgcaatgtatgtagtgtaccaacgagaattattttagagcaagattctccttccatgaacgaagctggtggagcatcacagatagtaactctgtagagattcctattattgatgagaatcaatactaatataaacattgactaattcctaagctgacttcttgccttcccccaggagtaaaagggatttttttactggtccccagctccaaatcctggtgttaggcatcgagaagtatcaatcaggcttctactggagacatcacgaaggatgcagaaaatacaggtcatcacctaatcataaaagggaggagatgatctgccgagttccagacaaaggatagatactttcctgtatgtaaatccctgcaatattctcttcaaggtaggggtaacagctgatataggggtaacattcttaaggacggagaaccagacccagagttgagtcagtcatgtaaaaatatattttagttctgactgttccaaatactgtccttgaacacaaaatgaatatacaaggttcctgccctcaagagttttatacccagtctggtagaaaaaaacagatgtgaatacatctataattgcattttcatatgttaagggagatgcatgatagaggtatattatagatacagggaaggcttcttagagaaggagacacttgaactgagccttgaaggatccataagagcttatcaggcagcaagagggacatttcaagtagagaagacaacatgagcaaagtaacaggactgtgaaggagcattttatttctcaggagttccaggagttcagtagctggtgaaaggagaaagaggatttttggagtcacaggcaggagatagatcttgcaggacttgtatgagtccaatgcaaggagtttgagctttatgggagcctttgataaagcaggaggataacatggttagattttggttctagaaaaatcactctgatgcctatgtaaattggagggacaagactaggggcagggaggataggatgtagtaatgatagttcaagcaagagatgaggaagtcctgaattaggtgaggcaatgaagacacatttcagttcttctcaggtttttgtgactagcagacatggtgagtgagagagtggtccgtgttcaggatgcctcctgggtttttgtttctgttgtagactggacaatggcaccattcaccgggacagtgaatacatgaagatgagtaggcttgggatgagacattgacaatgacctcagggatggacatgttgaatttgtggggtctgtaggacattcaaatagaaatgtccagtagtttctagggtgaccagctcattctgatttgtctgggactttcttagttttaaaactgaaagtcttgcagcccaagaaatccttcagtcccaagaaaactggaatggtctagaactcagtagagtttagactagagagactgatttggaatttatggaagccataggcatggatgaacattcatagggtgtgtggagagagagaagagaagaaggccaaaggttgttcctgagcaaaccaacctttgatgggtaggagagaaagaggaattcatgaaggggcctcagatgggaagcctggagagacagggaagagatatgagaagataaggttgtgaaagccaaggttggggggaacaattgtaaaggagggaatggtcaactatgtctgagactgcagaaaattgatgggtggactggctttttgaagtggtcaggactttttgtaacagactgattttgtaataagaagtcaggggaggggtgacccacagcgaggaaggggatacacacttttaagaagttatagtgtggaatgacagaaagaagagctaagctagtatgggaaataaagatgagggagagtttcgaaaaaattaaagaaatgtgatctggtttataatgagggaaagaagttagtgtagaaagacagattgaaggcataagggggataactgttagaataattgggagggatggggtgaactagagcagacccctcttttgagaccaaagatatcagtggggaggggtgtggggaggggtgtagcaagggcatgtagccacttagctacagagttgggatttgaatcaatgtctgccagatttcaaaagtcatatgatttccacctcttcttagaaaaatacatatagcctcagtaaaagatgtgcacacatgcataatcacttagtgctacacacagacagatacgtgctgctggtgaaattgcggaagtgatcagaacaattggagccaggtgtagttcatctggggcgcttaacaggaaagatgaactttgaacagaattctcagggaatagaagaacgtggtgagacaagagttagattaaattttttgtaaaaaaattaagtcattctccaaatcattcttcctttcagaaacttgctttgaggatataaaaaatttgcttcttgttcttattggtgtgtagattctcaatagatgaaatcacagtagagtatattatcccatgtagtgggttgctagtccctacctcttccatatccatttttttccttttctttcatagcagcagaatttttaagtgatatcatggcccctcaactacctattacattacccacccttcccttgttcttgaccaaggcctggccaattggatgtgctcagaagtgacaatgccactcctggttgtgcctttaaagggagagatacgtcttccttgccctcttttctctactctgctgcttggaatgcagagtagtaatggtgatcagtcttgaaccatgtgatgagagcaatgtcctagggatggtagagcaacaatataactggagcttaggtctctaaaactgagggaccctaacactgagaggctaccttaaaataagccattgctaatttggatttatgttacagtagttgaatcatatatgtaataagactaacataaacaatgacatttctttgtagtattcatatgcatttccaggataatactgatgtctgaattctttgcctgtttcagtcccatattaaagacttccagagagtgtatccctgtgagcttaaattcctttgcctgaaacctaactcagagtcacatctaggtacaattatatcaactgggaaggatgaggcagggttaaccttggtcaagatcatccctgatcacctttcttggtcatgcattcttggtcatcgcatgaaacatgtattttcttaatctatttcattttttaggaagctgttgaggagttggtttgtcagttagcattgcatttagctgtgaataacaaaacttgactagatggtggcctaaacaagttagggttttaagttttttctcgtgtggaacaagaaggctgactgtggtaggcagttcagagctttataatgcactcagtgtccccctaggatacctctgtttttctacctagcaaacttagcatgtagtttttgttttcatgtttgtcatctcatggttcttctttaggcatcacatctgtgttctaggaatgaaaaggggaaaatgtaaagaaaaaagtgcaagcctactgagttgattctctcattttcataaaaattttatagtgacatatacatacagaaaagttcacaaatcacaagtatgtagcttgattaatttttacaaagtgaacataccaatgtaactggcacccaggagacacactagaacatttccagcacttcagaatccttattcccttgaaatacctcttatataccccaaagaatggcatagattaattttgcctgattttgaactttatggagtcatatagcagatactcttttgtgtctgacttcttttgtttaacataatgttcgtgagaatcacccatattatttcatagaattgtagaacatttattctcactgctatattctaatgtataaatataaattttaaaaaatccattccggtattgttgggcattcaggtagcttgcgggttttagtaattataaattatgctacaatgactattctagtacacatcttttggtgaacatatgttcacatttctgtggatatatacctatatgaagaatccctggattgtagattgtgtttatatttagctatgctcctgcaaaacaatttctcagagtattttttatcaatttatcattccactagtagtgtacaaaatttcagttgttccatatccttggcaacacttggtattatccatcccttcaattttggccattccaatgagtatgtgatagtatcatataatgtttttaatttttatttccctaataactaatgaatcacctaaagttgaggtacttttcatttcatatgtttattggttatttggatatcctctttcgtgaagtgctttctgtaattttttttgtacagttctcattgtattgactgtctttttgatattgttttataaagctctctctatcttctgaatatgagtcttgcattagcttgctaggggtgccttaacaaaacaccacagactagatggcttaaccaacagaaatttattttctcacagttccggagtctagaagtccaagatcaaggtgtcagaagggctggtttctcctgaggcctctctccttggcttgcagactagaaaatatagtatttttagatggacctattgtcactttgcacaaagctgagattttttgaaaagaggagaatggacaggcaactagcaaggtctggctcagtccctaatttttctaaaactagtagggatgaaggaagaagaaaggaagtggtaccttcttttcttatcaaatgagcagtgttccagggcttgtgctgttacagctggaaccacattggcgcagctcaggggaatcaatggttcttgttattccctggtctgctgagattgggctaagcaggaataaaggtcacagcagctcttctagtaagcctatgggatggccatgatggttcccatggaaagtgtataggccagagaagattctccccaccaccaatctcatttatggtttgatggagctgagagtcccagaaaagcattccatgacatttcagcccaatgcatcccctggtaagagaaaattttcatatcagttttggaacaaaagattgtaaaaatatttcaggaaataagccctagttcacattgtcacatataactacataaagggcattgaattatcttacttatatttttaataagatgatttttagtattgctcatcaactcttccccttcccctcaaacaggcttgagactgttcactagtatatagggtaatctgtgccttgaaagaaagaagatgtgatatctgttttctactacactgatttgaatctgttttctccaaactgcgacccaatctagcagaatgtaaggagcctatattggcatactaagaccactgccctcccatttttattgaaaaaggccaagaatgaaaaagcaagctgtcttagtctgagagacagacatcagggtgggattaaatgtgcaaggattttgttaggggaaatacctgtctgggagaaaatgggtagggagcagaaagagctgttagactatggaacaagtctatctcacaaatggagagagggaaggaaggttaggtggaagtgtcctagaccattgtgcagcctaaggaagcttcagcaaggttgttatggagtctgtgaaccaaagttggctgtcagaggagtcccttgtgtcccaggaacaggcttgcccaccacatccagtcattggctaggagcagcctgtggctgggagcagccagtatggacgtggtacaaatgtgatggtggatctcagagtgcagcagctgaagaccttggtcaattaccttccctgtagctggatatttgcaaggcacattctaatggcagcttagtttgcttttgctagaaattaaagaggccgggcacggtgcctcacgcctgtaatcccagcactttgggaggctgaggtaggcagattacctgaggtcaggagtttgagaccagcctggccaacatggtgaaaccccatctctactaaaaatacaaaaattagccgggcatggtggcacacacctgtaatcccagctactcgggaggctgaggcaggaaaatcgtttgagcttgggagacagaggttgcagtgagctgagatcatgccactgtaccccagcctggccgacagggcaagactctgtctcaaaaaaaaagaaaaaaaaaaagaaattaaagagagcattgggatgcctctcacttttgtgaaatgtaagaatcccacttggttgacaccagttgacatgaatgactttaggaagggagtgaaatatggtgagtcagaagagaagggttaaagaagggatattggatgaacccaaagtccataatattaaaactgaatgcactatgaattattttcattttaaattctattgtcttttcttgagtaggtgctatgaatagttttcttaaaagtttaaacaaaaacttttcaaataggttgattttcaggtctgaaaacatctgaatcaaacatttggtgtgtagtgacatagcaaaacaaattcaggtcaggatccctgacctatgacttgttgacagattcacagatcagtgtgctcatgttttgaaaacaagcaacctaggcatgtaaggcaagatatcagatatctgagaatcaactttttgttgctagttttatttttatattgcacaccatcaagtcctagaaagggcaaacacaagaaggcaccaaagctaagttctgaatttggcccagggacaaacatccatgtaacggccatagcagcagggcctgcaaacctgatttattcctctgtcatctctctaaatcacaatttatgctgataaggtgacctaacttgtttaaaagtgaaatggagaaggttgatgaaaatttactgcatcccaggtttgtgggttggacgcctccattagcagcaggaccacaggaaaaaggagtgggaggaatacagccagaaacaggttctcactctgaacaagattaagagatggaagagctcatgagatcatctcactgaactccccactttactgcctgaaaggcttgggagaggaggggcatgtctgaataatctattttctgatttttctctttcttcattagaagtgatttagctgatgactttcctgccatttctcttggggagatagtccttaacacacacatgaaagtcatcagtattaggaagtttcttcagatgattattatttttttcagaggattttatggcattagtcttcctccaaccaccgtgaaatcctttttcttcccagtttcctctcccatgatacctatgagttattattcgtcatgttagttttccaaccactcagctagggctcttctttcttttctgattcatgggcaggtcaatcctttgaaaggatttgccacacacatgattcatcaatggcttttggttttctgttattcatttagttcttgaggggtcctagagcctgtgaccaaatgacacacttgatggcttcctgaaggagctttctcaaaagcaatagaatttccttgcatatttgaatctgctcttgcagcagtttgaagctgtgagcccagctctgtgaagcagaaggttagacattaccacagactccaaggcttggaaacactgcaggacattttgtaaacagaagtgcagccttaggaacacatcttcagcatacgggggaagttccagcacatttcacaagagggaaaagtaatgcaaggaaaggataatttcagtcttctgtgttgattacccttctccttgccctctgtacaagggggttagcaagggcagctggtcgcaagactgcagctgttcttaattgttgattttagctttgcagtggtcccttgtgggaaaagatgccacatctgtaccatggaatgtacttacaggtgtttgagagatgttttctttcctacaagttacatgacactctgtaacagacaagctattaagacataccaggctgatgtccagagacatgggcttaaatggctcccttccttttctccattcttctcatacatagacctgtgaaaaagatctgctttctgcttaagccagggaagggtgcatttctgacattctctctttctgttccctgcaaatggcctggatacatcaacagcaaaagagaacatcaggttcaactactttacaaacctgctcaaagtaggctcaggttaaaatgggtccctagttgaaagcaatgttaaaaaaatacaaaaacgagcgtatgagaaatattagctttttcttttaaaaaatacaaaggctacttgagtaaaaataaaatctgttttttgtttgtttgttttgttttgttttctatgagtgaaatgctacaacttgggttctagattagggcagggcatgcattcatgtttgttttgttggtgtaacaatgggtttcgttaagtggttgtgggtgtctcatacgcaataggacacattgaatgcattgatatgaatggattaatactagtacagtactcgctcctcctacctccccactccctttaggtttgaggcagctaaagctgcttcttccctggactccacatctattctggctcacctgtgattatcccccatgcctaccctgacaacccactctcgactatgcttaggatcagcacctagactctcctggccctgtgcctactgtggtggacacatacctgtgtctcatgagggtgggatgggaaagaagacagaccttgcatatactggctgaagtgttcacatgcatgtaatcagtgttcctcgacctcggtaagaaaccacagggctgcccagtcctggtccctgcgtgtgttcttgcctgcatcttacaaatattaggaacaggcccacactagcatgctatctcttttggtgtgttactttcaaaaaaggaaacaacatgaattttcattaaaaatacaggtaaatttctcactcattctaaatcctgaaggcaggtgcacagaaaattagtctcaatggaaacagaaagtgaaattgaccacttttatttctcccttttaagtaaattacctccctcagcagagaatgtatttattccagaattaatctgagcatttgaaagttattgacgttttagaaaagtatatccaaaggattgatagtggcaagctgaacagtattttaaaaacccacaaaatgtgccaaggtctgaaggccattcaagttcagggttgtgataataagcataaccgtaactctgaattctgtgagttcaatcaaatgcttggactatacaatcaagtaaaaagcttgacagatttttttatagtgcacagcttagtaagagctcagtaaatatttactatatttaaaaaaatccacccagtgtctggatgggtttggtcacagtagttcatcatgtagcccaagatagggtagcccaagtcagcctaaatctcgtggtgcttcagtggcactgaaagccaaccatagcttccaaacctgacgtagatactttaatgtgataaagtggagctaattttcccatttcatgtgtaagtagatgcaagagtgcactcacctcaatgtggtttgattcctatcccgcaaaagcacacttcagtctcagtattcatgatggtttcagttcacttattggtcattgtccctttgctctttggttctctggtctcagtgtaagaatgcacactgatttctgttagattctatctgggcagaggggcggggatggattatctttctgtgattgtgtatgagtttgggagtggatgaatagaggaggagttatgtagtgagaagatgggtacactctgatgagggtctccagtggcggcccaaagtgattcatgaagtagtagaagctgatttttgctctctccagccttctgctttctagccttaaagcatcgtgggtttttcccctctcaggactcgattccctacggtgaaaaccctaatttatatttttttctgctctgttcctatgtggaattaactctcagtgtttttcaaattgtgaatcttgacccattagtagttgttaaattaatgggtcaagccagtagtaaaaaatgaagtcatatgaaatatattaggaagtgtcagagcacatcttaggcagtagggaaagtattgcttctgcaaaaacttttatttcaattgtacgtgtatgagagagtactgaacagtactgtaaaggttgtgatgagaacaatttgaaaagcactgacctcaagcaagttgttagaggtggatttgtaggtacacaacaggcatcaggaggaaggtttaggggcaggagacctcttctgtgtacctcccactacctcatgtcggcagccatcttcccatttggcctatattaaggtcatacctattgttgttggtcctttatccttgctttgtggaggaccatcatgaaatcaaaatattcttcagtgaatactttgcagcttggaaggtgcttttatttacattatcccacttgactacggattctacacaccagatgctaggttcatcccagaagagaggccgggtccagccccctgcccctaagaccacctctagtatgatcttatctagcttgtttttatgatgcaatgttaatgcagccactgcccataaggggacacatgaatctgaaggtattttccatgcatgattaacttttaaagttatgttgtattccttggcctaagcaaggtgtgactgaccttatggcatctgtagtagccaagggttgacattagagaggatgaaataagcaagtggtaatggctctcaggaattatggtaacaaggagaagaggatggttcttcactgctaagcagcttgactaggtgagagacagccagcatcttactgcttcctggcacatggagtgttccactgagaatcacaggcagactcaggcaaccagccacttttcaaatgggctgtcttctgtagtgctgttccaccaccattctgtgggcccaactgttgccattctgggggatctgccattgctagcttaattccattcacttcaattcaattgctgttatgaaaggcctactagtgctattcccctgagaatctatagagacagggtagaactcttggatgaaaaggtgagggcttaggacatctggttagtggaacttacttatttttgggcctctttcatcaagtaacaccagctgatgcctaggagtgtgggagtcatatcggctttgttgtcgtctgttagaaactcttcgtgttcacaaaaaaaaaaaaaaagcagccttggagaaatcttcaacccagaaggagttaagctgtgtgtctgcacagcgcagctttgttctggcaaggtcccatcagtttaggtcatttctgatgacttcactctcctggtgacatcagcctctaatctcctgaaggtgaattcatgtgcgattgcttcaaaatactcactccctgagttccgagccattcccgttgatatatggacagagcttgtctttcccaggccacagtctggtttgtgcactgcatttgtgcttaccgtatcatattaccatgtggacattatgtcactaactggcacaaccggctcaaaatgaaatatgcttgctgcaagcaaaaacccaaaagctaacatcaactctccccaccccctaccccaggtacaaaataaaagggctagagggatggctggactagattttggtttaatatgtttctaactgttctctccctcctctgcctttctgtggcctgaatgttgatagtaactttatcatccttttcagtcctttatacccactaactcttgaaaatgtttggtcactgatggcacaaattaaatgtaagactttggaataatttagtttagcctcttcctaaaatatcaagtctgtgaactcaagtaacctttttaccttctaagaccactttcttttctttgtctttcaaatgtcataaaagaatacagagtagaaatgaaagcagcctgggcttattgggtaggtgccaggaattagctttgacaaagatggtgttctgtgcacttggcccaagctgacaggcatgcagatgcctctagaaattgtgggagatgaactggaagtatccccagagtttgtccagtcttagggtggtgtaagtacattttaggcccttctcctgttatccacaggctgtgttgacaccctcttgtgtcaccagggattcagaatgccacagtgcctccctgaccactatcatcctcctgctgcccccactctggggcagaagagggtagtctgtctacagagaagcagagtccccacaccacttccaggatcccaagcacccatttattttgattaatagctcttggcagtagacagtagcttctggaatacagaactggccgggtacacactgaggtttaaaatcacatcaagaaaatagcatactaacacaggattgttaaggggagaaactggtgttcaaacaataaaatactactctcactgtttatctttgtttcattttgaaggaaataaagaaatgaaaccttacaagtgtagcagcccagttatcaaatagtcatagccacagacactcagttttggggtcagcccacagactatgggggtactttctctgcctctgcacaaaataaatgttgaggctctcaattttttgaggacggaaataaaatccctggatgcttgcaaatatattttttaatgcagggatagctaggttttctgagtttcagttctgtttcagctggggtgcgggtgggggatggcctgcatcacaggggaaactggtggaatcttagtccaggaggctggcgccattaccattcacatcagctcatgatatacaaaggtaccagacttttttttaaaggcccagtataaagtaatccaactttctttctcctgctgtatatccaaggaggtggaagtattaaagaacccttttataccttctcaatgccattctctttcttggttcatgcaggaaaaaaaaagaaaaaaaaaacacagaagacagactagagaaaaaaaaaacccaaaaatctaattaaaatacaaaattaataaaacattctcatgtgctcaaatcctacatcttctcttctaacagcatggctgttatatatgcacctgcttactctctttccccagtaaagaaacagcatctccttactccagaggaattggaatttcccacttcccgacttcttgctccctgcaagctacttgaggaccacaaaggctgagccttcttgtttgactgggaagactggaagagctctacctttctagcagagaaatgcctcctgtggacagtgggccatagccacacatgggatagaagacgtgaggggtgtctgacttttggaaagagctgagcactggatgagacttatatttttcccatgtgccttactggggttgtacctggagagggagtgcttcttttcatttctggaggtagagtgcgatttgcttttgcagttggagaggcaaggaaaagctgccagtgtctgtagcaagctaggtaatttgcgtataacatcactcctttgatgacggcatcaatcgctttgcttgactgattctgcgaactagtgggttctttgatgagtgtgccttgccctcagtttgctgagcactcttcctcggggtgggatctctaagccataaacaaggagtatttcccctccagtttaagatcacaggttgacttcatcgtatccactgtctcaccagctttctccattcgccagcccagcccaagggcagcacagccttgaaggcaccaaatagggaaagcatgccactccgtacctccttcctgacatcttctgcttagattaggctcatgccagggtcagagccagctgcgccatcacacccgatgcagccttgggacgtgctggaggtgtaggggagaggaaggctgcccccaaatgctgatctgcatgtgtgcatccaccaaagcatgtgatgggaacactcttatcagcagatctttcatcccagccctgccaccactgccgtgtgaccctgagctaggagcctactccacacaaggtgtttctcgtttgtcctgagactctagctctgaagggaaagagttcctgttggggccatcgacccccatagccactgggataaacactgatgtagttgttgctcaactaatgagtgaaggaaccaatacggccaaaaaattttttgaaacgtgtgccctccctagaaggtcagctggggcccctgttttgcatgcacaggcctgccctgccctgccaccctaccaagtttctttgagtttgtaatttggtctgagactagagatgtcatctgatatgatattcccacccagggaaagtcaccttgggaggaactcttgttatccctggtgctcagcaaaagcctgctggctccttgagtgctgggacactcatgtctcaacaaggcaccgtcactcttgtgtccccgtgcctagagcagggcctggcaggcaggcactcaggaacaacttgatgaattgagttgttgaagtcagctaaatctttctgtacaggtgcaaaacttgctgttcaaaataaatcctaaacatgaaaacagaaagctatagacaaaatcctaagttccagtgatctcagggaggcaaaacctgtcattctttgaaagaacctatttggatatgtatatgttaatatatgtgtatgtataagtacacctacatctcttccatctgacatgttttaatagtgtgcttatggagtgggtttccgaaaagagctaagtctaaaggagagaacctacagttttctcccaaatgggggcatctcactatagcatcatggagtttgctgtttaacctctctgttaagcaattcaaggagttaccttctatggaggtggcttctcagattatttttttcctataatatcctcctccagctgcttcttgacaaagaagcacttgtttattcactccacacaattttttttgcaagtcttttcatttttgttaataagtttcattttctatttagctttctgactctgtgcttgtgccttcaacactttcacaacgattttctcttcgtcgataaggaaagcatgcttgatcctgtcatgaacacatttagcatacatggaaccaccataggccctgctgacatatttctttgttttggacaatctcataggaattttaggtcttacagcatgaacccctcaaagtctgcctgggcacataccacatgtagattttggtgctttcccaaccttcttggtataaaggtaaatgattctattaccaggggttccagacagcttagttttgttagaggttgtattgtaggaaagcctatgttggtgtgtcaaacgcaggaccattctgagtgcctgcagacaatgtccccggaagaggaagaagaaaaccttgcgaaccttgcgaggtcctccacataatttttaatattaagattgcttgcttatttgtttattctctctctctagtccccctccctggaccctcaccaccctgcccagcactaggcactaggagcactccatgagggcagtgattatgccttattccccattgaaacctcagcaccttgtccaatgcctggaacacagaaagatgcttaatgttggtgtgcttaatgaatgaattgctaggaacaaatgacttgtgaaaacacaggggtgcctctcctggcttggtttattaccctggatgctgacaaccatcagcacatgtgaaaaaacaatttaaaatcaattctctggtgaatcaagttttggcagtgggtgattggtgtttggccaatagcctctcctcgaaggcattattcacacataaggcatagaagcctggccgagaggtcttcttctttttttttttttaacttagtattgtaaaaaaaattttattgtggtaaaatacacataagatttacaatcttaaccctttttaagtgtacagttcagtggcattaagtatattcacagtgttgtacaaccatcagtctccagaactcatcttcccaaacagaaactctgtacccatgaaacactaactcccctcctccctcccccaaacccctagcaatggccattcgactttctgtctctatgaatttgactgctctaagtacctcttataagtggaatcacatgctatttgtctttttgtgactgtattatttcacttagcttaatgtccttaagattcctctatgttgcagcatgaatcagaactcccttccttcttaaggccagatactattccattatcggcataccatactttgcttatttattcatacatccatggacacttgggttcttccactttttggtcattgtgaataatgctgctatgaaaatgtgtgtacaaatatctgctttcaattcttttgagtatatacctagaagtggaattactggatcatatagtagttctatctttaattctttgaggaacctacatacttttttccatagcgactatacagtttcacattgctaccaatagtgcaaagagttctgatttcttcacgtcctcatccacactttattttctgggtattttttttttttttggaaatagccctcataatgggtgtgagatagtatctcattatgattttgatttgtattttcctaatgattagtgatgttgaatatccttgccatttgtatatctttagataaacgtctatataagtcctttgcccatttttaaattggtttcattgtgttttaggaatttatatattaggttggtgcaaaagtaattgtggtttttaccattacttttattggcaaaaactgcaattacttttgtaccaatttaatactttgagtatttattccttatcagattctgtgttgcaactatacatcaacttagaaaaaatgacatcttaaaaatattgaatcctccaattcatgagcaagtatgtttgttcatttattaagaccatcttaaattttttagcaatgttttattatttttggtgtatagcttctttatatttttgtcagatttattcctagaattctgtattctttgatgtcattgtaaattgtattgattttgaatttcatgtttggatttttcattgcttatatacaaaatacaattaattttgtatactagtattgcaatgctgtaatcttgctatattagttagcacacttactagttctagtagcttctttgtacattccggcagattttccacacagatgatcttgtcattttcttgcttttacttctctatttccaatctttatgcctttagtttggacttcattacatattgtgctggtgggaatcttcagtataatgctgaacaaaagtggtgagaacagatatccttgttttgttcctgatcttaggggaaaggaattcagtctctcacgattaagtgggatgttggctgtagattttttgtacatgtccttcgtttatttgaggaacttttcttctgtttctagtttgctaagggtttttatcagaatgaaggttgcatgttgtcaaatgctttttatacatgtattgaaatgatatatagtttttcttttttagtttgttaatatggtgaattacagtgattgattttggaatgttaaatcggctttgcattcctgggacaaacctcacttggtcatgatgtattatcccttttatatattgttgaatctgattttctaaaattgcattgagaatttttacatctgttttatgaagaatattaggttgtagttttcttttcttgaaatatttttgtttagttttgttatcagtgcaatgctggccttgcagaatgaattgggaaatctcctctcttctttaattttctggaagagtctacgtacaaatggcattatttcttccttaaatgtttagttgaatttacttgccattaatcccttccagtgcagtttttgtctctaggagtctgatttaggtctttaaaaataactcctccatttctgttaaactttttgaatatatggaatacaattttaatatctttttaaattcctttgcctgttaattttaacatctgtgtcagttttgggttgtttttgactaatttttctcctcaatgttttctcatttctttgcatgcccaataacttttgtttgaatggcagacattgtgatggttatttttttttattcctatacatgtttgggctttgttctgagatgcagttaagttacttagaaactgatccatttatggcttacctttcatatttggaaagcaagactagaacatcgtttagcttagggctaataaccttctactactgaggcaacatctttctgaatattctactcaattatatgtaaaattataaggttcttcaatctagttactggcaacagtcactttttctgacctcatgtgagctccagttgctgttctttgtaattcttttagatggttcttcccctggtctctgctagcttcctcagctgtgtgcactgattagtactctgttgaatattcagggggaccatctacagatgtctgattctctttccctgcaactctttgtcccctctctgtcctgccaactttagccatgttggtctttccaaacccttgcttcatttcttcattgtagggaatcgttgagctgcactggagtttctcattcctatgatatggcctggaaactttcatgtcagtaagttagggctttggtagggttcttctcattcgttttctatcttatgtcttctgttgggttctgtcatgatgattattcactattgtgttcactttcttgtttcattgaacatatttttaatattttatccagtttttctagtttgcttttgtagatggtttggtagtaattacctagtctgcaattattggaataagaggcctcagaccttttaatttcaacaaagtttttttccagagaagtgagcagctatttcaggtctgctggagtcctaaggtagagtccaattgggattgagagctgaccatctggccagtctgcaagttcttgcagaagaacctactgctgaggactgaggagtgtgggagtgagagggtgcttgttctgaggggagaaggagccggaaatgacagccttgctagagaactgaatcatggttatcagagaggaggagaaagagtgagaatgctgccacatactcatagttctttcctgttcagatcccattcgatttgtgaagtgtgacattgagagtctgttaaaattgaaatgcacttttataaaaattctgtaaaatatggagccataggctctctatcaacaggtgggagtgagaggcagtgaaatctgagttatgactgttaaggtgactgtttaagtatacccaggctgtgaggcctgggggaaatcaggttacacagaagccaagttaacccggatccagctccaccttgcagagtttcgttaacagaaggggtccttggtacaaacccgctgccggtcagaaactggcctgaggccagaaactcattttaccttaacctcagaatgtccatcagatgatgaggttcttgcctaggacggatatttttctaagttggtactcagagattgacttaagagtccttaaaatttcacaatgagtcacacataaggccaggtttgctgaaaccgaaagtgttgaaactgcctgggggcaatttgtcggtaacctgtaggcatttgagaagctatgaaaaggattaatataatgcataaaatgaaagacaagcagtgggggtggggagtgagaaaactatttccagtgaacatagccctagttcagaagacgaaatctatatttcactcagcagagggtacaaatctgtattacattaactcagcaattctaaccaaaacaaagacaggatggcaaatatttaaacagtgattaaacagtgcccaggcaataggaaatgtctgctcttgccaactgtttgcttgaatgaaataaaataaataaggggcatacaaactgtgtcttcctggttgttctcagggaccttctctggcataggggcagctccctcaatcatgaacttgagtctcatgggtcccattagaaatagcctaatgagaaagaactctgaaaactgttaatggctaacagggtacagaatatgtatttttcttttaacgtattttacgtatataaatggcagggtacaatcagagcagatttccccaccaggaggttgaatgcttaattcaaaacaaacgcctattgaatttgatagtagatctctcccctctctccctaatttggctttttgccagctgttaatctaattgcaggggtggcagcctgagattctgtggccctctagggcaactcaaagtacatattgtcattactaattattatatagtgttgctgtgattaaaagcaccactgtcctttgaaaagcctcaaatgagatgacagcacagaagcacctgagtgtgccccataaactgatattctatttgctgtgccattaaagttcaacaatgccattatgtcttaagtgacaatgaaaagttcccattccagcttttagtcagaatgaccacaagtttgatgaaaccccactcaacctcttctccagtcatcttgaaagtgaagctgtttggtgtgttggtgtgaggtaactaaccatggtgctactatgcgcttttgtaggcagagctggcctggtgacttaattcacattgggacacttactgtcacattcatcgcactggattaaatactgcaactgaacagccaaaagaagaggtatcgctataggttgagtgatatcttcccctcaaaagatgtgtagaagtcctaatccccatttcctcagaatgtgacgttatttggcaataaggtcgttgtagatacaattagtttagatgaagtcgtactggagtagggtgggtcccaaaccaagataactggtgcctttataggaaggggaaatttgtacacagggagaacgtcttgaacataaagacagaggtggggagatgtaactccaatccaagggatgccaaagattgccagccaaccaccagaagccaggagagagacctgggacaggttctccctcacagcagagtgggctcatgtcttagcctgtttgagctgctataacaaaataccataaactagatggcttataaacaacagatatttatttttcatagttctggaggctgggaagtctgagatcaagataccagcagattcagtgtctagtgagggcccatttcctggtccactgatggtgccttctgactgtgtcctcacataggggaaggggcaaactagctctacggggtctcttttataaaggttctaatcccattcatgagggctcctccctcatggcttctcaaaagtcaccacctcctaataccatcaacttggaggttaggatttcaacatatgagttttgaggggacacaaacattcagaccagagtagcccctaacccaatatgactggtgtctttataagaaggtggctttgtgaagacagagacacatgaggagaatgccacgtgacaactaaggcagagactggcattaatgcagttacaagccaaagaatgccagaaattgccagtgaatcaccagtagctaggagagcagcaaggaaggacactcacccgcaggtttaggggggaacatgtccctgctgacacctcaattttacacctctagcctccagaattgtgagagaatatgattctgttttaagctgctcaatgtatggtgctttgttatggtagccctaggaaaggaatacagtcaggaacactcttgtccataggcaacatgggatgtagcaatgtatggccaaatctttctcctcccaccatacagaacacattcattcaaagagtataaattggcccaagcttaatagacattctcttttttactagtgggtcaacacaagtataggccaggttagttctatagataaaacagaatttgaaatgtgtaatgttaaagccaaaggtccaatggctatttattccacattctatataactaccctaactcaagcagccgctctaaaaccccagtgactaggaccctgaaaaagtgttctttaaagtgtcagaacagagattcagactctcagaatttgctgtttcagtttgagaagatgaagagtttgaagatgagaagactcaaatttgagtccagcacccagctgccagtctagcagcccattgtagcccccagagaatgaaaatggaatgcttggtccaatccccatggtgggtgtcctccaggaagctctggggttcccaactggcctccagccataccagggccatatagattccttaaaataaatatctatttgtgtgttgccttttggtggctctgatcatctatagcatcaagtctaagcatgatgcttgaataagcctccatgatttatgccccctctgggctctgggctcctgttgcatcacactgtccctttagctttatatctagttacacaaaattacttgttgtttccacaataaagccttatgtgtcttgtctttgtgaccttaactatcacttaaattgacaatgccctttccttcttttcctactgaaacaaccctagttaatcttcaaaatattcataagggacactttcctatgaaagccttctttgacaacatcctccagatagacttaataccttttttctttgtataattttttacctgctcctttactgtgcatctcaaactatatttaataatttgtttataatcatcttttaattaaactgtgagatccttgagggcaggaattgtattttatttatataggatgcccagtagtaagcatagtgcctatacctgtacaggtgattagtaactgtttaaatgaattcttcatttaacaaatatttcttgagactttttatgttgcaggcattgttctgggccttgtagatgtggcagtagtcaagaaaaacaaagacctttcctacctgaagcttgtgttccggtagagaaaatggataaacagataaaaataatagacattgcatatactttcaagtaatgatatgtgctacgaagaagaaaaaaggcagtgtaggaggttgtgggtcgatgggatttctcttagattcacaaatcaagaggtgatcaaatgaaacttaaccaaaaaagacaatgacttctctctaaccaaacttgattactgatagtctttttccaagtcagcttaatgtgctgttcaagagaatcagtgtggaaggaaggaaatgtgcaagagagtcctgtatcagacacagtgggcagggagctttacatctctcatcttattgggctttgacaacacccttcaagataggtgctgttgcagatgaatgacaacctgaacttcagggaggccaaataatgtgtccatgtggagtgtctgagtgtgtaagccaaggttcaaaccccggccatcctgggccacttgtcaacaccagttctacagttgaattctatgaatacttatcaggtgctgacttcatgtcaagccctgttcttcatgcttagcatacaccagcaaatagaatagacagaaatccctgccatttcagaaagtaacaagtgttgacaaggatgtggagaaattgaaacgcttgtgcactgttggtgggaatgtaaaatggcacaggtactatgggaaacagtatggtagatcctcagaaaattaaaaatataattaccatatgatccaatgattccatttctggaaatatacccaaaggaatggaaagcaggatcttgaagagatatttgtagactcatgttcatagcagcattaaccaaaaggtagaagcaatgcaagtacccgtcaacaggtgaatagataaataagatgtagcctatatgcatttaccacacatggaatattattaagtcttcagaaggaaggaaattatgacatatgctataacatggctgaaccttgatgacattatgttaagtgaaataacccagttacaaaaagacaaatatatggttctgcttatatgaggtacctagaccagtcaaattcatagagaaagtagaagagtggttgccaggggctggcaaaaaggggaagtggggagttagtgtttaccgggtacagagcttcagtttgagaagatgaagagttctggagacgtatagtggtgatggttgcacaacagtgtgaatgtactcaatgccactgaattgtacacttaaaaatggttaaaatagtaaatttcatattatgtgtatttcaccacaatttaaaaaatctctgcccttgtggagctcatgttttagttcagggacatgaacagtgaacagattaaatatgtaaatcataagctattagaaggagatgagtgatatagaaacagaacagattgaagaagattgggagggctgcgagcaaggagagtgtgttttcagttttaaacggggtggttagtttcatggtcttcttcagctagagttaaaataagtcgtcaataaagcttgtcagccatgaaactggggtatcttccttggcatccatgctttgcccagaacactctgacttgttggaatcttgagtggaaatttaaagtctctcagaaataactttcaagtttcagtgtaggaagtccagagcacacagaggggaggagggactgtcactgggcagcatccagagggacttcattttcagtgtgtgagggagacagccaggcggggcgtgcacattcagggaataataaacagtaagagggagagggcagaagacaggtggagtgtgttggaggtgggtacactaaggcaaggcaggaggctctaaaatttgtaggctggatgatgggaagtaagtgcagtgtttaaatttttattgtaaattagttatttactccatccattgattcctctagccagtgttggagggaccagcttggcacgtgcttctgggctccttcctggggattgggtgcaagaatggctgccctcagagaatgaatcacaatctggtaggaaagtaaaaacatatgcacattgggaatatttaaatagcaaggctgtgtagtttataccaagatgagtgatccagacaatagatgctgtagacaaggaagacagtcaaaatatctgtcaaaatttctaacagccagtactgcacaggcatcagactggattgcgatggatgccaatcccatcagaacacactgtgggagtggacaatctgtaccccatgaatattagccctggtatggcagcattgaagagcaaaggtctctagggactggggccactgcgcaacagttcagggaggagatagaactcagactgagcctggagaggtggggagggagagagaagcgggaataattaaattagtttcatgatgtaagtaggattcttagaagattattctgacagatatgtgtggcatggagtagagtgggaggaatgaaggaagaaaattggtgaggaggctgttctaggaattgaggtgtgagatgagaagaatggaggactccctattggagagaaaggcttgacccgtgagccagggagagctgagcggcgaagagtaacttggaattattccgccaagagccaaagtatttatttcttaccacgaattgttaaaatgtgactatgaagagtagtaaaagcataataaggtgtgaacttaaacccttgacactctttcctctcccttccctgaaattcctctcttaagatccaacaagggacttgaaaaataatattgtgaaaatggcttgcaagacacagctggattcctcacaggactagctttgttagcagaaattgctctaggatctgcagtatgcagagcacaggggtgggcagatcaacctcagcctctggattgggtttgggagaaagtctctttaaagcccccagcactattcctgggaagccccactttaggagttatgtcccgggaaggttcctgacctgctgtcctagcaaagcccaagcttcccttcttgtcaaagttggacttgggcaccctgctgttcagctctccacctaggcaagctttgtgtagcgttcaggaggctctaagagttgtagggcttcccttctgcagttttaatttgagtgttaataaaaaaactctttaggcaagtgataatattggtacagacctctttgaaaagaagagaggaagatacacgaccgaatgcatttcaacttccacaagagctatttgaagaggataaagatgaagggtaaagggataaagtgggtggtggagtggaaggccagttggagtagtttattctataaagagtgagataattgggtggccatttgcaaacacacacacacagacacacaaacacacacacaattacacccttcactgtgcaccaaatgcatcaaggatttatatattttaatattaactttcataatacaatcttttatactatgaaaataagtaaatataccactttcttttctttctaaacattcactcactgaaggatatctaggttgttttcattttttggctatcaccagtgaagctgctgtgaactttcatgtacagatttttgtgggagcatacgtttatctctctgggataagtgaccaggtatagtacaatcacttctgggtcaaatggtaattgcgtgcttagttttgtaataaattgccaaactgtttttcagagtggctatatcattttacatattacttatatatgtatatataaattttttaaataataaaaattttattatatagttttaaaaaacatgacatcagataattttgttttgctatcattataaagtgaaaaatgaatgtttaatatgttaagaatggaaatcatgctcacagtatattcttttaaagatagtttaaaaataaatttatgaagaaagagagagattgatttagttagtatttagttaatatgaacttctataacaaaataccatagactaggtagcttaatagcagaaacaaaattctcacagttctggaggatatgtgattaagtaaaacatgcaagacaagaatactataaatagcacaatatgattttaaataaatgttcaattcattaaaaaaataaaggtacacacacatgcaaattcttgcttaaggacaaggttatgaaccttggcaagtcacctccatggaaatattaatgtatatcatgcacaaggagtggaggagcatcactgggggtgatttttcttccccaggggacattggcaatgtctggatgcattttttgttgtcatgactggtgaggaggatgttaccagcatctagtgggtgtcagccaggaatgctgctaaacattgacaatgcataggacagcccctacaacaaagaattatctaccctcaaagtcaatagtgctgaagttgagaaatcatggtttagggagtcttgattaaaacttttcaactggggtaccctgagatggtgaaatatactagtatgctttgcttcacagtgtcaactttactcgcatctgcagcaggtgagttataatcttcacaggagccagctcctggggaaagactgatcatagaagaaattctcattggctttgaccaaatccttctccttgccaattaggaaatattgactttctaatcttttagcaaaagctccgtctgtatttgaatatatgtttggttataacaaataacttgtttccacaaatggaaaaaagtatcgtaaatggcaacagatatagtttagtgctgactttagatggtggctggacctcctataggacaggcaaagctaagtactttctactcaaagccatcaaacaaaatgcttacaaattagaatgtaatggccattgctttacttgttttgataaaccagaaaaacaggcttcagcttattgaatctattattgaaccctaattagctgtggtgtttggacattctgaggcccatggtaagataaataatatttatggtttcttccatgtatcaaataattgtgtacgaaatgtagtatagtatggaatgctctcttctctcagagtttagaccacagagtgaccaggcgctcattgtggggttagggttgaaacgctggagcccagcatgggtaatcttcgcgtagacactctcaccgcagatatcagagagcttagcaacatctcaggctcatgcagactcctcgctggtttcctcaccaatgcccttcgtgtcgccatgtgagctttgggtggaattgaggaagggcagcattaaatacactgagtaatctgaaaatgaagggtgggggaattaaaaacgagttcacttgggttcaaggaaaatttttgaggatgtcagcattttccatgttgggggaaaaaagagattttaaaaaacttttctctcagagaacttgctaaaatatcatcagtgcataagtgaaaggagatagtgtggagaaaaaaattttaagccatcaccaaaaaggcgaagtcccaaagatacaaaccaaaattccaaggtaaatacatcaatgaagacaaacagaactggtctcagtttccttatctgtaaaataggcagaaacaatcccttatcctaaactcttgaaaccagatgagtttcagaattcagaacttttagtattacagaaagataataaagtacatattgtcatttattatatagaacactcagaggcattggagggcaatatcccttaatgaaacacattaatttttctgtagtgaaatgtgcaccaaatgagttaagtaaagactataagtagcctcatgttagtttgttaggttttgctgccaagtaattttgctttagacttatgaaaaaatgttcagttttcagagattttagatttctgaattgcaaatgagggatggtgtaccagtgtctgtctcaaagaggtgtcctgagaataaaatgccataatggataaattgtgcacactgctggtgtatactaagcatgtaataacagtggctattgttactaggtttttgtttttataggtaaaagtattcagatattataattataatattattatcagcattggaattattttgggttgatgtatatttcttttccatttcttctttccttttctctccttttttccttaaccccccacccctactcctgtctgcctggctgtctccctcctttcccccttccttctttccttccttccttcctttcttttcttttctttctttcttttcttttctctctctctctctttttcctctcccctcccctcccctcccctccccttcccttcccttcctccatccctcttttctccctctcctacacagggctttgaccttaatatccttgcatataacaaatgatgtgagtggtcatctctcatctggtttggttactggacagactctttaagcttcatctgattgtgtatgaatagcagtcctcttattaaagagataaaaaccaaaactaaaacaaaaatagtaaaacaagcagcacgcatctcacttgtcttagatttctgtgcccttttttctcagcaagacccaagtattctaaccacaatgattctgatgaccaggaattctagagctggcagcctggctgagtcagagggatttgagttggatcagcacagaatccagaccaaagtcacggtgaactggcatgaaaaacaacaacaacagcagcggcagcagcagcaacaatatagacacatgcaaaacacaaagcagccagctaccagccacctccgaattgtatccaaatgaactgctactcatacctccacttcctgggccccatttctctgattcctttccgactgcagacctattagccacagtctcacattgttctagatctctactttctccctttccttgcttttggctctgccttttctttctttcttttcttttcttttcttttctttttttttttaaataaggcttcaactcttcaacttctccccttttaaattatgttatgaaccatccacaggggagaaaagccaacaaactcatgaactacattctgtttacaagttcgtttctaagtctgattatttatttctttaatttagaagttctatatccccaagaggaccttagtaactgaaagctgctcttattttactaatatatttaataactcttcatttttatagtaagaatgaatctaggcttgccatatattttcatggtaaaatattttaattcctctgaagaagacggaggatcttaaccaaatgacttatgcagagaatacaggcatagaaaaatggaacaaatatcattgttaattgttttttctgtgatgacagtttactctgtagcagcaattcttaaacttggtacctggtattagtacagcaggtgttttggaaaaagtaaaaggattctgtgcccacataactttgtgaaactttactttgaacaaaattaagcagatttcattaatgtagaaacagtgttccggacatacagtgtttgaaatattggtactggcctactggcaggtcagttgtgaggtcttgacaccctcagttttctaccaaggaaaactactcagttaacaagctactgctcataggcagccatagttggacttttcccctcatcatggctggtgatgggagtgggcactggattccaggctggccagatcatggactggccacaactgccaatcaaggacaggaccagtcaattagcagacaacacatagaggccactgggaggcagcagggtccctgaggatttccgaggaaatcagtcaggtataggtggaagccttgagagatgaaagagaaaagcagagtgggaggcagggtggctgataggctgtgtcaggagctgtggatgggagacaggaaatccaagttacagaggagaggtggatggactgcctgcaccagaggggcaaagaggtaaccttattcctagatcaactctaggaccttccagttgtcttttgctaggttgggctgtgcaccttcctgattgccccaagacattcctgtttttatttccagtgacttccacttctaaacttactcattacccaatgcattcttgtaatacattctatcataatttgaagtagcttgaggactttgtaccttgtagctaaaaaagtctaatgaatgcttctggtttattcttaaggatttttttataataactttttttctctgcaaaaatagtacatgacaaattgaaaacccaatgaagtacaaagcagacaataaaaatacctatagttaccctcactcagtcactgttaaattttggtatatatctgtgaagggctctttctctgttttcgaattgcaagaatgggtgcacaccacatacactgttttctatttttttaacctaattattgtaaatatctttttctttttatcacaacatatttaattattatgtcatattttgttgtatgtccaaagttcaatgaattctcaatggttgaacattttggctgtttatttattttttgctactgtaatcagttctgtggtaaatcaccttgaaggtaaatatttgcacacatttgtaattatctctcaggataaagtcctagaaggggaattgtcaggtcacagcatatgcacggttttaaggattagaatacttatggaaattactcttcaaaaggtctaggctaatttacatatcaatccagcagcctctcgtagacaagctttgttttctatagcttctttttgggcttttcccctgtcctgtagaaccttctggattttagtgttgattgtcccacccttttgatttcagagcattagccttctctctaagctttttaatgctttgcaatgagattactagttctataattttcagtgctggctctggctgctttgtctcagaataccactgcaattttctgttttttcttttcttttttttttttttttttgccaatggatctattgaactgcctagtgagcagtgcagggggagaaaggtgaacccagtttcatttgcatcccatgtggctttggcagcagtagcatcgaattaaactcaagccccggaagatgtgcttcctttggaaaatgaaagacctacaaagttcaaggagcccattcgtggcaagtaaattaagagcgtaaacccaaagaatgtctgcagtttacagcttggtattacacggttgcttctgattggtataatctgtcattgctgtgatgtgtttagagacaactcagattacactcctgatacactagctagggccaaccacctgtggccctagtcaacgatcaaagatagttaccacaaatgctatttgaggaaataatggcttagagtggaataaaaactgcagtgctgcttttattgtgtaacttttcatcttatgtgcttagcggaacagggcatgagaatcctatttattggcagtaagactctttcttttacccttggtgtcacaagggcatttggggaattttgctgttagttaaaagttccaaggcaccaagcgcaggcaggctgaagagatgaaacttgagccagtcatttttactgcctgtttgcttctctggtaagaacttctgggagaagcatgaggctaccagttaaaatgtgtaggttggacttttgtggattacctatttaagtattcatgttttctctaatagaataagtacatgccattgagaataaactgtatttattcatacatttatgtattcattcatttttcccttattcaaagccatcaactgaatatctattaggcaccatgcactgcatatatttaaaaaatatttgcatgcattttattcaagagtttaagtcccagccaaagcaagaattttagacttttatttattaatgtgcctggttttgttacaacctaataatctgcctcctgggagcctttaagtcttatggtcttatgggggtggtgtaggatgattgggggattgtcctttaattaaataaaaaggcatgaattgtttgacacagcggtcatgtgaaaaaggcaagttgttctctagtgcacaacaaaaagatcggagcccctatttccaagaagtgtattttgtggggatgcaggattggggacctacgctgtgcctctgcggtcacttggtttccatggtcgctctcacctctggaggccgttcttgttttggcattgccttctcctatgcagggtgttgcctcttgtcctttattaccccagagtactgctggtatgagattattgtgtgaagctgacttttcagagggctgaggctacccttactctgataccagctacaagttcagagggtttgccaaacaaccctccagtttgataatttaccagaaagagccacagaattcactgaaagccatacttatgattcattacaggaacaggatactagttaacattagccaaggaagagatgccttggacaaagcccaggaggggtcgaaatgtggagctcccattcatcctctctcgctggcatcatagagagtattacctcctcccgaccactgtttgtggcagtatgcagggcattgctgggcagggaagctcattgagcttttggtgtccagaatttttattgagtcctaatcacatactatctgcatggctgatcttcagtctccagaccttcccagaagttttggctagcatctttcatcctcagttcctctgcaagtgtgaactgatacaacatggcctaaagcctccatcacaaatcacgtaattagactctctgattgccaaagtccccaggcaaacaaagatactccccttagactggacactccaggggcctagcatcaccttcttgtacctgagggcaaaagccagagcttttgtgtgtgtgtgtaaagttaattcttcacgaaacaattatattaacaaaaattttctagaaatttatagatcattcttaatctcactgactaggtcttctctccaccttgtgaaccctgaaaacctgagacaggtctcagttaatttagaaagtttattttgctaaggttgaggacacgtacctgtgacacagcctcaggaggtcctgatgacatgtaccaaaggtggtaggagcacagcttggttttatacattttaggaagtcacgagacatcaatcactatgtttaagatgtacattggttcagttcagaaaggtgggacaattcgaggcagaggcggggcaacttgaagttgggagggggtttccaggtcataggtagataagagacaaatcgttgctttcttttgagtttctagttagcctctccaaatgagccagtcagatatgcattcatctcagtgagcagaggagtgaccttgaatagaatgggaggcaggtttgccctaagcagttcccagcttgacttttcccttcagcttagtgatttcggggtcccaagatttattttcctttcacaacctcttcattttccattatattttttgaagttccttttttatctagaccctctgaatatcatccttttacctcattcatggatgcatattctttcttttttaggctgccttagaaatgcaaaattcccctcactttgctatgcagagcaatccatctctcttggatttgccttagtataaccaggagcccaggaggcctcccattccttgtctgcaaaagcctatccatacccatgaggtattttcctcaacaaaacaaaacaaaacaggaatctattcctgactccacctctcctttagaaggccaatcctgaacaaaagtaatcatcaaccataaatttctatacccagtgaaactatcttcacaaatgaaggtaaaataaagacaatttcaagcacacaaaaaaatgagagttttattatccaaagtctctcactaaaggaagttccaaaggacatattttaggaagaagggaaatggttccagaagaaacatctgagttacaggaggaaagttgaatagacaaacaaataacaaacagaaaggtaaacatgggtaattaaaaaaaaatgcaactgcaattggtttttgtttaaaataagaacaatttattttccccttacagttacatttatgattatattgcaggtgttaaaagaaaaactttagaaaaattaaatttagtagagtttaattgagcaaagaatgattcacgaatcaggcagtgtcctgagccagaataggtttggtgtcaccttgtgctggcttgtggttgaaaaagatttatggacagaaaaaggaaagtgatatacagaagacagaatgagatacagaaacagctggcttagttacagctccacgtttgccttatttgtacacagtctgaacagttagctgcctttgattggtccaaacttggtgattggcacaagcataggtgacagtctgtgtacgcatccagttagattacagttcactatgtatggagaaacctttaggctgaacttaaaatatgtaagaaaccagctttaggctaaacctaatttaacacaggtaaatctcaatttaaatactattggtaaccttttctcattattggctgacaaatgatgtcccttttcctttagaaacattttcaaagaatccaatccttttagtcgtcaaatcaagtgtttcttagttttcaactgagtaagaaaactttttcatttattatttactagggtcaggagcatttagtagcaatgataaaagtgcagatcagagactacttatattgaacagaagtgctttataaggtctctattcaactgacattctgttaagtatttctagtcaatggattcctacgcggactgttgaaactttaagctcaggataagtggtctggatgtgcagtgcagtttagtaaatgaactagagctcgggttctatttgcaacccagttttttggagctgaaggggcccttggaactctttaatcccaggtagaaaaatggagactcaggaaagcagcacagagcatttgttgtctgagataagagagatggggccatttgagagctctgaccaggcccatggcaggcaaagggctgcagagcgtttcaaattggcaaaattgacctgtacttctccatgttgtgcttctcctcagaacttttgggaagccgtgtgactgtcatcattccagctagaacactttcttcctccagaaagttttgtgatctgttaacaatcatgtctggaccaaagaatttggggaaacttgaagccaaaacaaatttatctaagattgttgttgtttttaaacaagtggccagctttgcaaatttatggattagtccccaaagcttgtgctctataattgacccttaacaggttagcagtagaggagaagagagacaaaggccacactctagggactaagagctatgagagtgtcgagaggttgggagggctgtgtgtgtgtgtgtgtgtgtttgtgttgttggagaaggatgatcaggtgtaggagagaagggagtaactgccacacttgtgaatttggaagcaatttcaaaatctctatgtggagattttcttttgttatatggacaaacttggggaaagcctcaaaaagttgaatgtcttagatctccacattctatttttttttttttccaagagaatgcttacttagttgcgggaagcagcctctaggtgtgcaggagtgcagatgcatgtcttccttctcttctagtggctgggactcttcctgggctggcatggcagcaactgtgggtgggtggtgcagaatttgtgctggtgtgggaggccctcataagtgacccagcctctgtcatttccgagatgttcatgtggtgatgtgtcctttgctctaaaacagttgctgtcatttgtgataggtacacagaagtgtatggacacaggtgcaaattcccagacccttacctgtcaccaggaggctggtggacttttccagggtatttgcccccttttcgtctcctgaatgacaatgttgtgaattgcgtgggggttcaatggaagtgttttactgactggggatttttattcttgctcattataatattatcttctctttatttcctcataaatactttaggtttcctgttgtaacttttgcttttcaatatccattttatctggtggtgatgatgatgatgacaatcatagaaaacagttacatagccatcagaatgtaccaggcactgctctaaacactcaccttatgttaatacatgtaggcctattattatcccccttttataaatatacatgttcttagaccttttccttttattaaattagattttcattcttatgttatccagttttatacccaaagttttagttccttttaaatttatcattctgaaatttttattgctaaaaattatttctaagataagttgtattgtccaatattttcaattctttttcttatttttgtattctacttgcttaattacatttaataattattttctttaatgctgccttagggttaacatttttcatttttttaatccacttttaaaaagttctttttttcctatatataggggatatagaaaaagttacacaatagcatagggacacattctctccaaagagaggcaatggtatggggggagcaaaagatagggtgagaccatcctagagtaaaagggaacaagaattaaccacaagcaacttcggaacctgaattagatgctggtacaaaaacaaaacaaaacaaaacaaaacacagcaagcaaagatattcttaggacaattgtggagatttgaatatgaactggaataatggttcactttcttaggtgtggtaatggtatcagggttatgtaggagaatatccttatccttaggccattcatgagagagatggagaaagtaaatgaggtaaaatattaacgattattgaattgaaagatatataggcattgatttcactattcaacttttttgttggtttgaacattttcatggtaaaagttagaaaatacaaaaaaaaacacaaaaacaaaacaatttttatctttattatctgtttttcaatttttggtcttaacttgagtattatttatattattatctgtttttctgtatttttgtcataactttttagttcctattttatatttttattgtttactgctttataaaatttatgcgtttactattttataaaaccaggtaatgcctctggtcctggatgctggctggggaaaggaacagcctgtatatattggccaagatgatgagattgaagttgcagagcttgtgttctctctggtcacctgcctagcccccttatcagatacctcacaccttcactgttggttcccaaaaaaactcatattaacattaaactcatagtcctctcataaattacgtgataatctaaaatggagagatttgcccttttccatcttgccattgaaattctcatgaaaacaacaacaataacagaaataccaagtgcaatggcaggagatctgcaggagaaatttctaatggcccaggacaggtgtggctctgaggcaggaagacaacaggagatcccctctctccacccctgctgcagagaggggaatggggcttagtggttacccctaggcctagatatggtttgtcaaaaagaacacaaagccacaagcagaacatagtgcaatttcctaaagtgtgagtagacttgagggaagttacttttatattaaaataaacatgggtatattttggaatagcctgcaaaagggagatgccaaaggaattttatgcttattgaaggctgttttgagacatcctctaagactcccaggagtataaatggaagagtttgtgaatctctgtattatgattaattatgggttggtttggctaaagaaggttttgtagggggaatgtttttgtgggccaatattgattatatatttatatatatatatagagagagagagagtatagacaactttttcttctttgaatagtaacctactgaccatttgtacgttgaagtcctatcccccaatacctcaaaatgtgactatatttagagatagggcctttaaaaaggtaatgaagggaaaagggggtcatatgggtgggccctaatccaatatgactgaagtccttacaggaagaggagattaggacacagatatgcatgcataaaggaaagaccatgtgaagacatgcagagaagtcaatcatctgtaagtcaaggacacaggctcagaggaaaccaaccctgccagtcaacaccttgatcttggacttccagcctccagaattgcaagaaaatacatttctgttgtttaagtcacccagttgtgatactttgttaagggcagccccaacaaactgatatactgctagaatggtgcttatcaattttgttattctgttaatttgtttcatttactttccaacacagttttctcctttctcactcactgatatcctgacgtttgacttcctgatcagaaatggaagtgatggggttggacagcaggtgttggaaactcaaatgccttagggaccatgcatgtggatgtgcaaatccaggatgtagaataaagacgtgtggtggttgctgtcacaatgaagggtgcattcccacttaaagacattcagattccaatgctttaaagccctgtgccagcccaaatgaataaataagtccttacctggactgtctggcaattgcaatccctgctccagtacagcctgggcctcatccccatgttcccttgatttattacaagaggtccataaacacaggtgccaaccaaaccttgtctgtagactctgtaatgccactcatatactcacctcttagtaaattaaattgcaaactcacttgttaaattcaaattaatttccgaaccttttttattggatactttcttaatcatgatgatatatggggtttatccagattttttaaaaaattcactttttgaattataaaagtcatgcatacgtatatgtttattgtgaaaagatacatttcttttcctcctgtggatcttcccctcagaattccagttctaattctactccttgtgtgaacccctgaacatgcacccatgcccattcatttttctgggcccctcacagcagctctagcacctccacctaaaaggattgaaagggaagatgagaccccattgcagaatatttgaagtggttactcatcagccctgtatatacatattaaaattctctgagttgttacagcagctgttgcaactgaaaataattcagcaaacaggatcattttctgtgtagtttatgggctcgggaacagtccagaagctttggaatttgagttactgtcagcccgctgctcagccaatctccacatgtcacaggctggtaatttgatctacagctcccttgaagtgagtttgtactgaacacagaaagctcttttttccccctttttgccaaacgctaaatagccttttatgtgtgtcttttttccccttacacaatcacgatttgattcaacaaaaatattacacaccttcttcctgaggattttgtgtccttttcttggactcgcagctacacattttgggcagcaagttcccttgttccctcggcagctgcctgcgcgcagtcctccggagagcctaggcctgggagagaccgccttggatttagctgggcctaagaaaacacaggcacagcagtgagaaaaatattatcttccaattccccttcctttcaagactcaggaaatctgcttcttttcagtgctcttatcactgctgtgaagttttgatttttccaatctccagtggtggtttaaaaggagcttagagcagaagctgaaagggcctcctgtatttagagagcagaagccccacctgctgtctctggggcacctcccagtggccagggccagggggtgtgtctgatgatggagacagttggagccacttcagcactggcgccgagtttatttcatctgctgatatttagattgtggtggggagggcagaatgcctgatgatgccgtcagttcaccaccatgcaacaggtagcctgctttccagctactttgcatgatatccagactttctggcatcaaggcttggtggctcacagggcttgaggcaacactactctgtagcttccattttttttagtgattccctcaccggtggtggatctacctaagatcacagtggccacggtggtatgctattttgggttactgaaaactgaaacctgtttttcgctgaagacagtttgcctaacagtttaataacctttatacttagaatatcaggagtcctgtctgtctgatcagccagtggtaccattaaggaaaaatgaaagattggttttcagagtcactgaagttctggtgatattttaaataaaaattgaatacttggacatctaaacttatttgattgaagccttgggatgcctaaagtcattgtggttgagattatatctgtttatggctgacaaaaattatcataagtgtatagagtcttatgttggggaccttgctgtccatctcgagaccatctgcagaaaatcccaacagctgcagtttacttctcatttttcagaatagagattgattatgaaggaggcacaaaacaaaccaataaacaaaaaacccaaatatttgattatggcattaactttatggtcatttctagaggagtgtgtgagagacattaactaggttctgattcttggaatagattagacattggccttgcacccagctccacggaatgatgtccccagaaggccttgcttgtgcctggacactgatgtctgaggagtacgcttccctgagctttccatgggtcaatcttagagggcagggctccatgatcctggccttgactgaagggggaaggatagattggaggtttttccaaagactcactggaatttggagataaaatatttaataggttgaaagcctttacaagggagaactctggtctccctgtgaacgatgaccaaatatggtaaaaatgttcccatttctggtggatcaatcagtccttaaatatttctagaataacttccatggttaaaatctggatccagattttctaatgagcaatttgcagaaagaacccacctgcatcaaatggcaaagtcagaaccacgtgcaagagtgaactgcacagcccttgcttagcaacatgccgcttgtagcccactgggggtggagtgccctccaatccagactctacactaagaaattaggtaattcaatggcaatagtaattttagctgcagtttaaggaacgtttacagctttgaaacaggaaatggaaaacaataagtaagaaactataaaataaattgagcacatagctttctgttacattttatacccagtggtatggaaagtttacttaaggaaatgacaaggcttatttagaggaccagcaacttctggagtcttttattgaaatggaaatgggagcaatgttggatactcttaaggctatttctttgtaaattcccaattgggaagctttaatatgtgtccagaaggatttaaagacatttttcttttaatatttacatgccatattataataagatgaatctttgctgtgaatttgaatctgaatattaatgttggctgtattttattgagtgattatagtgagccaggctctgtattaagcacttaaaatgactgagcttatttaatttatttaacattatgatgtaggtattattattatctccattttacagatgagaaaactgaagataagaaaaattctgcagcttgcctagaatatggctgctagcaaatgttgtaaaggaactcagatctgcccattcccagagcctgaggtcttaatctattctgctgacttaaattctgtatcatgagtttcacaacctgaagcttgggaactcctgtggagccctggagtgatgtttaaggaatacttcagtgagctgtacacactacaactcccatattgcattttagtttttaaaaatagtttctttaaaataaatgcaagaggggtctctgaacaatatgctcaggtctccaaactggctgaatttaccacggactatttttctagcatttggattttaacagaagcagagcaaagttgggatgaccacacccttcctgggcttcaaggactttaaaaatgtcctggctgccccagaagttggagagctctacatttcagcgttggtggtgtgtgttgtctgaatgaaatgggttaggggtagtggggagataagaggatttatagcctaaagaaggtcagggaatcccagtggcccacctgctttagagtctcaattttctcaactttaaatggaaatgatatcattacctatgtaatctgagtgttgttaaatgcattaaattaggcaatacatgtgaataaagcttatgagttattattttggaggtatttaatgtgttctcccctccttgacagtgggctgatattttaccatcctgtttctaaggccctgttaaagttgtttttctgagcgtgctctatccatcaggatcctggcaggaaacagatggtgcgctcatgctgggaagagtttaataaaggaactgtttacaaaagtgtgcgcaggatttaggaaaagcaacaagggatgttgcagcgccccagtagagggccattaccaacactaagccagaagggtggaaggaaaggagtgtttaccagcacctagagaggtttttgagagggctgcctgatagttaatgtggcctttggtggaggaatgcaatcaagtcacagaaacctaccagggagagatcttgggggaaaaatatcctgacctcactttcctccctccctttaatctcctgcaggtattctccactggttgaatgcaaatggaagccagaggaaaagggaacccttgacacagttttcatatagattggcctccagggcagacagcaggtgagagtggagagtggggctgggggacaaagagcaggtatggagcacagcatgtggctctccacatgtttaccagtaaccttcatcactcttgccagactggaccgagaatcaactcagcccataattatgctgtcgtggtgcctctacctccttttctgtgttttctcaatttccagaaacttattctccacttccaagctgtcttgtgttcttttgctcctctaagtcttcttattgtggaaaaatgaacacaaaaagttaactcacacacttaaatgtcttatgcctaattgttactttaaaatgtgcatacttattttcacttctgggatggctaaattgctaccagactgaccacagataaacaatacaaagaacaactatctgaaggtgagtaactgtaagcagattatggggattagttggcacatgtgtgaaaggataagacaaggtgtgtcttcccctatttatggtttttagcttaagagcaggccttagacaatgcccatagtctttctggcctgacgaactagaagaaaaagttgagagcagccagagccagaagaaagtgagaggaaacctctaaaagaagagtgccagagaggggagccccaaattccatgcatcaggtgcccaactttctggctgagtcccaaactttgtgtgcatgtggcacactgcaagcagctcagtaaagggtcaatgacctaactgagataagagctactgcccaaaagacagagtttgcagttttgtcaaaacaaaaacatcacactcgacgggagaagtgtaacagaaatgcagaatctccctaacaaaacattcccagtgtccaggaaaccatccagaattacccaacatacaaagagcaggaaccagattcctgacctattctgaagagaaaatataatcaatgaagatcaatcttgagatgacctagatattggaattaatagatgtagactttaaagcaactgttactacagtaattaaaggaacatttatatttttatgtgcttgtattagaaaagaagaaaagtctaaattaatgacctaaggctaccttaaaaagccaaaagattagaataagttaaatcccaatgcagtagaagagtagaactaattaaggtaggaaaagatatcaacaaaatataaaacaacattagaggaactatattggttataagagatgcagtttaagtataaagacacaggtaggagtaaaactgattcttgaaaagatcaagaaaattgatagaaccatagctagactgatcaagagaaaaagaacacaaataatcaatatcaggaatgaaaaaggggatataactacagatcctgcagacatataataagatgatatgttgactaccctttttgcctgctgatttctggacactaggagtccaacatgccttgtgaacaatcataaattatagttcagtgggacacttgctgtgtcctctggcgaaaatgtgcccttctagggtcaaagcctacagaacccagaattatgggggcaggaaggacagaaatcccccagtgggtcactgggagtgatgacaagtgtgatccttcctatttccaccccttggttacatgttcagtacactggaacatattcagagctttttgggtgtaaagatttgggtacaggaatactgtcattgagagcagtgctccaaaattccttccataaatactgaggtgtctccatcaccgtggccagattttcatatttttttcacccctggccatgtaacacacctcacagcagaccctttgcttgaacagcttatctgtttgcttcctatcacttctgcaggagaaaaatggagtggaatgggggcaagaacctagttctttctgcaggagagatagttaatgcttatggtgtgcatttttatatgccccaatctccctagcagttagttcagggccatgtgatttgttctggccaatgggtgtgagcagatcttctgagttgaggcagtgaagagccagtgtggttcctctgtggctctcttttttgggtatggcaaccttggaggccgtgtgttccagatggtgtagctgtgagtttcaggagcactgcccaacaaacagcaactttatgtcctgtcaaagcaacctttatcctgctaagcctctgagattcctggtttgcttgttgtgggtagcaagtgctaattaccttgattaataaatctattctctccacacccatcaatcaataaaaaattcagaaccctgattataaatgttttcacagttggtcagctaagagtttcttgtagattgctatgcatttagcattttgctgggttttttgttatcagtgcccactctgagtgggtggagccccctttcctggtgggttatggactcccttatatcagcagatgaatagaggttaagaagcatcacgagtcagctttatttagttcttatctggacatggacaaggttacagtctacccagatatgcagagagtattcagtgctacatactcaagctcctttcctggctaaatttctgttggttgctcccattcctataactggaacatcacctgttaatttcttaatgtatgtgcacacaacagattcttactatgtattctctgtctagccaggagcattacaactgcttccaccacaccacctcatttggctatctgagtcttcgggttaatttctgagcaattagtgctgttgtggtcattgggttttgttttgttttgttttgttttgtttttaggctcaatcttatcagattggatgcctcttgctttgaacccacactttgttgcctcacccttatgactcctctatttccctcttcatccttttattaaacaaaacttattaactctgtaatcagaccagcagcattgtgcaataggcacaaatgttaggtgccttacacatgcaattttgtgcccaactttggcagcagttgtttttattctgtcttcacagatgaggaaatggaggcccagtgaagacacaggagaagtattagtgacctgctacttttagatataatctgtatagagaaataatatggatataaaagaagttgctaaaaataatcgtaatatctgtatattgtaaaccagcagtccccaatgtttttggcaccgaggacaggttttgtggaagacaattcttccacagaccaggggcggtcgggggatggtttcaggatgattcaagcacattatattaattttgcaatttatttctattattattacattgtaatatgtaatgaaataattttacaactcaccataatgtagaatcagtggaagccctgagcttgttttcctacaagcttatatgggactccatatggggttgatgggagacagtgacagatcatcaggcaggcattagattctaataaggagcatgcaacctagattcctcccatgtgcagttcacaatagggtttgcgttcttgtgaggctccagtgccgccgctgatctgacaggaggcggagctcaggcagtaatgtgagcagtggggagcagctgtgaatatgatgaagcttcccttgctcgcccactgctcacctcctgctgtgtggcttggttcctaacaggccatgaaccagtattggtccacgtggcccaggggctggggatccctgttgtaaactacttaacattgctaagaaaaactaaagaagatataaataaatggaacaatattctgaattcttggaatgaaagaatcaatattgttagttgtctccaaattgatgtataaattcaaagcattcccagtgaaaatcccagaaggctttttttttcttttatctttttttttttttttggtagaagttgataagatgattctaaaatttatatagaaatgcaaaggacttagaatagccaagataattttgaaaaacaacaaagttgggggactcatactacctaattttgagacataaaactattgtaatcaaggtagtgtggtaatggtatcaagatggacaatatataagtagatataatggaaacatacatctcatgtatctggtgaattgacttttataaaggtttaaaggcacttcaacagagaaagcatagtcttcttaacaattgatcatccattcataaaaacaggaaaaaaaaaaagcagaaaactcctttgattcaaaccttgcaacatatccaaatccaaaagagatcataggcctactttcaagatctaaaaatataaaatttctagaaggaaacagaagagaacatctttgtgacaaggtattaggaaaaatgtttataaatcccataccaaaagaataaaccataaaagaaaaaaatataaattggacttcattcaaattaagaacctctattctttgcaagaaacttaagaaaatgaagaatatccacctattggaagaaaatattttcaaatcacatatctaataagacttgcatacagaatatataaagaattcccttaacatagtaataagagaacaaataaaccagtaaaatagggcaaaatattagaacaggtactttaccataaaggacatatggatggcagataaatgcattaaaaatgttcaatatcattattccttaggggcagattaaaaccacactgagatagcactacacatctgttagaataaagactgaccatagcaagtcgagggcaggaagcaactggaactctcatgtactgctgatggatgtgtaaaatggtacaatcattctagaaaatagctagtttctttaaaagctaaacatatagatagcaaataacccagtcattttacaggtatttactgaagagcaatcaaagtatgggtctatacaaggactgaacatgattattcatagaagctttattttaatagtcaaaaactagaaacaacccatatgtccatcagtgtccatcaatagatgaatggataaataaacggtggtatagctatacaatgggatacttatcaataaaataaatgaactattagcacatgcaacatgagtgaaattcaatgtaattatactgatagaagcagataaaaatgacatactgtatgattttatttatacacaaatctagaaaattcagatatttatagtgacagaaagcagataagtagttgcctggggatagggggagtggagagtagtcgaagaaaaggatttcaaaggggctagaaaaacgtcttgggatgatggatatgttcataatcttgattgtggtgacagttttataggtatatgtatatgtatgacgtcaaacttatcagattgtacttatataaaataagtacattattttatatcatttacacctcaataaaggtgctaatagcaagtaaataggggatattcattgaaaggcaggtgatgatagggtaaaacaatttagctttgaagccaggatgcctgggttactaattttttcttctcctcactggttgtatcactttggactggttaactcttctgggcctttttttctatgtctaaaatggagaaaactattccaacttctgtgggttcttgtgagcattaagttggtttattaatataaagcacttatggtactccctggtatgtaagaagtatttaacaaatgttaagaaattattatgcactgggcaccatgtgaagtgttttatgagaattatctcatttaaacttcacagtctctgaaacaagtaacaatccttatcctttgtaccaacatctaagtgaaaaggagaaaaccaagctgcaaagaggaggtttaacttatcccagattggttacacaggaggcaagaagcagaagccagatttgagtaaaggcagtcaaacttcagaacccacacttttaatcctgtgattaagtgctaacaggtggggcactgactcaagtgctaataagaaagttgtctagacagtgcccatgttttcagagcatttcattctctgagccttgtgaaactattgaagaccaacatgtttgggcagctttctgagagtgcctcttatgattactcctggcaatcatcttagtgctcatcaaacctatttcttcttcctgggcacagggtcaaactatttcccagccttcttgtatctggtgaggtcatgttgagaggtgacagcatgctggcagtcctcacaacccttgctcactctcggcgcctcctctgcctgggctcccactttgacggcacttgaggagcccttcagcccaccgctgtactgtgggagcccctttctggactggccaaggccagagctggctccctcagcttgcagggaggtgtggagggagaggcgcgagcgggaactggggctgcgcgcggcgcttgcgggccagctggagttccgggtgggcgtgggcttggcgggccccgcattcggagcagccggctggccctgccgaccccgggcaatgaggggcttagctcccgggccagcggctgcggagggggtactgggtcccccagcagtgccagcccaccggcgctgctctcgatttctcaccgggccttagctgccttcccgcggggcagggctggggacctgcagcccgccatgcctgagcctcccacccactccatgggctcctgtgcggcctccccgatgagcaccgccccctgctccagggcgcccagtcccatcgaccacccaagggctgaggagtgcgggtgcacagcgcgggactggcaggcaccttcacctgcagccccagtgcaggatccactgggtgaagccagctgggctcctgagtctggtggggacgtggagaacctttatgtctagctcagggattgtaaatacaccaatcggcactctgtatctagctcagggtttgtaaacacaccagtcagcactctgtgtctagctcagggtttgtgaatgcaccaatcgacactctgtatctagctactctggtggggccttggagaacctttgtgttgacactctgtatctagctaatctggtggggactggagaacctttgtgtctagctcagggattgtaaacgcaccaatcagcaccctgtcaaaacagaccactgagctctaccaatcagcaggatgtgggtggggccagataagagaataaaagcaggctgccggagctagcagtggcaacccgctggggtccccttccacactgtggaagctttgttctttcgctctttgcaataaatcttgctactgctcactctttgggtccacactgcttttatgagctgtaacttaccgtgaaggtctgcagcttcactcctgaagccagcgagaccacaagcccaccgggaggaaagaacaactctagatgcgcggccttaagagctgtaatactcacctggaaggtctgcagcttcactcctgagccagcgagaccacgaaccccaccagaaggaagaaactccgaacacatccgaacatcagaaggaacaaactccagacgcgccatcttaagagctgtaacactcacggcgagggtccacggcttcattcttgaagtcagtgagaccaagaacccaccaattccggacacaatgtgactagttcttgccaatgcaatgtgagcaaagcagtgtgtcatttctaggccaaggcaggtaagagtggatgggctttctcctttctctgctttccctacccatttctgctggtttgtgtttaaaatggaggagccacagcatgggagaagcctgcttcctgaaagaccacctggagcagagcccctattgctgacctgtgcagaaccatactttatgtgttaagtcactgagattctgagattatttattaaaacaagtaacatgacattgccaatgtgctactcttatgccagtatgtcactcttatgccaatacgttactcttatgaaatattacctttgctgaaacattccatctcttagaatttctaaaatatgggtcaaatacgtagacggactcttttgctaggagatggaccacagagttttgtagtagaagtttaagtaataggaaataatatataattagtaggagataacatatgaatgacacatggaataagagtttcaatatttatttatttatctgagatggagtcttgctctgtcgcaagttggagtgcagtggtgtgatctcaactcactgcaacctctgcctcccgggttcaagtgattcccttgcctcagcctcctgagtagctgagattactacatgtgtgcaccaccatgcctggctaatttttgtatttttagtagagacggagtttcaccatgttggtcaggctggtctcgaactcctgaccttgtgatccgcctgcctcggcctcccaaagtgtttcaatatttaaattccttccaagttacaatatttaaatatccttcatctcactcatggagtctgagtggtgaccagtgttcttcattccaattccctgttggcttttgctctgtgtgcatcctgtttcttggggctttagttgtgggcatcagctcttggctttccaagatccacaagaaattgcataatctctggccatctcagatgtaaaattatttccttgggttgttttaaaacctacccctcacatctcaaaaacctattcaatgggacaggttgccaccatctgtttttcaactgccatttttttttctttcttgctcgttggaaggtttgtcttctaattattttatcagcttccccatttgtgatgtgtcttctttcatactgtgccctgtctgtactatgacaattcatggtctgcagacagcgctctggttcctggcccacagctgggttgcaactccattagtctcccggcaccagagtcttctcttgggtttctggggttccaagtgagagacagaaaaagaacactcagcaccctggtttggggaccatctgtgacagcctgaacacatagcattatttttatgttttccctcttttctagttctgtattggaaaaaaaaaaaaaagaaaaggccagagatagtagcctttgtattactggagttcaagaggtttagggagaggacagctgttcacaatgctggatagtgaggacctcatgtcatcgtcatggaagggggcttgattctagtcatctggttctgagcacctgctgttttggcagacggtgatcgatcacttagcacagcacttcagaggctatccagaggctatccagaggggaatatgatcctatagccctatgctcccattttactgatgaggaaactgaaccctagagtcaaattgagagttcctcaaagatagtcaacagaccgaagccagtctgagaaccacttactcctggtggttggaatatagaaagtgacagtaagtttttaaaaacttttatggtaatttgacagagaaattttaagtcatctaggcctatatttcatatgtctttaaaagaccaggtgtgttgtcatttgttttattttctataataaactttattttgggaacagttttagatttacagaaacattcagaagatagtacagagagttcgcgcatactctgcagtatcttatagatagtgtaagacagtaaaattaatatattacattagctacaattagtgaaccaatactgatacgttatgattcattgaaattcatactttattcagatattcttagtttttaacctaatgtcctttttctctttcagaatcctatccagcgataccgtattaccactaatcatcatgtctcttcttgattgtgacaatttctcagacttttcttggtttccatgactttgaaagatttgaaaattatcgggcaggtgttttgtaggatgtccttcaattgggatttgcctttctcatgattaaactgggcttatgggtttgggggaggaagaccaaagagctgaagtgccattttcaccacatcatatcaaggctacatactttgcacaggacttatcactgttgttgatgttgaccttggtcgtctggcagaggcagtctttgccagttttctttactgtaaagttatcttcttccctgcccctactttcatactatgctcttttgaaggcagttactatgtgtaggccacacttagggagtgtggagttgtagtttattttagtgtacttgacaagaaattggtttgtgatatattgaaagtgaaaatggtcctccaacactgctcatttgagaagcactgctctaaaaaccctgtgtaagggcacacagaagaaatgctgggacagagcccaaggcatcttggcttcagtcccaggtcctgtcattccccagagcctaacttgtgcatccatctaactgtggggccaatttggctggctctgtaacaccacagactaccccctaactttccatgaatcttaaggagtgcttcaagtcttggtggacgtttctggaatactagtttcctcaaaccttgatgcattcatttgtcagagttactgttttaggtcaggttcaatggcaaataggttctgagatggagatttgtacacagaaaattcttttggtgggtgataggagaaggacaggtcagaaggagaagtcaaacgtcaatgcagtccaaataaaagcccctgccaatcttacggggagctttggacctgggatggccgttcagagttgctctgaaattaagcagaaagatcaactttgactgcccccaccccaccccaccaaacccacccaacacatacacattgaccaggtactggattggatactgtctgtctttgggagggaggtgtcactgggaaacgtggcccccttagcccatggacataacttaaaaaggaactcagctaagccaccagaagtcaacacccctggcagctgggggatgaatacttaggacctgatgagagatctggatggcaccctgcagcacttgccacagatacgattactgtttttaattcttttgcctttgtcttgtgtctagattccaagaaccaggaggttgtttgctgtactctcccttgtacagttagctgtctctagtgcctgaatgcactaattgtcctttgggtatggatgaggtaatgaaggaaagggatgctgggaagagaggccacatgagaaggttagtgtgggtgtaagacacaatgcagaggatttgtatttgtgccatctgcctgcttctatgattcatctgggtctgtgcacccttgtaatcagcaggctgcagcaaactaagtgttgcttgctaaagaaaaatgaaagctggaatttcagcagggaagaaagtatatgccccaccgtgatgagtacaaacacacagcatcagggaagccacacagaatgaagctctgagaagactgttagcattttccctccacgccccaggggaaaaggtgtaagtaacagaattagtccaattggtcaagaattcatctttcctgtcacttgtctcttgtgggagttcaaacttactcagtcccacccattttgattgagagtgaaaagaaggacattttaatttaagagcagaagatggaacttgagggcagaacaaatttggcaaatgtaaattcttatccaaaaagcatgcttcctgtacttggcaccttgtttccccgattctgcctgatgtccatctctttttctcattgcagtttgaattcaggcatgtgtctttcctctcagcttcaccatgcataaggggatacttggcacgaatgagctcatcctggctgataggaaaatcttataattaggcaaagaaactcaaaagaactgaagcccttttccctccatgagcatctttcactaactggcctaggagttggtgcctaccagttggattatatgtagctatggggcaggaaagggttaaaggatttagaaagaattgaaataaaaatgaaaattttttccctattaagatagcagaagttcgaatgtgaatcactgttttgcataataagcatggccatataataatagctaacattgttgagttctttcttagtgctgggcactgtgctaagcactttataggggttatctcattttatgttcatcatgactcagtattgtggatattattacaacccctcaagacagatgatgaaactaagacttggagaggttaggcaagttgcctaagtgtggagataaaattcaaatctaggtaccaatgtttttgaaccactcctgtactgcttcagtagctatgggatggggatgggggagtagtttgaatgggaaaatcggaagtgtcctcacataggcctcctagggaaaagcccttctgaaaagcatcctactgtaagtttccttcttgtagcttagaccattttcttttgtgctaacaagagagaccaaagggacggttgagatctgaaacttaagtcagaaccttaagattgaatttgggacctctgatattgactcagagtctgtggcatgaagatgatgaccaagaccatagatttggataagattgttccaagaggaaacgtgcaaaaaggaggttaaagagttcaggctggatttttgggaagccaacatttaaattaggacatgtagaggaaaataagccaataggaaggtccagaaagaagagttaatcgttctgtggtaatccaggagagggaggtgtgtcgctatccagaggcaatgaggcaaaactgtcagcttggatgacatcttgtcttctaagacaggggaggtggaaggaaagatcagaagaaaggtgactacattagaaggtggagaggaagcagagttaaggaagtccacgccagggcctgtataatcttaaggaagtagaatgttcatttctttggggttttcacactcaattccttccttccccaagtacgccccaggtgacactcaagcaggagtacctcaacccaagagtaatccagctgttgaccttgacaaaatcgtgttggcttgacagagagagagaaagctgtgtctgtgcctttgctgggaagctggtgatagagaccatggctgcacgactgccagctttcatgtggctcggttgacaggggtttcaccctctgatgaagttctccaaactttcttggaaaaccagctgggcaggtttaccttttgtctactgccttggatggatctcatttctatcctagtttggggttaagtattttctggctgcctcctgcccttggagcatccagagacaggtgacatgtggacactctgctcactcctctttctactgggaactttgggctgaggccaactcttgtgagtgctaaagtgcttgggggttggcaaattcaaggtaaacactgcctgacgtcagactcctgtgagatatcctacatccagactcccagagtgggagcttgcagcctggcaggtcttcctttccttcagtgctttggtgcctgcctcatttatgtgactgttagttgaatattttgtactttgaaaatatatgaaacctattagtcagtggagtaggattttagcactccaatctctcattttatggacagagactgaggttcagaaaggattgacttgtccaaagtcacatggctggtttgaatccaggtcttctggttcctagtccatagcttttctcatttttatcatgcaataaaaggtagctcatcacagaaatgtaaagagaaagaatggcgacctctctcctttcccacaattcttaccagttttgtatctcttgctcccagttagacaggttgtaattgactttgtctcttcatggaaggatacctgtagctcacacccatagctaaaaccaactcaatcccttgaatcatttctatttgcaatctatttctagatttaaaaaattagtgaacaaatctcttctttctgcagataggaatatacccttagggcaacaatcctggagaaatttgacttaaatttaaaccagattacaaaacactggggacaggcattggtggagttgggatgagattatcatagtagctcagcgatgagtgtttagcatagtctattctaagtttataacaacgctgggcattgttctattttactgtacaggaaactgggtcacaaagaagttaagtaattaacccaggtccctagggttaattatgttaattaagtgtcagtgctggatttcaaatcttcatttaactggctctgatggctgttctctttctactacccagtggttctctaacttgatgtatacaaattttctgagaagattatttaaaaagtagtttccacccaatccaaggattccgattcagcagggctgaggtaggttggagaatctatattttaaaaaatgccctcagtggttctggcataaagtgttgggaattcctggaggaaaaaaacagagaggtggggggcagtgggtgcagatggcagcttcccctctttgacagcttggggctaggccagacactctccaagtctcacagcctccctagacctggtcaggtgtcctctgattgcaaagggtgggaagcctcggcaagctgtgctggaggaactcgcattaagacaaggctccccagcatggaaatcccaagttcacccagaagtttcaaagttagggatgtagttccttctctgttgttttcctttccaaagaaagacccatttccaaccatactctaagcccagaggtggacttttccttgtctctattcttagtgttggcacaagttgctggcccagggaagtgcccagtgctcattgaatcatgactggtggagggcatgctcaggcgttcagtcctggtgagttaggttcaagggcttccctttctaagtgtctcctgtttgagagttacactctgtatgggggctaccctttggaatgtagctctaaggaacacatagctgagggtcccaaagtaggcagttttctaaggggcatagagatgagtgtgtgtgatagtttttatcctccctgatattttacaaattgaatctcatttacttgtgggaaaatactatagagattaaatttctaatctagccagcctgtaattatttcttttctttagccaatcactgatacttcaggcggctccttcccagtccagagtcagcagcaagtatcattaactcgccttctaatatttctcctggataataagacaaacaatcaggagattccaagagcctgaaccctaatcaaagaatccggtcttctggttcctcaatatcatcacatgccctagggctctaattttccatgcctacaaacctcaaaactcaagtaaaggcctctgatgattttccgtaatgtgattccatgtgttatagtattccctgctcagctcccacctccaaatgtacactacatttaaagtaagccaacatgcacagagagacaagataactcaccatcttgatagtcgaaactttatcatttacctgagtttcctcctcctcacccatgtcatccagaaaactgaaaatggtccaggcacaaattaatgaaacaggtggatgggaggcatgaggtggtcatggtggctgtggtgacctggcgggagtatgcgctccccaaaggaggcaggttccatttagacacatccagtttattccaggtgataacataggcaaagggctggcaagtgttctcattcttcaggagaagctgcaaatatgaatgagatctccagatttaaaagatgttggtgttatagaccgcctatctttccttccttccttccttctttcctcccttcccttcccttccctttctttccctttcctttcctgcctccctccctccctcttccccccctctttcactccttatttccttgttctacaaatattatttatgtactccccaaaattcatatattgaggccctaacccctctaccatgtgatgataatggagatgggatctttgagaggtaatgatggttagattagatcatgcaggttgggccctcatggtgggattagtggccttataagaggaagagagagagatcttttgctcgcctcgcatacattcactgaggaaaggccatgtgaggacatagtgagaaattggcgactacagcgcaggagtgagccctcaccaggacctgaattcactggcactttgatcttggacttttcagccttgagaactgggagaaaacacatttctgttgcttaagccacctggtctattgtattttattagagcagctcgagaagactaacacagttgatcatgagtgctggacaacaaattatatccttagatcagatgattgctgaccatttgcctgctttgttgtaaaaagggcattaaaaaatgaaattagggatggacgagtgggtacaaaagggagaaggaattaacacaattttgaggtatcagcaggtaggtagggctggttggttgttttctaaacagctgtgctcgaagtaatattttagcaagataggggctttggagcctgcttgggaaggctcagtttccttccttccttcccttcccttcccttcctttccctttcccttccttcctttcctttcctttctttctttcctccctccttctttcccccctctctctcactccttatttccttgtcctacaaatatttatggtgcactccctccctaagcacctccacccccccaacccctgaccaactgcactaggcccctgagaatacaaaggagcaaatgacttggtctttgtgtttcaggagctttaggttccctagagctctgatttgtctaagtggagctgtgaaaggagggcaagttttccgggccatcatttctgcacccttgtcccctgggagttgacatagaactagtggctgctctgattcagagtcaagtgagaggaggtgcttgaatgctgctctcctgtatcaacatccccctcctaatttagatcagaattgattctttggttgtgggcagcatggcagaggggagaaggttcagagaggctgcattactcaatcgctttccttcgggcaggttggattgtgattgccatgaagtgaaaacatccataaccctgagtggtcatgggtttgagcatgtgtagccactgctcctataacttggctgctggtggctggtggtaaccaggacaaagagagaagagactcttatgttagagaaatgtagtgtttataataaaataaaccttatagcatttctaaaaaaagtattcaggcaagtaaatgacagtcaataaaccatctgctagtgaggtccacccaaagcccattcatgtatttactcagtaacctatcattgtggagggcattggattaggagctgtggatattggtgattaagctgcaggtcttgcttggtctggcaattgaaaaactgatttttccaaatactgtatctgcatatcttggcttcatgaagataaggacctgtggctgcaaaggtctagggggtagagcagagggcttctggcatttaatctctgttaaaaatacttttcaaaatcattttaccagcatatcaaagctgtaaaatatattaagttaaatgagaaaaaaaatcagagatgtaactgttaaaatctagagtattttagttgaaagactgggacatgaaaagtaaattttcaacttgagaacactttgtctcagggaggtttaaaaaaaacaccttaaaaataacaagagcttcaaagcaagtgtttttatcactggcaaggcaggtggtcccacgtttattgtatgcagggttcagggaagcttaaacttaaaatttttaatgattttttaaagttcagctaaaagacattattctgggatagaaaaaagtctatttattccactctaggtactccgaagcagggtatggattctgctttcatctttcaatgcaagcctgtttccacagggttgagatctggcatggacaatttcagcctgaaacgattacttttggaaatttgcagtgagtggaaacagtcatgtagagctgtggatcttgctacctggatcaataacttcttctagttaagcttcttgccaaggaaaagcaaggaatatcaaatttcatagacctaatgaaccactggaaactgcttgcacccatgtgtgcaaggatcgctttttatgatttatacaaaccaaagcactcattggaataagaataatagctaacgtttatttatcatttattatcctggccactgtgccaagtatttatatacagtgagttatttaatccctgcaacaacccatgggtaggtactattatttttccttctttatagataagaacattgaggcacaaaaatgctaaattacagagtgggatcaatgtgttgctcgcttagaaaatgagtcaagttccatatgtgtgagtaaatgtgaacattcccacttccttgtcacttggttttctttctcaagtttggtgtgtttgctctgtgttcacaggatattgttaacttcttagtcctttgaagaaaaatcaaattttttcttaagaagagacttttgaaactcacaatatgaattcaagaagcaaaaaagaaaatcgaatttcacaaatgggataccaatagcttggaaaaatccattgcttttgcagggtttgttattgagggaaccctgcctttcccagcatccttaacatttcttcctcaaataaaaggtaataaaatgcaaccaactgactcattttctaagtgaatgacatatttactctactctttaagtttaaactctaaccaattccccaatccttagttcccatgaaatgtaatgttctcttcctaaaatgtttggccaagttggggaaggtgggcatggcagtgtgagcctgtagccaggttccaaggttcgcttgaggttaggaggttgagactagcctgggcaatatggcaagactctgtatccacaaaaaaaaaaaaaaaaattaaaaattaaatgtttggtcttctacaacctggctttccacttctcattcccaatcatgctctgggaccacctctttcctgtgctgaggaaggctaaggaagcactgtgttctttgaacacagtgctcaatccatcctgcattgatgcctttgctatgacagtttcctctggtctcttcctcctctgagtctagcttgagggccacttccgaacagctgcagagttgagctgctcctcggtacacttcactgttgaaccaacctgggccacaggtgttgcagtgaggttgtcttcagagcctcaccctacaggaagaaagtctgtgaagtttctggccctggcacaaagctgcagaatcttggtgaatcaaacaacttctccaagcctcaaagaaggcactttaaaaattgtgaagcactaactgaaggagaggagagtgtcaaggattccatcctccacttactagtagctgtcttattcatttgggactgccgacccccagatagccttcatccctggaaatgtgcctcagatgcatgtctcttcacatgcttgggccttccagaatgtaccaaaagccagggttaaacaacgtcagctggatgaacacatttcagtggcaaaggctgttggaaactaccactgtgttacatttcactttaaactcctcaccttgaagtgaagctaagtcaggccagagaattgaatggatttgcccttggccacagtatgaggtggtggagtaagcggaaggagaatgtggtatgtgttgcaggctgtcagtatttgccagactatggtcttttaaaaaatatatacatacattgcacaaagagtttggcattataaaaagaatcttttaagtaccacagtcttttatccagaacattattaagaactttttattaaaaattaagatgcctcagaaaccatataaaattttaacaggctctacctttccacttcgccttttccagggcacctcaggagaggtggtagaattctcaaacatttggagagctctgcgaggaacattctactttgccaatttgtccctgtattggcccaggacagccatttaccaccttgtttttggttatttcagctgctgctaggcgttctccttcaaacacacctggattgctgtgaggacactgccccacaggcggaacacaatgtgtttctcagagctgcggactgtgggctgtaggctcccacagccctgtgtgtgtgagcccgttggcgctcaccaagctcttctgaagttctctggtttcctctgacttctcttctggatgggaacttaggtacgggaccagtcccatatatattcatcagtgcaggtccctttgttcaactcaaatgagcaccacatggggttccttctttctgtgggcctcaatcccttctgtgcttgtcttttaaactaatctgctcacatggggagagtcttaaaatttttcctgaatgtacctctttttatcttcaagagaccctttgccattctagggtgctgtaatttgacaaataaatccttgtcccactttccccttccctggtttctcacctagatcctggcctttcgttcacctgccgtctttcagagtggagagtactcacccttcagtctcctattcactgcagtaacccaaattcccttctcttgggtggtctcctttatcactttcgtatttctctaattctaatagcaagacttcaggcccagcttgagaaagcatgcattttcctccttcatgttcgtacagtccattggacatccttaccatcagctcttgttggttgaaagatctgaaaactttcaactggccatttcctgaggttctcttttttgttcatggagaagcaactggagcccttcagtctgggcacagtcaggaattttctggattgctgccattattcttttattcagtaaacatttgctgagtcccttccatataaaagtcagtatcccaggggctggggatacaagaacatgaccaaggccctgcctaaaggggcttgcaggctggtgcgggagacacagtgacacatgttgccttctattggataccagtgcaataggttggagtgggagcaggatgtatgggatgctctgccccatgccagaggatggaccacctcattcagcaagggaaggggtgtcagggaaagctgtcaccaaaaagccctagttgaactgagctgcgaatcacaatgagtcattcgccaggcaaagtcagccagggcattcctggtggaggcagccacacaggcaaaggttcagaagtgtgcaagggggttgactatgtccattctttttatgaatgttgtcaaagcttcagtaatcttgcccctgtgcgtttcttgtctgccctgcaggcagaatgaactgtgagtgggttatcaggaaaggtcaaagactgcatggctggtgtgaggggctgtggggctgggccagggaagcgggagggaagggtgagtcacttgaaagttttgtgtgctgagacatggctcttaaaggagttctggggtttttgcagaggagaaagtgcttaaaggcagattatgcagccaacagtgagccagtaaatggtttcactggggcctatattgggacattttggcagccttctttattgggtttggggctctctggctatcagatacctttctgttctctccttgtgaatgcccgtgaggggtttagggtaaaaatgtggagcttttaagcatcttaatgtgatttcaattgcattttaatttttaataaaatgttgaataaagttctgctcaaagagccacagggatgagaagattctacttaatagggagcgtagtattttcatactgggagatagatgggtttaacaagaccctggtacatctctttcaagtaagtgcaataaatggttctgttggaatgggaaagaagggaggtgcatacatacatgcatatatcttatttttctgtatagccagtaattccactctttggaagtaaccgccgagcttttggcatctttgactaataccctcctcatatgatagctacactgctccaaagacggtacagacatctgagccaaacattttttctgttttgtttgcaagaaatggaactgacagatatacctgtctgttttgtttccaagaaaatgtcttgttagaaatgtgtgaaaatgtattatatgacagttgctgaaaatgtttcagatgcagcaataaactgattgtggtttttggaccagatgtgcaccatgtttagaatttattgtacttctctgtattctagcccagtgcttaagtaaatagagagaagtgctttgcttttcagtgagacttcttatgtgggtgaatggcattttcctccatttcatgatgggaaattataggaatcatgcaaattggaaatagtcactcacctcacacccattgtgtagcggagaagactcaaactaagggcctgttgtctttgtcctgactcctgaggttaaggagaagacttagcctgcaaacgtctatagcttaactgtgccgcattttctgactcacttagaaactaaagaaatgcacttaatgtcgattgtagtattttaaatccctgccttttgatctgatgcattgtagaacctagtcagaactcgattagttaaaaaggcaggagactttttcatgcatacccctgtgggactccaggcagcctttgccaaaggtgttagacatttgtttttctatgtgtgctcagtaaaataggcttctaagcatagaaatgatctgcgtgttgtgattgatctgcttttttacgctatctcatgttccatttcacttctagaggcacattgatttgaatagttaaagatttgtctcatttccttgccaaggaggattatgtttccagctttttgttaattctgggcatttcaaccactgcttctgataacatcctgctttactgtgctaggcattccttggacccaggactggggtaagacatggtcctgctgtcagggaagcagtaagatagttcatgaagggcatgaagtccaggtgcttcacacgggagacctcgtttaatgctcatagaaacgttagattttgcaaggggtgagggtgttaatttctttatttaaaacaaaataaaactgagcatcttgtagctcagagatgaggatccagaactaatagctgcttgactacagagctcatgccctccctccagctcactgcttgactggttgcatagtcaagacataacaatgaacataaggctagaaatttttggaataaaggctaacataggcactagagcattaaaatacattgtgtgttagagaagggtcattgtgtacatgtagtcagtgaaggaaggctttatggaggagaactgagctgtgtttggaagcctgaagatgaggatagaaatcacaggcatgaagccaccaaggaggacaagcttgcagggttgacaactacaccagattgccagggggccgacctggagagtcggggagaggggaataggaaagaaggggaaggtggagggcaggctgtttagagctccatgagaaactctgtgtgtgtgtgtgtgtgtgtgtgtgtgtgtgtgtgtcacatgtatgtcagaggagggtttacaatgtggaggaaacataccatttaactaaaaatcaaaatgtttgggggatatacgatgctgaaatttcccattgtagccagaaaaagtggtgttttaataatgagaatgtcatgtttcttttcctatgagggaataaaataagtcagcctctttgctgagttggaagtggctgagttgttggcaaagtgaacgaattccctttgagtctccgtgataaaaggaggcaacaggggaggggagatggggcaggtagaggaggaccagtgtgcagaccaccacagccccaccgtttgtctgattatctgaaagtgcttggaaactaggaagcagataaaaacttattaaagaaaagaaaatccagagaaaaaacctggggagcccagggagcatgcagggcggctctaaactgggatttgggatggggttatcttttttcccagagtacagcttttcaaacgtttccaacaaatattcacttatgctaccagggacagtagcataaagtatgaagggatgaaatatagtttccttgcttttttcctttttgcttatagggagatagctagcaacatttaatccaattttaaaaacacattgtagaaattaacgacgtgattttgtaatggagcagaaaaagaaaacctctaagatggagtgagcgacttagggatccctatgtagtcatcacagatgcctgtctattgataggaatcctgtttcaaacatggaatttaaatttaagagaaaggtgcacaccaaattgatgcctggtttttctggtggcttgaaagaaagtaatggagtttttaaaaatgtgtgaacaattgatatgaaatgctcaatgtgtatacaatcatttatgtggcaggcaatgcactgcatgctggagctaaaagagaaagtccgggggctttccatctattgagggaggcagagaaaagagtgatacaaagggattggtgctacaatatgcaacaagaggtgggaatgttaaaaaggattgatttactaagactggaaaaatcagggaaggcattatggagaagatgacatttgagtgggttttgcagtatagataagagtgcagatggaggagagagaagtgaaataaaggagaatggcaaggggcattgtaagtggaaagacatacaaggaaaaacttaaacatgttaaagtttaccttctacttggggaaaagaccacaggtccccttttcagattccctaaaactagtatttccctaaactagattgggaaataccactgtcactttgaagaaccactgaggttttttttttcttttgctaggagtggggtttaatctggactgaattggaggaaaggaactggcaccagagtggaggctggaaggatggtggaactgacactgggacagaacacagaaaacagaatctaatgctagtaagttctttgttatagaacttaactttgtgttgtaacccctgtctcctccactggcctacaatgcaagtttcttgccttagtcatctttgcatctctgtgcccaacacagtaggtgtattagtccattttcatgctgctgataaagaaaaacccaaggctgtgaaatttacaaaagaaagagttttattggacttacagttccatgtggctggggaggcctcacaatcatggtggaaggtgaaaggcacatctcacatggcggcagacaagagaagaacttgtacagggaaacacctcttttaaaactatcagatctcataagacttattcactatcacaagaacagcacactgggtccctcccacaacacgtgggaattcaagatgagatgtggctggggacacagccaaatcatatcagtaggttcttaataaatctctgttgaatgaatcaagggaagaatgagctattgtagttgtttggttaagagattccgatgtaggtataagcctctgtgggaatcttggaaaatgtaagactctttggggttagaaaataagaaaaagtaaatatctcaatcaggtttagacacagctttcacttttgatattgactctgataaagcaggatgattaatttctttgttaaagtgctatttcatgaggatgtattttctataaatcaccgataaattcttttgtccacattgaaatcttattcatatgagatagtgaaatatataaggaaaattactacttaatatatttaaaaagatggagaagtgaattagggataataaattatgagcctttcagtgtggactgacaattattttagcaagtaaaggaaacattttcttaatgcttatcacaatagatgtgagacaaaaagaagacaaatctccatttacaatttattttgctccaagacttcacaatgcaagatttactctaaaggcacaacttaaagaaaactagatgaatgtttcagcttgcattattaccattatcacattgaaaatggcagaagcatagtgccatcaactctgcttttgaaagatagaggtacccccactttagcttggccaacatcatctagacaaaatagacagcgagaccaaaacccgtggccaaaaccaagctttgtgaggctaaagcatcccagagcagtgtgttgggacagtgttttgaaatatcaactgagtatttttctagtatttactggggtcccttggttcttcttccattcagtaaactaggtcagtctggcttcattgtcttagggaaggtctgtcatagagcaagtgtagaaaaagaagtcaaatattgccttttgagttccaaaagctaggtccctctggaaagtgaagaacctggtacagatgagctaaaatacctgagctgtgagggccagttatccaccccaaagcaggtaaagattccttggggtcaagaagcatcagggagttgtggggacatatttggaactttctatgtgtatcatctctgagaaagaggactggtgcccagtccctacccagactgaaccctgggaagtacaattccagaacccccaatagaattgtgggagctgtgtttacccagggcctgggcctcagtttctgggtagtgctcaaagaagacatggttgtatggcgatgaagggccttcaatagcaccagtttccatgggaagaatgattctttgagccaagtagatgggtttttgaatggccccacagtttctcacaccccagcatggtgtggagcagtgagtgaattactgggcaccagagaggagtgcaaggagaaagaagagcagaggcaaaggtgggaatgtgggctgggcagcagtgaacttactgcatggtagccaggaccaggtgggccctggggcatcgaagcagatgccactgtgcttggctcaagatgactgaggacccaatgtccaccaccccatccctgcctgctcagccctgctcaacccctagaatccccatgtgactgagattaggcttctgctaccttgtcacaggcatgggccctcaaaatagaaattcagctgtggtatggaaaaataaagttacattttttgcacacatgaatctggggactgagattcaagcctgctctttgtataataaagaaaagttccatttgatgaaatctgattaagaatggacacttctctgtcctgcaaagatcagtatgcccttaacctctggcaaatacaaagatgggtttgttgaaaaaatacacaaaaatctctcagaaaccaagcagaagagtaaagcaggatctgaggggattcttggaaagttaaaaatgaacttccttctctgttgtaacgggctatgtgggctctttgatttttccctgtgtgccttgcctgtccctcttcattcctagagtcttctgccactccagcctgcacagagaccgtgatggccttcccccagcgtaacacctgttctgttctagcagtgacctcacggatagaggagactcttttgtgtctctcaggtccgtgtccacatagcaagaatctgattggctccctgtggtcaagtgtatactcctggtccaatcactggctggagtgttttggtgccgagtcacaaaccatattccgagcagtcagggcagggctgccatgttgcacaactgcaggttgtgcctgccaaacaatactctgggagcggctcccctggatatgtgtggtgcttatcctgcatggtgagaggcagtggtcctgagtaaaagtcctgctctcctggttagcaaatgtaataaaatggtggaacatagtgttgtcgctgtttgaattgagtgaatatcttcctaacatatgttgagtggccatatgaatgcatggagcaggactaagagagctgaccttggcatacagaatattcatggtgggcagatgaggctgcctactcaggtggttcactgtttagcactgtggtttggagagcaagctttgatgttcaacacacctgtgttcacatcccaactctgtttataaaaatgtgacattggtcaagttacttgatttctctgtctcagtgtctttatcaataaagtgggaatgaaaattactacaggaatgctcataaagattaaaggagtcatttaaagaacttaggccagtgtctgatgcttcataagtgcccagtaagtgtcagatgtaacttatgtcattattatcactaataattctattactagtgaattatttcactaatttttccactaatttatctcactaattatttcactaattaattttaattcttagtgaaataattcgctaattcactaatatatcactaatactagaattattagaattatagtgaaatagaattattagtgataatataatagattagtaatatattaatataatagaactattagtgatatattaataatgtaattagtgatatgttactgaattattagtgaacagttattagtgacttagtgattattagtgaattattagtaatattttagtgaatattagtgaattgtaatagaattaataataattctattattagtgatataagccatatgcattttacagtcttaaaatgttaatgacccattatatgaaaagcatttatttatctgcattcaagatacatgtttggttaaggtccttgtaattaaaataaaaatcagaatcaccatattataccaacattgatacaagtaataattaacaacaacaatgatgatgatgatgattaaaaacctggataaaattttgtctcaggcttagtgtggtttgggtatgcatgtacttatcatatttgattttgattttattttaaaaattttgtctttactttttttcttagcatcttgacccttttgtgacatctagcaggatgtatttttttttcaagatgcatgtttcacaaacaaaatatatgtttatatctgactgtacccaagctgctaattatgggcatctctttctatagctcactattaatcactcatgtctttggggttatatagaaaacaatttatgttacaaaatcaaatcctcccttaaaaatgtttgccctggaagtgaggcaggaggaaatcacaaactgttattattttcccttagatggatctaaatattaacattcccttagctttaaagattatttttatgccgctcctttataaacaattgaagttcactaactcttctgttgtctcgggttctgtctacaacatatccaaacaactcagctaaaaaaatgggcaatcagttcaacaggttatttggcattatatgtagaaaataaaaatgtttgaatagcttaaaacattttaaaaagcatagcatatagcaaaccaaattgaatgtttaaacataggctaaggatctctcacacaggggagggagttgccatttttagctctcattgcaattgtattaactacctaactaccagggcaacaatagcagccacagtggcagtagtagttacagcaggaggaggaggagggagaataagctattaatagtatgaacaacagtagtagttgtagtgattgttgtaatagtaacagttaacagcacatgtacacattgttttaggtacttcatgtacagtaactcatttaatctttacagcaaccttaagagatagtcctattatttctccattttacagaaaaggagattaaaattccaagaggtaaagtcactagtggaggaaccaagatttggaaaacagtaataatggctgacatagatcaaatattcatgcttctcagctactgacacgattaccccgttgaaccctcacagtgagcccaggaggtggatttcttcttatcctcatttaacacagaaggaaactgaagcttggatgtccgcccgatgcaatgtcagacagggtctgaaaccagggatccaaagccagaagtccagtcttgctttcagtttgattgtgtcttgcagattctgcttggaatggtttgctgagggaagagaactcctctaagtagaagctgttgccttgaggggggatctgggtacccgcctctccctgaggagcgttctcctactgcctgtcttacaaagagagtgcttttcttctgaaccaccccaaaagactcccacattggagggtgaggcagtggggtgagacaagtgaggtacttgtcctgggcattgcatttcaggggacactaaatatgcagtaatcaatataaataatattttatttacttatttatacatttttgagtcagggtctttgtcacccaggctagagtgcagtggcacaatcatagctcactgcagcctcaaactcctgggctcaaatgatcctcctacctcagcctctcaagtatctgggaccacaggtgtgcaccacctgctgggctaagggataagtaatattttaatgcaacatttacaaataggtaaatattaaacacttaaagtacattttttaaaaatcaaaacaaataccaaaaatatccacacctgaacaagatctccacattgaacataaagacaggatcagtttggtcctgggtctctggactcctggatggagaccaggtgggcaggtgagcctggtgctgtcctcaccccacagggctttcttgggtctcgagcaacatttgggctcctctgtgcaactgtctacaccactgctcacccaggcctccatcacagtcaccatgatgatgagcagtgcttctttaggcatcacgtcaccaaaacaatatttcatcatgcagtgctatttttaaaaagtgaggatggcattttccaatgatatgttagaagagttacacctcttccctctccaccttttctctccagaacccaaccaacgaagttgtttaaaaaagaaacagtcaatgccttttccacttttagatctgcatattgggccactcttggtttcttttttcttatttactacttgagggtgtcaatttaagaaaactcagctctcctaccagcaagtcagctgggacacatgtgttctgttcatctcttccaaaggcactgtggaattgtccagtcccagaggccttgggctttgaggacgcagcccagcagtcgtggtgctgaatatgaatatagtggcttcccaacccaaaagacatttcatttattattttaaaaatattttctttgggctcttttaatcctcagggatattggcttgatgaatagcaaataaattccctaaccagactgttgttataaatatccgtggcattaattcaaaccatttgcattggaaactttttttttcccctggaggaaaaggggtggctgatttaacctcaacatttgggacacgtttttccctaaaataactacaacatccatcatttttttttcctgctggtgtgtcaattttttaatgagaggctgggtccctttagtacctttggtctccatagtaacaatttcatgtgtttattctggcttactgaaataaaacactgaggaaaaggtcagtgactcatttttgattgggggttgctctaattagaggatgattatttaaaatttggtctctaacacaaagatactatgtgcttaaaaataagaccatggcaagcattttaaatgacaaatgatgaaacatttagacagtgagaggcttcccaactatgggtctttcttcacaggtgcaggtgttttcaagattattattgttttcatccgtatttaactgaccttgacttcttgccattccctctctggtagcaggatctgagtaatgcattaagtaatggattaaagtgtctagaatgactaatgcagttctaggagtcaatttagacctatggtatatgcatctgagatgagctgaatcaatacaataaagtcctctcagatggccactgagtggccaggggaggcataaaccttgcctaggtacagtttttctatccccttggtcactgcaggttttggatctgtaggaaggcagaatggggcatgcagtgctttgtgattgttgccttgggttgccattgccattgtttgacttaacatgtgtcacgcctttcttttctcatctgtgaagtggcaataacagcggaagctgcatcgtaaggtgtttgagtggattaaatacaataatcatgcatgcacagggcttagcaaaaactagaccctacttaggaaataccgcagcagtgttggctgttttaattattcttttactttcattatttgattggcactttggcctttggactgagttcctttgttctcaagggaattgcttaaaacgaaggtaagactctggcaagtgaagtttccaccgcagagagtgagaaatcagtttgagcaggtgtggatgtggcactctgcagggaacattctgtggggaatactgtcctccgttagggctccatgaggctttgctgtgtcatggctgagagctgagggctgctttgtcctctagaacccaggctcccatggactggctcacaggacaaagggcagagctcaggtagtggtcctcaggccctatctggttgaatctccatcaagcacatttctataaaatacaaagagatgcaaacttggctggcagaactggaagacagctacacccgtgtgaccccatattgtggcctaacaggatgactccatgagacacggtgaaaccaggttgaccttatgagtgcaaattgtgtgggcttgcagagaaaagctgaaaagtttagataaaattctgggaatttgaatgatgtgtttttctagttactcttgaaaatcagtctctttgatgggtcctagtaaattttagaccttagaagccaggccttaattagggaacttcacccgtccacttaattaacaactattcatggctctgtgtcaagcacgtgcttagtcagctgggacaccacgattctccttttttggagcttacattttaggtgggagacagagacagtaaatgaatgataaaaggaagaaaattactgtaaaatattacaagctatgaaggaataacatgctagagaacatttgtcagactcttgatctttctgtgttgcagctaaggatggaaataatgttctgtggtaaagattgtggagtgaatccttctcattaagtgttgataccagcttggcctttcctcttaggttgtacaattggactgagcaaagtgcttgctattgctgttcttattttagttgtgaataacgatgttgctagggcctaagtctcttctagctgttataattactatttttattctcattgtcagaaaacacaactttgcaaactgatttactcacagactgctttctccttgcccccggttaagtatctcgtgaattttgtgtttcccagaacacattttgggaaacagtgtttcagaaaattcaattctgatgggcctgtgttatgaatttccaaagagtagtaagtatgtcttcaaagagaaatattccagatgagatatctgcgcttgttggctaacctaggtttttgaatgcctgattaaggtcacctatttttggctcatcatctacccccattagtcaatgttgttgcaaactaaaaatagtccctcaaaacaaaacaaaacaaaacaaaaacaagagatatttaagggcaaacagataaattccattgtacagtttaatgtaaaataaataaatataatgtagccttgtttctaaagtttgcaaaaggataaaatgatacagaaattcctttggggaaatactgtgcatgtcaagacatgctgtttctcttttccatccttagactattttagttcttaaaagatttgcaaattaaattctttgcttttgtatttttaaaatattataataggtgtaaagagaattgattggtacatgcacttggctctctgggatgtgggggtgctgtcagaggctgttggctatgtcccagggtaattgaatgccaattgaggagacttgaattgaagctaactccaccactttctagcttttagcaagcctcttaaactctctaggtctttttttttttcttctagaatgaggacaatagcacccatgttactgggatgttgagaaggttaaagtgagataatgttatgtgaaagtaccttgcaaactatcaagtctgaaattataatctggtttagtctgtgcacttggttgtcattgcattgtattgggagaagactgttattggacctgggctgggtgattaagtcccgaattttgagaacaggggacgaagcatctctgaaatagaacggaagaaggaaagaggaatggaactgcatgagtattagtgtgggaagggaagtggatattcacaagaagtaaggcaattcagggaacatgcattttcattgagcttagggacagaacagaatatgtactcactagcatatttttttcaaacatgtactgaagtagggtgacattaggtgagtaacgttaggttaaatacagtaattccattatccctgaaaaacatgttaaaaagaaacatagttccattttcagtaatgcggacaaacaagataacctgaagccctcctgctaaaaacacttggaaatgccagctagaccataacagacatttttttaaagtgcatagttgagcctcaagaaagtaaaagaaatacccagggatacaaaatagagaggaatctgaaaattagagtagtgacaggtaggtgttgttttggctgccttttattttcagtaattagagagtttgggtttaatagccttgcaggttcttagacaagccatgaggctgtcaagaggtgagttgttggacctgagatccctccctgcacatgcctaaaggtgacacccgcgaatcctgttctcaactacctgattgctttgagtctctctttcctttcacccattctgcaacttattcaacaaatattcattcagtattttctctgtggccagcactgctctaggttttgtcaaaggggggattctgatcattcatacctcactctgtataagccaaggtatgattgcttaacaaagtgttttgaagactagatttctatacaaacctgttacagtcctataagagttgcatggataaagtgctgatctcagccctgctgctccttggtgagaccctcagccacttctttaacctctccagcaggagctggcttggcttcaggatatagggtacatccttcttactcctaggaaatacttgttttcaatccccctgggtctcagcatgtgccttctcattcctgagggcagcagcctttataagagagtgtgtgaagccttggagacccatgccaagagggtgggctttcaccagaggttggctcctggactcccagtcaccccatatcttcatttcctcaggaactgtccccaccaccactggctaaggggtctgatggatatcatggagagcccccagagatgtgaggttgtttttcagatcctagaattggagatagaaggaagacaagagaagaccaatgagcttgacctgtgaaattcaagagtagagggtaaggagaactctgagagccagagtgttggcaccaccatccttgtgcaaaggttgatcatcaccaggttaatccttttgaagagaaaggcacaatgcagaggagccctccccctcccactgctgaaagtctggcaatgtcagatacagtccagttcttataatttggggtgctgtagggctggctgggatctcaagtgcctgctttgagacagagtaatgaaacaggaacttgggggagttactctctgaacctcccatgggggatggagtttctctcatagaggccttgctgctggagtctcaggcctgtaagaagaaattctagtttttgagtaatttaagtggtaactttaagttcactgagagttgcactgaaggccaactttttcctctagtgtaattattcaagagcaaccatttgttggcaaaaaaaaaaaaaaaagaaaaaaaagaaaaagaaaactgtaaaggcctgggctgcagtagttggagcccatctgtctacggccttttttcaaagcttgggaaaactgaacttgtggataggctcagttggagtttgggtcattggggaaccatggttgacaactatttaccgttcagtcaagaatatgttttcaggtcatttgttcagctctgtggttcccctttggggcatgggctacttaaaattttgtagaaaaataaatccatctccctttaaagactggcctccttgtttttgttagaagccagcatagattttgacgccagacaaatatgtatctgtacgtttgggcattgcaacttactagttatatgaactcaactatatctcttaaattctcttgatttcctcacccttaagatggggatgcttggcttgttccaacagaaattggatgtgttgggattttggtaacttctattttgtgtgtgtgtgtgcttcccaggacactttaatacaaagtacaaaatcaggcttactcttagctccttgttaatctcttctggcatgcaaacagagaggtgaagttcaagggtaggggtgtatagtaagtagacaaggaccctcaagcctagctatgggactgggggaaactgccatacagagcagcaattttctcttggaaatccatactcaggacttatctcagagacattgtccacagataatgctcataacaactaaaaactagcagagcaaccagaagtataatataaatttggtttgacagtgttaaatggcacttggcagaatcagttctacaaatcactaggttaagcaatgttcaatacaagtttggagtaaatgaatactcactatgcagagccaaagattcatttatatattcattcactgaataattagatatttactgagccactgccaggtgccaagcccagctctcaatacagggtgtgtgttagtgaagactgcagagagctgccctcccagggcacagttccagtcagggaaacagacaaattaagaaataaaaatgtgacataataagtagtgataagatatttgaaaaaaaaaagtgaagcaggggaagggattagggagttgttttttttcaacagagaggccaaggaaggcctctctgaggagatgatgtttgatcagagacctggatcaagtgaagaaatgaccaactcatggggagatcagaggggagcaacaccaatagccataaaccaggattgtcccaggaaaactaacacctgtggttaccctatagaccaaggtgaggactttggattttattctaagtgtgaggagaagcttcagggagggacgtgatctaatttgtgttttaaaaagacctctctggaaggtagacagcagacacagggaaaccagtgaagaggccatcacagaagcccaggtgagagataacagctcagcctcacattgggtttggcttacacctttttttttttttttttttgaggcagagtctcactctgtcacccaggctgtagtgcagtggcgtgatcttggctcactgcaagctccgccttctgggttcacgcctcagcctcctgagtaggagtagctgggactacagtgcccgccaccatgcccggctaatttttttgtttctgtattttaagtagagacggggtttcactgtgttagccaggatggtctcgaactcctgacctcgtgatctgcccccatcagcctcccaaagtgctggaattacaggcgtgagccaccacacctggcaggcttacatcatttttattagactctacacagaactcatcctgaggctcggccctctcattctttcccaaagcagaattatttgccctcaatattaaagaaaattagaggatcattgattccaaggacggtactgggccggtggaggatgtgggtttccctgcagtgtctcactgccctacctcccttgtcctccccgagcagcataaaggtctcaacccctcttcgtgctcttcattgtcattgtagattattggttccagaatggaatgtcctctccttttctctttctgtttgtaaatcaaaaattccttttgtcttccaaagtaactttgagcatgcagcaattgtatctctaaacagccccatcagggacattctgtattttgttggagttgatccaaaggtcctgatagatgaacttcgaattgtcttttaatggtcctcagaaaagttttattaggtacatggtggacctggggaaacttgttgggacttgtaggttatataattcttttagcttcattgctaggatgcttgggacttttaaccatgacttcattgctcttgaatatgggtttcatgcatctggttgcttggctgttttcagaaagtaggggtaacagtcccatcaatgtatcatcttttccatgattagaaaagaaacctgagaatgctttcctagcaagtatgtagacacagtttcctccaacacctgttctttcaagtcatgagacatttgaaaataaccacacaagttcctgcatctgagcctgtcttttgaatatctgtttgagcaacatgaagttttgctagtgtgagctaatgtcagcatgcaccctcctccccactgcctgtggattcaagtatggcaaatgcctgttgatttggaatgaccaggagatggcttattttggttctgtatcattaatcaacagatgtgtaaacagatttttaaaagtaaaatgcctaatgtcacattgctattacattaaggagctaggattctgactcccttttctaaacattgatccacactgtgatgctttggaaaatttaaaaattatgcaacaatgcactctcattgtgaaaaaaatgagaaaacatagatggaaaaaaagaaatgaacctcaaaaattccactattcagcgataaccactgttaacattttcaggcacttcttttcagttttttttctacaaaatgtaattgcaaatgcattttcaaagatactgctttacaatttcctttttccctttaataatattttgggttttgttcatgttcttctaaatcagaacatagatctgcattatcattttaaaaacttgcattgttttccattccaggatgctagtactatttattaaatatttcattatttttttctcctcctgagcttgactactgtattagtctgttctcttgttgctaataaagacatactcgagactgggtaatttataaaggaaagaggtttaattgactcacggttccacacaactggggaagcctcacaatcatggtggaaggcaaggaggagcaagcaggcaagagagagcttatgtggatggcagcaggcaagagaaagcttgtgcaggggaactcctcttcataaaaccatcagatctcctgtgacttattcactatcaggagaacagcacaggaaagacctgccctcatgattcaattacctcccacttggtccctcccatgacacgtgggaattatgggagctacaattcaagatgaaatttgggtggggacacagccaaaccatatcaactaccaattgattaaccaaatccctcagttttagaacatttgttgaatgttaataatatttcaagtttgcgctatgcactttacatatgttatttcatttaggtaacttgcttacaatttcttgatattactgactatccttattctctgtatacctttctgtaggattgtacactgattatttaagggcttttcataaatattgccagagtatgctccagaaaggttctaacaatttacattcacaaagcacaaagcatccagagtgtttaattctctacatccacacaatcaatgggtattatcaacttttaaaatcttttctaatcttctaaggaaaaacggtaactcattctttcaccttggaattctttgatcactagagaagcagaattttgtctcttgatgtattcatatttttctctaaaatattttaaatcctatatatttgaacatattaaaaagtatattttggccagatgtggtggctcatgcctgtcatcccagcactttgggaggccgaagtgggcagatcacgaggtcaggagatcaagaccatcctggctaacacggtgaaaccctgtctctactaaaaatacaaaaaattagccaggtgtggtggcgggtgcctgtagtcccagctactcgggaggctgaggcaggagaatggtgtgaactcaggaggcagtgcttgcagtgagccaagatcgtgccactgcactccagcctgggcgacagagcaagactccgtctcaaaaaaaaaaaaaagtatattttaattatatgtactcacatgtacataatttcatcaatgcatgcctttaaaatcatgaagttctctttttattgcaattttttttgtttgctttatcctcttcttctttccttttacatcatcctttctgtcccttaaacagcctttaaaacaacattgaatgcatctttccatatttttatatgtccttatataatccttatataatgtatgacatacatgcatacacatacactatattatatacacatgtatgtgtgtatatatatatatatatatatacagtttgttttatagatttttttaaaaagtgggatcatatattacatatttttctgcatcctgcttttctcactcaacagtacctcatttgaaaaccctccaagttgtttgatggagttacaatttatcattttcagtgactgaaattttttaaaggcatgctcctattgataggcattgcttgtgtttctggtttttctttttcttctaccactactaacaatgctacagttaatatcttttaacatatgtctttacaaagaaattgattttatggaacacacaggaatgttattggtaagtggcctaagtgtggatacgtgttttacccctaagaaatgatgccagattgctttgcccgaaggtccaaacacgtcccttcccaggagcaatctcagagagtacccatttcattatgtccagccagcaatagctgttatggcatttcaaattatcagtctgatggctgtagtgataatcatattgttactgtaatttgcatatccatggttactgcttgtgaatttgtatatcttttcatttgtttgtttgccattgatttacccatctgtgaattgtctttgcccattattttattgggttacatttttcttatgtatttctaagagatttttgcatactataaataaacttttattttgttttattttatttttgagatggagtttcgctcttgttgcccaggctggagtacaatggcgtgatcttggctcactgcaacctctgcctcctgggttcaagtgattctcctgcctcaacctcccgagtagctgggattacaggtgcccaccaccacacctggccaatttttgtaagtttagtagagatggggtttcaccatgttcaccatgttggccaggctggtcttgaactcctgacctcaggtgattcgcccacctcagcctcccaaagtgctgggattacaggtgtgagccaccatgcctggctgaaaaactgctaatttttaaaaatatttattttgaattcagaaattagaacaaattttaaaattaattttacaattttttactaaaatttttgatttttttttctgtgcatgcaggtatacaatcatgtaaccaccaaaaagagtttttttctcatctttcccaatacttgtgccagttgttttcatgttatgtatactataatacctataatagtgttgaaataatgtgaaacataatctttatctagctatgattttaaaatttgccgctagcttttaggaaatttctttgttgaatttaagtggtttctttctagccctattttagttaggactggctactgaatttcgtcaaatgccttttaagtatttattgataggacatgtgttttatcttttacttttttgctgcacttaattcaatggatatattaatttcctgatgttaaccaaccgattattcctgaaagagactcaacttagtcttttgatatattgagagattctctttgctaatacttatttagaatttttgcttttatagttataagtcagatttatttccagtttcctattttgcttccatttttattgagtttggacactggattttaaaattctgttccaatggtctatgtagctgttttaataccagtatcatactactttggttactatggttttgtaatatattttgaaatcagaaagtattgatgtttccagctttgttcttcttgatcaagattactttggttatatagggtccttggataaagaaaatgtggcacatacacaacacagaatactatgcagccataaaaaaggatgagttcatgtcctttgcagggacatggatgaagctggaaaccatcattctcagcaaactatcacaagaacagaaaaccaaacactgtatgttctcactcataagtgggagttgaacaatgagaacacatggacacagggaggagaacatcacacaccagggcctgtttgggggtcgggggctaggggagggagaacattaggagaaacacgtaatgtcggtgatgggttgatgggtgcagcaaaccaccatagcacatgtatacctatgtaacaaaactgcacattctgcacatgtaccccagaacttaaagtataataataaaaacaaatagtatatgtaatagggtcttttgtgattttaggatttttttttttttttttctgtaaagaatgccatgcattgaatttgtggatcaccttggacatttttacaacataaattcttccaacccatgaacaagggttgtctttccattggtctgtgtctttaattttatgcattaaatttttacagttttcagtgtacaaatcttaacctctttggttatgtttattcctaagtattttttttattttgctattgtaaatgggattgttttcttaatttcctttttgaatagttcatcgttagtgtatagaaatatcatctattttttgtgtgttgtttttgaatcctgcaactttactgaatttgtttatcagttctttctgtggagtctttaggatttactttatataagatcatataatctgcaaacataggcaattgtacttatttctttctgatttggctgcccattactttttttttttttttttgtctagttgctctggctatatcaaataaaagtgtcaagagtgagcatccttgccttgtgctgaatcacaaaggaatacctttcagtttttctccattgattatgatagcagtgggcttttcacagtgggctttactgtgttgaggtaagttccttctgtacctattttgttgagttttcattacgaatgatgttgatttggtcaaatgctttttctgcatctgttgaaatggtcatgtggtttttatctttcattctgttaatatgatgtaacaccttgattgatttgcatatattaaaccagccttgcatcccaggaataaattccagttgttcatggtgtataatctttttgatgtgttgttgaaaacagtttgctaatattttattaaaatttttgcatccatcagagatatcagccttagttttcttttcttatggtatatttgattagctttggtattaaggtgatgctggccttgtaaaatgtgtttggaagtattccctctagttacattttttggaaaagtttaagaaggaatggtattaattcttctttgaatgtttggtagaactcagctgtgaggccatctggtcctgagcttttctttgctgggaggttttaagttactgcttcaatctctttatctgttatgggtttgttcaggctttttctttctccctgattcaatgtttgtggtttgtattttcctaagaatttatccatttcctctaggttatccaatttgttcatatgtaattgtttataatagtcccttatgatccttttaatttcttaggtatctgttgtaatgtctccaccttaatttctgattttatttatttaattcttctttcttttttatagttagtctggctaagggtttgtcaattttatcttttcaaaaaatcaactcttgttgattttctctatgatttttctattctctatttgatttatttctgctctaatctttattgtttccttctgtctgctaattttgatattgccattatatatcaatttggggagaacaattttgagtcttccaaactagtttggtatatatctctaattgtgtaaatattctttaatttttctcagtaatattttatatttttctgtttatagatcttgcaatcttttgtttaatttatccctaagaatatctttatgcaattacaaatattttaacattttaacttccaaatgttcattgcttgtgtatgaaataaaaatggactttttgcaaattaatttttatcctacaatcttaagtttatttattagttctagtagctttttttgtagatctgctggattttctacatagatgatcatgtcatcagtgaataacaataggtttacttctcactttcaaatctggatgtctttttggagagagttagtatagaattgattttatattttcttaaatgttggtagaattggccagtaaaagcatctgggccagaagttttctttggaaaggtttttatctataaattcaccttttgatatagatataggactaatgaggttacctatttttttcttgagtgagctttgataatttgtatatttcaagaaatttgtccattttttccttatgttgttgaaattattgacataaaattgctcatagtattcccttattatcattttaataactgtcacatttgtagcgatgttatttttcttgttcccaatattgttaatttgttaaagtgtgatttctataaatggcatgtcattaggttgtgttctttaatccagcctgacaatctctgctttttaattaggatgtttagaccatttacttttaatgttattactgatatgtttaggtttctttaaaattattttatatttttagagacagggtctttctccattgaccaggctggagtgcagtgaaatgataatagctcactgcagcctcgaactcctgggctcaagcagtcttcccatctcagcctccctaatagctggaattacaggcatgaaccaccatgcccagctatgtttttaaaaaaattttgtagagatggggccttgctatgttgaccaggttggtctcaaactcctagccaagagtgatcctcccaccttggcctcctgaagtgctgggattacagatgtaagcatggtgactggcagatatggtaagatttatatctatgtttctatttgtttatctgttttttattctacctttccttgttttaattattaagatatttttgggcactgaaagtcttattcatgtaaaatcagaacttcaattttatatcgaatccaaaatttcttccctgaccatgtgcagatgatcagtggctcaaggaccctttccttttcctagatcttttatttttcttcccccactatttccagtgctcaggcttctccagggtttggattgggagaagcttgatcagagtgaagaaggccatgactctttttattcaacagtagcaagagcaacccaaatctttgtttttacattatttatggcagtttcaagtgtttcgctgattgaaagctttagctattaaaaagaagaccctggtattagtctctttacaactgttgcaagcctgttgaatttgaatgctaagagacaatgtgtgttagagcttggtgtacagttgcttaccttaaatagattaggcattagtaatttaattcttcactgagttttaccattctgaactaagatacaatgttgttaaggtaatgagggctatagtaacacagcaagaaaaaaaatcttaataaaagtttttatttttatttttttggagacagggccttgctgtgtcacccagactggagtgcagtggtactatcttggctcactgcaacctctgtcttccaggctcaggcaatcctcccacctcagcctcctgagtagctgggactataggcacatgccactatgcccagctaatttttgtattttttatagagacagggttttgccatattgcccaggttggtctcaaactcctgggctcaagctatctgcccacctcagcctcccaaagggctggaattataagcatgagccaccatgcctagccaataaaattatgttaacatctatgtaatgtccaatattggttctctttcaatggcaattatcttccaagtagtcatttatggctccttattgggcttcttccatctctggctctgccatttttgacctagggcttctaaggttgccacacccatctacatcaagctgacattgttccagaaattttttataggctaagtcctggggatggtatacatcacttctgttcatatttcattggctggacttcagttatggctgacttcaagggaggctgggaaactggggcaagaatagaaaatgcttggtgaacagctagctagtttctgtgtaggagtgttttttgttataaggattttacagatttaaatttaaatttaaaagtccatgaacatggtttttcatctctgtcttctgtggtagtatgttgacatcatatggccaggtcactcaccaccccctccccccaccatccccaaggaaactcagtctcaataaggacatttcttggggagggggaaggtagctcatcacactaacaccaaagctctcagaagttgcaaagcttgaatttttaagaaaatgtaaagggactacagctttataatgagcattttaaacagaaaagaacagatttaatagaacttttattaaagtcaagcagcgatatcttcatacttcatgctgagaatttttttctttttctttaactcttgaatgtctttttaatgatttttaacaatttaaatgtagaaacttatgttctattttctagagttttgattttagacaaaaaggcatttgtataaagaatcctttagagtgtttatacagagctctatgtttagtatttttcttacaaatctcaatcccctggagtcatggggcactcagagcccagggactcaagttcaccattagtttaatggttttgacctctgctctaaagtggatttgtacagagagtcatgccttgcatgtcccagagtcattagcttggcatgaaatggttctactgcttatgttgcagtataattgtttctgagttgggcttctgtaaaatgattatgtctactcgaagacctgaagaatttaagagcaatctgctcatggggtgtcagtatttgagggctggcaactggataatcttatgtgtaagatagaacctaactttctctactcatttagttacctagggtactggctcacttaaagatttgagaggcatctcttttcaagattagtatttcccaccatggctatggaaacagttctctatgtcggccaagccagctctgagcaatcttctgggaacttaatattgtttattattgaatattttgttcattaatttggggtcctaagtatgtctcagctttttgatataatgtctccaatagtgatatttattttaactcatatgctagaagccaaagcttcattaatttgacaatgatttgctacatggttaacaggccaggtgtctagaataaaaaatctgcatcaaataacttttgaatgacaaggtgaccatattctggccaaagggaagacttaaattgaataaataaatgttgtagtatattagaaagtggtaaatgccatgaaggaaataaatgggagtaggaagtttaagggttggtagatattgcaatattaaatatggtagtcagggaggatgttattgattatgtgacatttgaacaaaaacttaaaggagctgaggaaagagcattccaggcagagatgagagcaaggatgaggccttttaaactgacttatttgaggaacagcaaagaggccaacttgtgttactagtgatagagaatgaggagatcctgataggagatgcggccagagaagctgagttctggggtgggaatagggtgaggggagcagaagagagtaagtcctgactaggagcaacacctgaattttgtggcatcctggaggccaggcagagaaaatgtgtggaggagggagtgatggactatgccaaaagatgctggtgggtcacacgaggtgcagtctgagaactgaccactgggtttagatttgcattgagtaagtgtagtgggatcaagagtgaatgggaggagagaaagtaaagattatttttttaagagaagttttgctgcagtaaggtggtacaaatcagaagcaaagttgagagagctcttttacttttaagaagggagaaatcatgtgatgtttgtatgctgatgagaataatccaggggagagggaaaaattgatacaggagtgagaggagagaattgatgaaggttagagaggagggatctgatgcatgagaagagagattggccttaaatacaagcacggccagtgtatccatgaggagggcaaatcaatgggcatggacgctggtagatgggtaagtatagagatgggaccatgtggactcttctaattgctggtaggtgggtaaatatagagataggggcatgtggactcttctaaagctttcttagcacaacaaggaataagagcatcatctgggagcaggaatgagagaggactttgaggagagaggagaagtaattgtgagagaagggaaatgaatggggcaaggggtgttattgtgattgctcagcagcattttggtggtcatgtctacgaaggacttaaagacaggtaagaattgaggtgtgagaggtaaccaggggtcagatgtactagagccttttgggctgtggtcatgactttggatttcattctgagtgagatgggcagctgttggagaatttgagcagtggagtgacactatctgacttaggttctaaaaggatcactttgaccactctgtgcagaatattttgcaggagcagaagcaggaccaaaactagttcagcagtctaagagaaagatgatggtggctccagctaaggtgcaagtggtgaaggggagaaaaagagctggatttgagataaattttgaaggcagagctgacaggaattgtcaattaaaagaagagtgtgagaaagaggcattaaggatgagtttaagatctaatcttgagcaatgcataaatactagtgctaattagatatcagatttctcagtccccaatacacctataagatcagcacaaactgagctggcattcttagccatgtagcaaaatgatccccatgtagactgaggcagtagtctccttcaggttaatgttgctaatagcctcatatttcagacacaaaggaagcaggttttggcatgaacatggtatgcaggaggtttaagatgtgtagtttttcaaagtattttagcatattttcttttaattttataattccaagatatattaagtagataccaatttaacctaccttctggaaatttcttctttcaaaaaatgacagaatttagttaatagtctggcactcgttagagttttcccaacaataaaacaaagtgtatttattttaatgggaagttctgctctgtccattcagtattttaatgttttcactttttccttctttaaaacttaaaactataaaagtctgaaaaatgaatatgccatcaactttaaaaataaagatgacactttgctccttccttcttaaagaacagcttgtctcaattttcccaatctctgttttcttgaaattttactttctgactgggccaatctggctacatatcctcttgctacttcattctcttttatcagcaaactttcaggatcactaaagaataagtagtgtctttgcttccatccccttacacttagagactttcagagtttctgtaatagctcgctacacagagaaaggcaaacaaaaggatgctagaacattttcccaaaaagtgcagtttagttcttttcttcattgtgtttgcaaatgattgcactgggactgagggaggaaatgaatgtattgcataggaatctttgttctgtggtttggggagatcaagaccaatactacctggatattttattaacatcttcaatttgtttctttgagtcttcttccctctcagcagaatgaatgattaatttcaggtaaaaagaagcaaggtttttattgcctttccccataatctgactttcagagtggacttgatggctccaattattggtgctttaaattgtaaacagttgtcaggtttgtggataggtggatcaggaacagccacttgttatttcagagataaaggcaatgtagtgcaaaagctgagagcttgggatctggagtctgatagattctagtgtcacggctctctagctggctaggccacttacaatttctctggggctcaatttactcatctggaaaatagggatgataatgtttattttgtagagttgttaagattgaaataagtaatgtatcttaagcaattaccacagtgccctgcacataataaacactcaataattggtagctatttttactttttattttataaatttgtaatataaggagtatgattttaataattgcattattacatattatatgtattggtgtatatatgtcttattatattacatatacatatatacgtgtgtgtatatatatttatatatgattcagatttaaaaaaatagtgttttactttctctaagcacccccaaaggattacaccagtgattctcaaaatacagtctccagaccaatggcatcagcatcacctggaaacttattagaaattcaactcttgtaaccccatttcagaccaactgaattagaaactttaggggtggggtttcataatctgcattttaatgagtctttctagtaaccctgatgcactgtgaagcttgagaaacactagaagaggctatgttctcatcccagaataatgactttcaaactaaaacatccttgtggttaggtggctcatgcctataatcccaacactttgggaggccacggtagggggatcacttgaggccaggagttcaagacccagttgggtaatatagcaagatcctgtttctacaaaaaattttaaaaattagagaagcatggtggctcatgcctgtagacccaactacttgggagtatgaggcgggagcatcactgaacaccaggagttgaaggctgcagtgagttatgattgagccactgtacttgagcctgggggtgacagggcaagacccattcttgctttagttactgtcttgtttcatgtagtaaattctaagcgacctgtaaatgctgaagtgaaatcaaatggtaatattaaaaacacaaactctttgtttaataaatgtctactgagtgcttactaggtgcaaggcattgtgttaagatgctttaatgcacacctagtatcattgtgtttggcacagtggctctccattcttttctgtttgcttgtcaatctttctgtacactgctttacttactactgccttatagtagctttggtatgtgatggaacaagttccttttctttaatctccttgtccacttttgatcatttattcatctgaataaaattcagattaagcctgttaattttcatgacaagctataatattcactgggaatgttttgtagatcagtttagggaaaatacaaatttgtagatcagtttagggaaaaattgatatcttcatgatattttcatgatattttaagccttctggtaaatgaatgtgatgtatctttccatttacttgagtattcctttacatttttcattaaaggtatataatttcatactttcaagtaatatactactttagatttattcccaagaaccttacagatttaaaaaattccatttattattgaatagatattttaatttgtcattcactttctaattgtttgtttcttgtgtatggaaatgtcatcgatctattttttattaattgatcctgtactctgcaattttacagaattctcttattagttctaaaagtttgtaattttcaaaatattttctgtggacaataagttctacaattaatgacagttttgaatcgctctttatttttctcttattgttatttcttgtcttattgagttgggaaagacctccagttagaagttgaacagttttgtaaataacaggtgtcttcattgtgtttctgactttaaagcagatgcttccatcattgatagcaaagtaggaggtttactttatatatatatacttttcctagttaaaagaagtttctttactcttcctagttggttaaaactctgtattataagaggatgttgagctttttatcacataatatggtattatttgagattttttctgtataaatacagtatttacatttataggttttacatctattaaattatccttacactcctgtttaaaacttgcttgactgctaatattatatgtaagattttaccatctatgcttatacaagtgattgagcttataatttcactttctgttgctgttttttgttcagttttgatattaaaattttgctggcctcatgaaaggaagtagagaactttcctatcttttggtctctgcaatagtttgaaaaagaaaaaggctatttaattcttaaagttctggtaaaatatgcctataagcctgtctggtcttcatgctttggtgcttctttatgggcaaggtgatttttttgtctgtttctttctttcttaaattactgagttactttccctttaggttttctacttcttcttgagttagttttgggaaattgtaatatttttccaggaaactttccatgatctttaagttcttacatatttactggcaagtttgttaatggtattctcttacagtttgccaaatatttactgctacaatgtgaatgtttgtgtccaaaactcctatgttgaaaccaaatccacagtgctatagaataagaagtggggcctttaggaggtgattaggtcactagggcagaatcctcctgaatggaattagtgctcttataaaagagatggaagggagcttcttagcccttctaccatatgagggcacagcaagaagatgccatatgtaaagcagaaagcagtctttaccagacactaaatctgcaggcaccttgatgctggacttcccagtctccagaactgtaagcaacaaatttttgtttataaattgcccagtttatggtattttgtcacagcagcctgaatagactaaaacatttactatatctatacttagtctctcttcatttctaatattgtttattttgcacacacactctctctttcttctactctcttttaccaaagacttatctattcaaagaaagagcaattttgttgatactgtcttttctttctcttctgtttaattaatttcctcttttaccacattttattccttttccctcctctgagtttctttctttcttttttttttttttttttttgagacagggtctcattctatcacccaggctggagtgcagtggtgcaattacagctcactgcagccttgacctccttgggctcagatgatcctcccacctcagcctccagagtaactgggattacaggtgtgcatcaccgtgccttgctaatttttgtatgttttgtagagatgagcttttgccatgttgcccaggctggtctcaaactccaggggttaagtgatctgcccaccttggcttcccaaagtgctgggattacaggtgttagccaacacacacagctcttactctgtagtttttaaaataatgttttgagttaaatgtagtaattaataatttacaaatttctgttcctaatctgatattaagtctataccttttcctgtttagctgcatatgaatacaaatgcttccattgtttaattataaatattttatatttcttattacaattcttctttgacccttgaattatctagaagtattttttagtttttaaatatacgaattaaaaattttaattgattccttattttcttggagactgtggtctatatgatgtcatttgtttggcatttgttgagaccactttaatttacttcaaagatattttaaaaattgttttgtgtgtagttaaaatgaatgacattctgtatgtgatacacgttcttatattgagcttgtttattctattgtttgaatcttttatatctttacttatttcctcctcacttgttttgggaacattaaaatctttcactatagttgtaatgtgtcaggttctctttataactcatcaatttatgatttatatattttcaagttatcttcttaaaagaatataaccaagtgtatatagggatgggtataacagtagatcataaggatttgagggatgtcaaataccagagataaagacaaagaagagctggagaagaaaggcttttttgcaaactctaagctgaaagtggagacaaaagaagtgccaggtatgtctgccaactccgtggcagacagactcacaccgcgggctgtatgctggataaggaacgaatgcagaagacggggtccaagatgaagtcagctggatgtaactcacagctgactgctttgaattgctgccatacctgtgtgtttgtttgaaagtggctagacttgaggttgctacctgacacttagtcctggcaggaaagaattcttttttgtggactaaaacatatcagagcaacttctaacatttaattaatctccacccacacttttattttggaaggatgtttctgactcttgtatacttctttttccaatctaagaatcacatttcatattgccccttttgctttatggaggcatgaattattccaattgtcttacttaactggcttttattgtctggaggaaactttagtgagttcaatttacctggtagcctattttgtttctggtagacttcaacactgagcagaaatactcctattacagcacttagtttatctgtagatgaaaacctttgcgttttaaataaaacactcagctagaggggtcaggtttggctctgtttctcttcataggtgcttctaaaaacatttgccaagtctgaagtcctggacttagacatcttggaggaacactaagggtagagatgcttttcattgaatgtgaaaaatagcatttttgctgaagactattttgttcagttgctgcaaagtaatttatcttggggagcagagaccaagtctgagagtcggagacattcaagaccaaaaggaagctagagccttttttttttttttaaaaaaaaaaagaccgtatatttataagcaatcaacaaaagagagtttttgatgaaaattattctttaaccctgacagtgacattttcttcagtaaaagacgcagctgtctcataaacataaaaaatatataaaccctcttcattctttcattactttcaggtctcttgattttgggtgaagaaagtaagcaaagtttatggtgaggtttttagtaaattactcagatgattcaagattctaaccttccccagctccatgcaaacatttatctcttttatttagtttatgcaaattaaagggacccctggggatgtgtgctgaatactctatataattgcacagttttaaatttcagtttcctagtatagatctggtatctaagatggtgtgacatttttagtttccaaaaaccttacaacagggttcacaaattctgaagttgagtcttagtgttttcctcttgggtcattttacacaattaaattatactgcttcaagttctgcatgataattcccacaccagatctcttccatgaatatccactcctttttcacattcaaaaatgtagaatcaaaatagccaaattaagcagcagataatctgaaaattaattgtttcaggggaggaaagaacaagagtccgattagcattcatttgaaagaaaacactttattgaggtataattgacatgtgaaaagcttgtagtcctagcactctgggaggccgaggtgggaagatcacttgaggccaggagtttaagaccagcctgggcaacatagcgaggccccatctcaaataataaaaattttttaaaaagctgtatatatttaatgtgtacaattcgataagcctgggcataagtatacactcatgaaatcatcctcaccatcatggccatggacatattcatcacctcccaaagtcttctcctgtccctttatgtttatcatcattatcttttggtaagaatgcctaacataggatctagcctcttagaaagttttaagtatatgatacagcattgttagccataggtactatgttgtatagtaatctccaaacttattgcataactgaaattttgtacgctctgaccatcccttccccatttccccccactctctggctcttggcaaccactactttactctctgcttctgtaagtttgaatatttcacattccacataaaagtgagatcatacagtatttgtctgtgtttggctatgtcatttatcataatgtcctttaggtctatccatgttgtcccaagggcagaattacctttttttttttttttttttttttttttttaggctgaataccattccattatatgtatatatcacattttctttatccactcatttgtcagtagatatttaggttgattccatattttggctattgtgactaatgctgcaatgagaatgagagtgctaatagctcttcaagattctgatttcaattcctttggataaatatccagaagtgggattgctggatcatatagtagttctatttttcattttttgaagaacctccatatgaagcaggatatttccctgacccgtttgtgggactcagaaagggagtgccttgtctactcagcctgcccgctttcagctcctcaaggaagggagcatgcaagcaaatgaggagggaactggagtgcacaagtgctggaactggctgaccgtttcggtactggcgggaacaagctccactcactgggatcagctgcaatccacccctcgcagggctggattcttctctgaagttacaccgtcaagctgtccctctgaagtcaagctacttctctctgatgtccagctgcagtcgttccattgtccagctgcttctctctgctggctgagtctggggtctttataagcataggatggggtcgggtggggccatgggtggtttaggaaaaggcaacattcaagcaggaaaacagggacgtacattctcactttaggctgcgggtttcaggctttttgctcttggcccagtcctttaaaaaactttttgcactttggtttcctcatctataagatggacagaaacacccacttcataggtttgctgtagttattaagaggataataactatagaagtggagaatggtaggtggcagctattactgaattaacgagtcagatgttttgctatgagaaggtcctgttttttttttaacatgctatagactttcaataaatgaaaatttttattatttcctaagaaatgcacactgatagtaaaaaaaatgtaggaactcaaacaaataaaacacctttaattctataactgagagagaacttaactgagatttttgtctattctctatatttttctatgtatacacatattatttaaaatggaatgctgtacattgttgttctgtaagtgcctttttattcagtaatgtttacattttctattttgccatagtgttgctattatgcttgcaaatggatgcttatgcccacagatgcttgaaaccattagaaataaaccaggtccttggcatagggttttgaatgactcaaggatttgctgttgtatagatgataatttgctgtttctttgtggataaggcttattcttcttatgttacacagagtggaataaggacaatgatgcaaaaaagagccattctcggagggagtcagtcaggggcaagctcagcgtgtcaggagacaccagggaggcccaggtgggaacctctcatgcttgcactgcgaaggggagccaatgccaaatggagtcctggggccaggacagaagtgaaccctagacttgtgagagctgaatatacaaatggatgacggctggaccccacataaaaatagaactctgacccacagcctgcagcaacctgcctaaaaaaccaatcctcttatctacaatgaaaagcccaggtagccagcctgctagaagtcagacttgcaggaaaccagattgttatctttagtcatgatccaagaagctaaacaataacttctataacaatcagccccgaatggccaggatgtgattaataattggcagcttccctaatttttatcctgacttccaacttggaccaatcagagaaagctaactatgccccctaaccaatcccatagaatgccaggcttctggttagctcacctacagcttcctcaggcacagccccaggtatggcctgattggagcctgtcagcataaggaagtgggaatggactctcccttttttccactctaaatctttctcactctcctgccctcttttgagtctctgccaaaatgtaaatgatggcagctgactcccttgttatggcaagctctgaataaacagcctttgcttttctcatctggttggtcttaatttatgtccatacttgcttgaagcccaggtagaatggctcatgtgtagccattgtcagacagggccctttgtttttaatggaacttgacttggtctctttgtgaggtgcaggcactggacggcaaggatcataacttactcatctcagtaatctaagtgtccagcacttgccttgctcataataaagattgttgaaataagctggaaagaagtcttatgcacaaagtttaggccttttcttgtccaatatggaaccaggaaagcccaatgtgactagtgtgtcttgtttcaatagaaggaaatgtcaccacgaattccagtgtaaatgcaaaacaaactggaattgacttgggggtaggggagcttagcagtctgcatttcgctaactctctagagaacccctttaaaatctttttggcaaaactttccctttttttgtttaacacctccctctaatctaaacccatgtggattttgagggaaatttaattaaaaatgatttttttcttttgctaaatagaagcaggtactattcagacagtgaaggaaatcatgactgggttgtttttgcttgtttgtcatcctgtttcccaggaagataatggaaatgatatgtggccagttaatcatcagtgaggtggagtttccatgaggcttctgcagggttgtaactacaccagaaccttcaccagaagccccactcctcaattacgggctatttcagttctaggttcctcactgcggaacagaaatatctgcccagagttagcattaggacctagcaaactacacctggtccatagattgccctgacctagtgtgttctttcagaggattgtccacattcaaacactgaagcaattttattttgtagctaagacttcttaatgtgtgggaacaaagttcaaaggtgggtagctctggaggaattcgttctcagaactcccatgcagattgcagagctgtaatggtattatttattgtgccaagcatcttttcagaacctgccactagactgtaagctccacaagggcagggactgtgctgttttatttatttctgtgtttcctgcacccggcatagagtagcacaatagaattttgttcaggttgggcgcagtggctcatgcctataatctcaacactttgggaggctgaggctggaggatcttgagcccaggagttcaagaccagcctgggcaacatagtgagaccatgtctctacaaaaacaaaaaaaaagtaattgagtgcagtggtgcatgcctgtagttacagctacttgggaggctgaggtgaaaggatcacttgagcccgggtgttcaagcttgcagttagctatgatcataccattgtactccagcctgggcaacagagcaaaacctcatcgcaaaaaaaaaaaaaaaaaaaaaaaaaagagttttgttcaatgtgtggtgggaacttggaattcagagtcacatgatggaaggtacaaacacagcattatagtaatgagactgaaagcaagactgtattgtgaaatacataaaaacatcaatactacagcaactgtccttgcagggagaaagctattttgactaggtatttattaacaaatagatgattttctactatcctctctaatagagcccttgatgagccaggaagtcctgcccaatgagtaatctgattgtctcattggaagagaagttaccctatattggcttgtgaatagggcatatagtaaagccacataatgaactcagacccccagtgggaggaaaatgatcccatgtcccctgatggatggaaggggaagaataatgctttttcttaaattttgctgcctgattactatacaggggaagttcactcaacttggttgtaacctaccctcctgagaagcctaatgtacacagctccaccaactatgtgccatctatttgtacaaccaaacccttgctatatttgtcaccttagttttcccatatgccttccaggtgtcttggtgggtggtggggagaagggattacaaagatgtgtcttttagtcaagaacttatgtgatgggcatgaggggttgtcattcaacatccatttcaaccttcttctgctgggcctttctataatgcagaggtttaaaagctaaaaactggatttcccggagtcctctgcagtcagagttgtggatgtggtttagatgcattcttatttggaaggcaaagggaagcagaggcattgcttcccgtattgtgctgtggttgcattgctatgaagaaatacctgagactgggtaatttataaagaaaagaggtttaattgactcactgcaataaagttctgcaaactttataggaggcatggtgctttcatctgctcagcttctggggaggcctcagggatcttacaatcatagcagaaggcaaagctggagcaggcatgtcacatggtgaagcagcagcaagccaagggagtggggaagatgccacacacttttaagtggtcagaactgtgaactcagagcgagtgctcacttatcaccgggaggatggcccaagccattcatgagggatctgcccccatgttgcaaacacctctcactaggccccacctccaacatcggtggttagaattccacatgagatttgggtgggaacaaatattcaaactgcatcacttcccctggcaaggatggttgaggaagcatgtggtttctctgtagcagtattagcaaaggccccactgcctggccattagccatgtgtgtggactgggaatggatgtgggaaggcagggagcagggcacccttgttgctggcacagatcatctcacaactggtggagtcctggagccggcagccacaatcggggcttgcccaagcctattatcatggcagtgggtgtgtttgtagctcagcttcccaatcagcaggcagcaactttggaggcctggttctgttgtgtgacttgtaagttgtttccagaagaacctagagtttgtttctttagccctcccaatgttctataagccatttagtatattgtaataaatccctttctgcttaagttagccagattgaattcttttctttgcagtaaaaccctgacccccacagcttgccaatgtggggctgaatcaaactttctgagttaggtattagagggtttccctccccagttactattgccttggttttagacaattatttgcaaaactgctgatgtgttacttttgattcctgaattccagctattgtgttttttccactatagtctagtaagtggtaagcaattagaaattcacgattttgcattttattatgtttaataacatgttgaacctgtaacatattaaattctatgttcagaaaactgttgagcctgctaacttatccatcagggcctgggtttaggatggtcttgtctgttgtgttaataagccattgctcctgggtatctcagtgatctccggatgacatgtaatataaaattgacggcaataattgttataataaagcattatatttgtaccctcttttatggtgtttgaaaacatgatctcttatgtcagaggtaagggaaagtgttatagaggagaaaattgagattcagagacatacgataatttgttgaaagtcatgaagttagttaataaatagcagagccagatcagaaaatcttatctttgacaacaagaaaagcaactgaatgatgtaacacatttcttctactaaccagccaacaataggctaagatatttagtggagccagctctccttttaaaaacctctgctgaagaaggttcatcagatggtgcaaaaaaataagcagtgcctttggagttacaaatttctttgcaaaggctggtggtgttgacaggagaggagttgtggggtgaaggcagagaaacaggattcaagctgaagcgattccttgcaacatctgttagtgctgaggcaagcttgggttactgctttattccacaaaacaaggatgtgaaaagcagccctaggaaaagacattaggatgggctgaggcagtggaggaggatggcatagggttacttgtgggaaggagagcagatgacctgctgggccgaacatttcagttaacacttttctgggttattgttcttgctattaaaatctattactaaagagtccttcaaaagaatggttatgggtttgaaacagaaagagaatgaagcactcttttccaccagatatctctttggtccttatagctaagactttcctggacttagttttcccttttttggtacataaggaggtttccttttgctgtggaaggatttacatgtagccaaatgtttcatgggcctatctgtaatgtgctttaaagccttttctgaaagtgaaatttatttaaaggaaaagctgtttcctactagttggaacgacatctagaagtatgattcatgcagctggtcccaagcgcctcgagagtagacttgccacagagcaagcctaaagatgttaacctttataatgccatgatttgtcttctgtggccctgccaccaggaacctaagtatttccagtgccttctgttgttttgcaaagcaactgattgataatagtaactaaggcctgttggagtgctgcaaactatcatcataggagggaaattgatggttggaagagtgaggtggttaaggctccctgttccaggggctggcctcagaaaccaatgactggtccgtgtatggaatcaggtctggaaaggagccgtggccatatcctcacatcataaaaatttggacgggctttgcacacggacagacctgggtttgagtcacttcactagctttttgatactgggcaaattatttaatgtttgtctcagcctagatttcctcatttgtataataaggatgataccatcaaagggctgttgtgaacactagaaaaaattattttaaggcttgaacaataatgcctggcacatggtagatgctcaacaaatggcaaacgactgttgtgattatgctcatgcttgtttgctcgtcattttcttaaccagtgctaagtttttcttgaggggccccttctattcacctcttttcttccctctgtctctatttctgttatgagcatgaagtttacatgcagtgtttctatttctgtatctcaaaacccttgtatgaaaaaaaattatcctcaaaatagccttgcaaaataggcagtcagcagggttagtgtccttatttcagaagtgggaataatgaggctaagagaaaaaaagagttagagaaagactaaataaaatagaagccctaatctggggttatgggctttaaatccctgaaaacgaatgcaaaaaaaatttttggtgcattttgattgcaagaaggtctatagcgttcatcagattctcagaggtctcgggatccctccaaaaaggttaagaagcactgtggataaagaccttctagactagagagctatctgaagggagttcatggtttctgctttcctgtaggcagaatagtagtagtgcactttgctggtgtatcatttccatcagtatcgcctctgggccactttgaaaatgtagatccctaggccccagcccagacctacagaatcagagtgtcaagaactggagctggggtatctggcatttgaacgagttctccaggtgatttttatggccactcaagtttggcagtccactggtgtggcagtaaaagctgcctttggaaacagatcaccaggttaagagcctccccttccacctatgggaacttgagctattacttcagtttcttcacctgcaaaatggggagaataatcatgactccttcataaaacatttgcgaatattaaataaggtactgtctgcccagtgtttaactagtggcttaatatgataaatactcaaatgttagctgaactgataataataattatgagtgttattattatcagtactatcattagagagattggagcaaattgaaggctctgactctctctgggaaattaatgtttgaccatttattaatacttcagccacttttgagagccgtctggctcacctgcaatatctgtcagcatcaatcctaaactgtgaagactgatgagatgaacacattagccatattacagatgatgggcaatttcattttcttttttcttcttagttgtgaatttttctgccatgaacatgtatgaccaaaacaaacacacacacacacacacacgtacacacaaacaaatccacttctagtttttcaaaaaggagtattttactcatgattgactgaaaaataattcagagtttattatctgtgacattgcagtaaattttttagttaacgaatcaggaatttgaccccccatattacattgtttgaaaaaataggcattacttacaagggcttaaaggggctttttcagggagtgaagcacatttcagtagaaagcctgtctgggggagcatgacattattgttgcagaaattagaattctagaggttgttgcctgattttgaaatagttgcctgtctttatgaaagactgaaaaattcatttgagagttttcttctcaaacagcttccaaagtgactgagaaactctcacaaatataagatatatgtgagaatgcatattcagaagggtgaactgtacttttcagatatgttgggcctatttgaaaaaaacaaaaggcagtttaaaaaacctggcatatataatacataattgtttggaataatttcacacacacatgtgtacatacatacatagcatatgtgtaaacattttcaactgtattaaactatagatttaaaatcacacagttcaagtcaagaccagaagccaggccaaaagaaaaacaacaaagtatagctaatgaaacacagtattaataatgcaataataaagagctaatccttgggattagttctggctgctattttttaaaatgagttgccaaggagagggatgagtagcaaagtcatctggtgaccagaaactactcaggaaaaaagatatgcaacaaaggacaaaaaaactcaagaacataggctaatgacgagaagcaacatgaaattcacaagtcccagaaggaatattttaaggaaacacaactgtgaggtggaatttaaagtttgtggtaactgatgaggaaaaataaaagtcaattgacaacagagaaccatctgctgagaaaaggctcggttgctttttcctctttcatcttcttttgaataactcatggtcttcgggttgccctccagcctccttgtccactgtggctcttggctttatgcccttggctagatcttgcggctgcttgaactcattccccaaatcctactttggcactgtgagtttgtgtgtgattgccagacactgttatggctccattccattcctgggacagctcagcaatgtgattgggtagggaaaaaacacctggagggtggcacagaggtgtcagggtggcttgggcccatgagctggtgggtcagtgtgggccagttgcataagaggatagagcccctgcctcttccattcacttcctcatgcagacccaggggttaaaactaccatgggttttttttaacaagcggaaaaatacctgagtgaagtttgtaaccaagctgtgttggtccattctcaacggagaagaaaatggcctaattggaagcccaggttatctgtgttcttcctatctaatgtcaatcaccagaatgcctgctctgcttttacttaagggaatcccctttgtttcatgtgtgtccaaagtcctccgagaccgctccttccaatctctaaaggttagttcagcagctacagccaatcttaacatggtggtccattctctactcttgatttcctttcctgttctgttttctagccccaaaccttcaggaataggactggacagtggcttcattgccgtaatcaggtaaacctagggaaagaaagttgcatctgcatgtcagccttattctcttacgtttccatctctgtgtttctgttctgaatctctgtctcacacacatacacctttatgatttctgtgttgcacatttactctgtctttgctttctcatcactgttatggtcttccttctgtattttacacataatgctcccaactgtcattattttctttgtaatgatagtaattttcattatgggtcctattcctatggtcatcttctttcatttcctcaatcctttttcaactttgctgaaatctgttgataataactccttccaccctagggataataattcccccttacactttatatgaagaataggatgaattcaaaagggagagtgccttcccttctgaatctggtgcctgtgggtgcctttgccttttttaaccctctcgctatggaatgacattccactgttctgggtacccagcaggtgacatagtacctttggtctgaagattgggcttagctgattggtacacattgtcgctaccctgttagttcttgaatgggttacaaacttcattgaaaaaaaaatggaagttgtgtaagaaatattttcaagcatgaattttctgtcgacatactctctttcgtcacggtcaactcaaaagtcttcatgggacatgatgagctgagctggcagcaaaggaaggagtggccaagagctccctgtgtccaggctcctgactcaacatctctggtcatcaagctggctttccaggcatagaaataggcacgagagttttccactgaacttgactaaatcaaatgaggaaatacatgaaggtgttggtttctagcacttaacttttcctgtggctgggctaataggcaaagccagggactatttcaaactggagtttctgcagcccagcagcattgcatgaataaaagtaacagttacaagttggcagtttaattcaggggcaatcaatctaccatctcaagggattgctttggggaagtggaaccaagagtaggaaagaagtttatgggttaagattttggtcttctttcaggtatgctattaatgtgccctgtgactgggtccatgccccagtcctattttcctggctttatggaagatgccacaacatcagctgagctgatataagaatttcctaactcatgtaagatgatttataaccctcagattaataagtagtagcatgtgatcatctcacattgttgtatgctagccatctctgacataatgtactgtcatctatcagctcttagcaattattaacagaatgtgactgtatttattttatgtgtataactcttgttgacattatctgcattgtcttgtgcatattttaactcatatattttctttgaagtacttctccaaaaaattatttgctttgggtatttctctttgattttatctatggtttttcctcttctttccaagtgttcttctttttctcaaatgttccttcactgtctttatcatcctagaattttattttagtcttgggatttattgaacttcttctccaatatttcattagcatctcatccatggtttctcagaattccttcacatggttcagccattttgatacttcttaaaacttttaaacctttgattaaataaatacttgctccaaaacacataaaaattctttgactgggattaaaacaacttttcagaaaggaatacaattcttataaacacgtttatgtgtcatattaagttcaaaatagatgtgttcctacacattatagaaagtctaagtttaattttttaaaggttgagtaaatacacacttgaaaatgcctacaattttttttgcctacaattcttataaacagttcctaactacctgtcaacagtcagtgtcaacatttataagttaacaaaacaacatgctttgacagagtcactaaatccttgtctgtttatttctggaatgatcatgtgaaagtcatgtccagctgaaccttagaaaaacatacaaattttacatagaatagaacacatagaaaatagaggtttcaacagtggatctgtctagagggcgtagggcctttatccatgtgcaaacaggccagttttcacctcttagggccagtcctatgctttagagatagtggtgctaattaaagcatttgttgccagagtatttttactaaacgctgcctatgaatcaactgagaccttgtgtccaccaataataatgataataaaaaatgccagtatttaaaaagcgtggcacagccactgaccaagtgacagctgatgacacaccctaccaccctgaggggggagggatgatggcattatttcacattgactcagaaggcaatggattcttccatgtacctacagggtcaaatgttgtccattggttccaagcccttgtctttctttgacatacatttctgctttgggtaaatctaattctggtaaattgattgcatcagtggccccagttaaaggcctccctatattcttacctttgcagtgtgattttgttgcccctccagttgagaatctgttctttacctttttggatgtggctggcctgtggttcgccttagctaacagaatgcaatggaagtgatgggggtgggggtcatttctaagcctaggccttaaggggccttgggtacatccaccttgtcttttggaaccctaccataagaacaagcctgggctagcctgctggaggatgagagaccacacagaacagaaacaagtcatctcagctgaggccaacccagaccagccagtctctggcctaccagcttactgcagacacataagggagcagtggaatgaagtgtagtagtgaggatgtagtctttggagctagacagacttagaattgagtcctagtgctatcactgcatagtgaaatgatttcaggcaaattcattaacctctctggtttactttcctcatctgtaaaatggggatagtaacaatagccacatcactgggttgttctgagaattcaataagtaagtccatgtaaaatatgtagcacaatgactactattaataaatgatacactctaaaaacatgactaataattaataataatattgcagttgaagtattggcctagctcatggtggggcatacaattaaatgtgttgaaaactgtaaaaaaaaaaaaaaaaaaaagtccctttatactttgttgctctggaaggcagccccagtatctgggtggatattagaaactgatatatttaggaaaaatataagaaagagactcctaatagttagagctctccaatgacagagcaggcagctgagcaaaaataagagaactccttgtctcttgaagttttcaaacagtctggaagaccatctggcagagatattgccgaggagattcctatttgagtaggagttggaagaaataaattctaaggtctcttccagatctaataataaaattatattttatttacttaaaatatttaattggacttttttttttcttccccaaccagcatatttgtagcaagccaaaccacaaggcaaccaaatgacagggtggggtgagtgagagggcttatctctactcctcctaatctcatccttctggagtaacccttgttgacagcttggtttgtgttcttctggacttttctttacacacatacaaactaatgcaaacatacacatgcacaccattgccctccttcctccacggtgtttgctatttttttttaatgatcataagatcatactatatatgctgttcaataacttgatgttttcacttaatgtatcatgggtataactgattttaaggttcacatagacaaaaaagtgtgattgtaattctaagaccattttgaaaattgacttcttagatattaaacttattataaagctaattaatcataatagtatggcatcagcacaaaaaataaatcataatagagagtccaggagtaattacaaattcatatgggaatttgtcattttaaattggtaaggaaataattcctttccttcccatctgtgtagattcttaccatgcatcctatacaaagactattacataaaaataaaacaaatttaaggacttaaatataagacattaaccataatagaaggcaacctaggtcattctttttataaccttgaggtgaacttctaaacaagacaagaaacccagaagccaaggagattgacaaatttgacaatataaaaagaaataaataaagacttttgcttggaaaaagacacagtaaacaaagatgaaaaccaatcacgtaaggagaaaatatttttaatacatgtgacatcaatgacttaatgttcttatatatttttaagaactctacaaactgataagaaaaattaaaaactcatgtccagtttcaaattggacagcggatatcaacaggtagtagaagaggaaatcagacaggcaataaacacatgaaaaggtgcaaacgttaccaattgtgatggaaatgtgaattaaagcagaaataagctatcattttcatggattttatttgccagaatgtaaaagatttataacaagaagtaaaaagactgtggggaaaatagctctcataaattgctcttgggaatgtgaaatgtcctcttttaagaaagtacttatccagcagattaaagtgaaaaatttatcatgttctttgacccattctgccttttaagaatctctcctacatgaaaccagtagggtgtaaaaatatgtattcaaagatgcttattattgcattgtttgaagcagcaaaaagtagaaaaattatcaatgtttataatcagggcatagactgaataaataatgacacattatactgcagaatattagggagctaatttttaaagaaaagatattgatttggtgggacaatccaaatttaattgacatttttaaattataaaagtggcacatagttaatacagaaaatccggatagtaagtactaaaaaacttttaacttatgtttctcagagttagccctgttatgttttcattagctttctagttctgtgtgtatatgtgtatatgtgcacatatacacaatatatatgtgtatatgtgcatatatacacaatatatgtatttatatagttatatttattcatacttatatttgaatttttaaacaacataaaatggtaagcattttcttccattaaatgtacaaatttaaatagctgactaatggtctatgccaaggctgtagcataatttgtttttgtcagtggaaatcgaggtggtttactggttttggtgtttaaagtaatgcaatggatcactcatgcattgctggtgggaatgtaaaatggtatagctgctctggaaaacattttggtagcttcttaagaaaactaaatatgcactgccatacaatccagcaattgagctcttgggcatcctctgagagaaagaaaaactcatacttacacaaaaacatatacatgaatgttcacaacagctttatatgtaataaccccaaattggaagcaacctagatgcccttcaatgggtgaatgattaaactgtggtacatggcataccagggactattattcagcaataaaaaggaacgaactattgatacacacaacaacttggatggatcctcagggaattatatggagtataaaaagccaatctaaaagattgcatactgtatgagtccatgtacataacattcttgaaatgacaacattattgaaatgaagaccagattagtgattgccagggattactcagggagtgggggcaggaagggagtgggagtggctataaaagggcaccacgggggagcctatgatgatgggaatattctgcatcttgactgtatcaatgtcagtatcctgggtatatattgtatcgtagttttgtaagttatttccattagggaataatttgggaaagagtccataggatctctttgtattatttcatacaactgcatgtgaatctacaattatctgaaaatgagaagttaaaataaaaaccattaatgcaatgaacatttctatacacgtgaacatctgttttcctaggctgtattcctagaggtgacatttctgctggatattgtattaacactattgagacttttgaagcacattgtcaaaatgctttttaggaaggttcgtacagctcatacaagtctacgttttcgcataatgtaggcagttgctgcagtttttctaacattatagagttcttgcctttggagaagcactgttcaaagcactttacctctcatttaatctccccaaaaggcccatgatctagggtgttgctgctgtcactttaccgatgaggaaactgacactcagagaggctgaggagcccagctgaggtggcatgctagttagtggcacgattgagactcatactaggttcgtttaatgtcaaatccaatgtgctaaccactgtgctaccctatgcacttaattattagactacttgttagttgctaggtatgcaatctaaggattaagaggatactgtaaagagataggaaaaaattactgtttgaataatactggaaccttggaagacctatggtcttggtttgatacttctggaagcattattaactcaaatcagtctttccgttggtcctctcgctcttagggcctaagtcttcatactgttttctcccccaagaagttttcagcttgcttttaaaggatagcggtagggatggttgtctgttgctggtgcatttctcataaagacttagtcttaactttttaatctttgtgtctgtgacacatgtagttatgttcttaactcatttataggctaagtggaatgtaaaaataaggaagggtacattatccccagtgctgtgtgtactgcatttatgtgaggccgctcatcattaccctcataaatgtgccaaagctttcattcttcagttgttccaagtaggaagttaatcatctttattaagtgtttcccagagagtcttgttttaacaaagctgcttttttattgtatgatttttagatttcatttaatgtactgagttgagtcctccaggaaaatgacattttcatggtggtcctttgtttatgtaggaccgtatttcatccgaaactacttaatttggtctatttgcataatttcttaaagtatagctgataacatttaaattagaggttggtagtttttgtagtacagaaaaaaagtcagacagcaatttgttttgctagtcttttaggacttggagttttatatgattttatatcaaaaattgttgtcttgaattcaatttaaataaatgctgtagtaatctgggtcagttcataaaaattgggttagtttctgaatcattgttataattgtggctatgtaggttttaagtgagttggttactttgtatagcatgccgaactttcattcattcatttgtttaattcattttcttacacttcggcacattatttcacattctgtaactactctgagttattgccctctttttcataaaacaaagtcctgcgctttcccatctctctgtatgtgaaaatctgtaccatgtcttgctccctttttatggctcttttgtggaattttttccttttgggagagagtgaccctaaatgataaagataaaccatgaatgatttatgaaacagaataatatatcccatattttcccaaatccctctaacttctattggtttttttcttggactaccgctgcacattgagcatacatcttcatcgagctgtccagaaagacgcctagttctttttacaggtctggaagctctccatgtgttccgcagggccaacgttaaaaaggattgtaaattgccaagaaagcaaaaataaaaattcagatgtaatgaacatcttatgacagaggtgattgagttcttggaattgaaaagtaattggatctaattgtgaagcccaattgtttatagcaggaacatgtgtaggattgatgagtttggatggtctattccacactgaatctaagcaccgttagccccaaatgaccatgtgcataatgtgtgtttgttcaagtcatgcttcttattgggtaaagcagatgacagtcatactatcccagtgatgttgaggctctcccattagaagaggggctggagtaggagacccttgtgtggtggttctcaacattttcttaatgactttatgccattcacatgtgtaatgtgtgcccctcagtagttgctctcattccacttcagtgattttcaacaattgcaggggcagatggtggtgggagtggggtgaaccggggacattagcagaatgtcggggtatgtgctctaaaaataccctccaggaaatgatgagctaccatttctctcaatactgcctgcctcctcctgttgagaataactcatatgagaacatagcaagggttataaggaaatactgtgtttaattcctggtcaataaaaatggaaattttcaaataaatggaccttctacgtagaaaattataaattatcaagattgattctaaaagtaaaaaaaattatccacaaatagaatcatgaaaataattaatgtcaaagatttatacccaaaaggcttcaaaactatatagttctatggataaattctttttaactttcaaggaacaaattaatcccaatgatataagtaagctgttcctgtatgaccccgtatgataccaatattttatcaacaaaatgcatgtgcagactatcatatatagggaaaaaaacaacattcaaaacaaatactttaaatagttaaagtcacatatctgattggtgggattgggggttttatatttttctttacattttattttccaaattatattgaacatgaaatatttttattaatttatttttataattttatatacaaaatcaatgaatcattttttcttgaagagaagaaagtggttgtgaatacagtgaatggcaggtcacttgagcacagtgtggcaattctgtgacaaacgtccactttgcattggaaaggcctctttgtggagtatctgttgtcactgtcgtttataggacctttagattcccctaggccagtggccctccactctgcctggatgttagaatcatccaggaagctttaaaattatctccttggtactggtatacattttgaacgctctgcaggtgattctaaagtgcagtgtggtccagaaccattgtcagaggctcaccgtgtatgtcttagagagttctgacattttgactcatttcagcagcaaataaatgaagtggaagccatcggtccctttggcaggataagctgagaccagtgaaagctcatccctaccttcagtctgtctttttggccgtttgagtgtagggtgtccagtctgaatatctgtccttcactgagatgcaatttgggataatagctctccagtgaaaattactcagtatgaggctgttgtttacaagaacttttcagttcaactcttcttagggaacaagaggtttagtttggttcctagtgatgtgcaactccaagaatttccattacacctggcttggatgtcaattctgtttcttatcactcaataaaacaatttattaggaaaataaggtttaaaagtgccagatgacatatagtacagcccttgtaaatcatatatgtcctaaatcttgttggacagcaggagaggtaactcagatacgtctttccttagggctcctggctgggagcttggtcctgaggtctgcgctgggctaaagaatgagactatgcagatagttggaagcaaagcgggacggccttggacaacgtctgctggctccagtctgaagcctggcgtgggctgtgggcttgtcagctctgggtccactttgttattatcacaaataggaagcccagtctcttggcagtagccaaggatgaggggccaggtgggcttaaggaatgtgacacaaatactgctttattatgcacttcttggtttttccatcgaactttaaaggtggcagtattaaggataaatgatcaggcattgcatgggagcagaaacagttctgcctctcccgaacatctcctatgtcctgttatgcccccatacttctctggtgatttatcttttcaaatcgacagccctctggagcagtaggaaaatcattaccgtatctatctagcggcaggaacactgaaagctgtcataaagcccaagctttctcctttttgccctcatcatcctgtgaaccacagagattttgtagatacaagtattttccatcaagcttatgaataacaccacttggcagaggaccctgaacaaagaaccagactgcagtgttttgtagtgacttttacatacaatgtgccttaattactggcaagcctgtcaagaacttattcccacatgtgtcaacactttcttaatacactgtaattcatcatgttagcatggcagaaacaaggtactctacgtccttacacgcgcccttctccaagtgctggtcttgaactgcatatcccttcttgagtgtcttcatctggcgaacaaagaacaggttatagcattgaaatggtgaggtccctggagcccatcaaagtcgtccatcactgagtactttagcttgggctccggagcactctccatccaagaagcactgctttattgtcaaaaggacgttcacttagtaacagcagtaaatcgtgaaaggcagtctaattttaggcagaacacttggctaagagagaatcctatcatttacccctcgtgacaattttattcattgagttcattttcatgttagttgcatgattaaattaggatcggaatgtattgctttttaataaaaaaaaggagtgcctttctggttgggggaaagagggcaggaaggggaaaggaagtctaaataataaacactgcgtttcaattggaaatagagtgatttgacatgccacattatgctttctggatcatctcttaaccctttggctcttctgagtgaatttaaaaatgggctctgagcctgatggtttgggaaagaagtggtgaatctgagccctgtctcagagaaaaattggcatggggtcccaaagcaactttgcttttaatacttattcagattgcttatttcacttttgtatttcagttttatagctgaggagagggaagataaatttatctacctcaagtttcagattacatgagatatgcttcatatgatctcttgggtaatgcatgcattttagaaagttcagaaggaagggaccacagatctgggtgtgagaagcagaaaagttttctttctggtactgctgaagctttaaagaaagttctctctgagtgtctgtcttgcaatctgtaaaacctagtgtttgatggccattccttactctcagttattgaaatccatgagtagagttcatggcggcatcttggtcaacaagggagcggccacctgttttgtattaatcttttacatttcttctcatggtattttccaataattggaacaaattacatatggtagaactatgctaacagtgcttaaactttaatatttgtcaaatattgagtatgtattttaacaagcatgagaatgccatagtacaaacatatgaataataagcaatgccttccccatatagcaacaggctagttctctcttaatgaacacattcattatacaattatgatgatgccaaagcacatagggaagcatacgtctttctgttttctagagatttgcaatctaattgcactctgtaattcagttaagcaaaattctaccccatgttttcctctgtccttgactcttctttctgtttcgactaagttcaaaacagaacctattagtgctaatgagttcattcagttcagttcaaaacagtgctaataagttcattcattatcgcctatggtcagtgcctaaaccacgattgttgaataagtatattgaagttttgaacatgacgtgttaatttttggaaggtttttatgagttggttaataaaataatattaacaacagtggtgtgtgtatggttacgagccagtaggaggggtcctgacagtaagtactggggaggaaagggcttgcagaggaggagttgtcactggagttaggcctttcctgatgaaagggcttttcagagcagaagataaggacaattccaggaagagagaaaatcgacagacacaacatctctgacatctctgaaagaagctttttaactttctggagagacacagtgttaaaatatacatcaaataacttgataaaactgaatacatcattttttttctttccggtttgcttcctttgtgtattcatggaatacacacgtgtttcctttgtgtattcatggaaccaacatcctgtcagttttccaggttctaaatctcaaaggaaaatctctttgcttcttctctttcactctgtcacccgagtccaaatgtacatggaaaccctgttgatttcattctgtaatatttctccaagccctctgctcctctcaccactccgctgtccctgatctcagactgtcaatcactgtgatctcggcctccagtctttctgcctgattcattttacgcttagctgtcggattagggcttttttgaagcacgactcttatactcttctactcaaaaaccttcactgtttataggaaaaggtccaaattccctagtcaacatgcaagcgcctcttcatttggctgtatagtacttctgcactctgtaattcagttaagcaaaattctaccccatgtttttctctgtccttgactgttctttctgttttgactaagttcaaatcagaacttactagtgctaataagttcattcagttcagttcaaaacagtgctaataagttcattcatttttgtctatggccagtgcttaaactgtgattgttgaataagtatattgaaattttgaacatgatgtgttaatttttggaaggtttttatgggttggttaataaaataatattaacaagagttagagattaattatccctagaagtattactatccgtgtataagaacaatattttaaaaattttcttctatttgcctgaaatcaatggtcctattgattactagtaaatttagaaatcctttaaatcactttcttcctaataaaattagattatgataatcaaaagtcctgatacatgattatagccagcagggaaataggaggaagaagaagatcaatgtattagagtcaatgtatagtgtacaatatacagctaatatacctcacttaacactaataagataaatgcccacgttccatgatttaatacgataaaagctaatttcttgctacacaaagtccaatgcaggtcaggcaatcttctagagcaattcttctctaggcagagactctgggatccaggctccctccagcatatgatgtcaccctctcaacacagggatgctttggcataacagtgcttattttcacatatcactttcactcatatgttattgatcagaaccagtcacatggccctgcctactgcaaggcacctgagaagtacagaggagcatatggaacatttggtgagtcctactatctctgctttagaaaatagagttagtgagaagtatgatggtggaatcccaagtattaatacagaagatgatggtctgcctcttactagctctgtcaggttgtttgacccttctgtgcctcagtttatagatataactgcatatttttatgataatagtagctacttcataggtagagtttaaaatccctgcaaaacatttggaaggatgcctggattattttaagtttcacttgatgatagctattattattattaatatgagaaactaggaatgagagacaatggagaccactgaagtaaaattaatttgaaataaaattattaaaaataaggcttagtatgaaaactaaaggtctgttttggctttgataggcttcggtaaaacaatcacagtggccaaggggtctatcaggttattttcttgaggaattcagataaagaaatatagttattttattattattgtttttaaagtgctctttctgaaaattaggctcagaagaccagattttaaacttatggttactatagccttgtagtatagtttgaagtcaggtagcgtgatgcctccagttttgttcttttgttcttttggcttagggttgacttggcgatgcgggctcttttttggttccatatgaactttaaagtagttttttccaattctgtgaagaaagtcattggtagcttgatggggatggcattgaatctataaattaccttgggcagtatgagcattttcacgatattgattcttcctacccgtgagcatggaatgttcttccatttgtttgtatcctcttatttcattgagcagtggtttgtagttctccttgaagaggtccttctcatcccttgtaagttggattcctaggtattttattctctttggagcagttgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatacacaatcatgtcgtctgcaaacagggacaatttgacttcctcttttcctaattgaataccctttatttccttctcctgcctcattgccctggccagaacttcccacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagagttgttgaattttgtcaaaggccttttctgcatctattgagataatcatgtggtttttgtctttggttctgtttatatgctggattacgtttattgatttgcatatattgaaccagccttgcatcccagggatgaaacccacttgatcatggtggataagctttttgatgtgctgctggattcgttttgccagtattttattgaggatttttgcatcaatgttcatcaaggatattggtctaaaattctcttttttggttgtgtctctaccaggctttggtatcaggatgatgctggcctcataaaatgagttagggaggattccctctttttctattgattggaatagtttcagaaggaatggtaccagttcctccttgtacctctggtagaattcggctgtaaatccatctggtccagcatggtactggtaccaaaacagaaatatagatcaatggaacagaacagagccctcagaaataatgccatatatctacaactatctgatctttgacaaacctgagaaaaacaagcaatggggaagggattccctatttaataaatggtgctgggaaaactggctagccatatgtagaaagctgaaactggatcccttccttacacctgatacaaaaattaattcaagatggattaaagacttaaacgttagacctaaaaccataaaaaccctagaagaaaacctaggcattaccattcaggacataggcatgggcaaggacttcatgtctaaacaccaaaagcaatggcaacaaaagacaaaatggacaaatgggatctaatcaaactaaagagcttctgcacagcaaaagaaactaccatcagagtgaacaggcaacctacaaaatgggagaaaattttcgcaacctactcatactcatctgacaaagggctaatatccagaatctacaatgaactcaaacaaatttacaagaaaaaaacaaacaaccccatcaaaaagtgggcaaaggatatgaacagacacttctcaaaagaagacttttatgcagccaaaagacacatgaaaaaatgctcatcatcactggccatcagagaaatgcaaatcaaaaccacaatgagataccatctcacaccagttagaatggtgctcattaaaaagtcaggaaacaacaggtgctggagaggatgtggagaaataggaacacttttacactgttggtgggactgtaaactagttcaaccattgtggaagtcagtgtggcgattcctcagggatctaggactagaaataccatttgacccagccatcccattactgggtatatacccaaaggactataaatcatgctgctataaagacacatgctcacatatgtttattgcggcactattcacaatagcaaagacttggaaccatgccaaatgtccaacaatgacagactggattaagaaaatgtggcacatatacaccatggaatactatgcagccataaaaaatgatgagttcatgtcctttgtagggacatggatgaagctggaaaccatcattctcagcaaactatggcaaggacaaaaaaccaaacaccgcatattctcactcataggtgggaattgaacaatgagaacacatggacacaggaaggggaacatcacacaccagggcctgttgtggggtggggggaggggggagggatagcatgagacgatacacctaatgttaaatgacgagttaatgggtgcagcacaccagcatggcacatgtatacatatgtaactaacctgcacattgtacacatgtaccctaaaacttaaagtataataataataataataataataataataataaataaacttatggcgtggataaagaggattcagttaacaagaccagtcttttaattatgggatagtagaatgaactggagggtgatcctcagcttccctgcaatagaagatgataaaataattcatttatgaggaaacctacacctttggggttcacttgagccaaacagacaatggagcctgctggagcagttcagaatggtggtttcagcataccctctggagctgggctgtggactccaagtcctgactcagtctcttgccagttgtactgccttaatcctcctatgtctcaacttcactatctataaactgggtataataattatactcacccacccagtacagttgttgtgagaatgaaagacattaatttatttaaagcactttgaaaatgctagctccatagtgagtggtcattgattgctagctgttattattttctctctgaggacaatgaaaatgtaaaaatgatcaggagagtaggacagaaagtctggatgagaaatggtgaaaaatgtcagcggtgcacagcaaatgttgacagtgaggtatattaagctgtagaacagagtccccaaggacaagatgaaatctgctgtttgagtcatgtagggtcagacaaagtaccagagaataggccataggaagtgttctcatgcttgtaagtttagggacaagatgatctaataaggtatttttcaccttgaagttgtctgatgactgggttagaaagctggagaaactgacagattgttcttttcagggagggaactatgctaggcaagtctgtgtagatttagtcagaaatgtagttctgagtgcagtgtcaacatgcatcatcacttacagaggtaggagctcttcaggttccaaagtcaggtgcggaatgaaggcaaaacacctggctaatttgggccaaaatgctacaaaatgagggaaaggaagcctttgaatttaaattatctggaaaatgacttcaatttccaacataattttgtatgttataaacatttcttactgtagatattttggaaggcaagtgtgtggattaaggatcttttcatcagccttaataaagaaggtttgcaatgttttttatttcttggcattatttttaatgtctcacactaaatacagatgccaggtacatgttcagataagtagccttacttccaattttatttttccttagccaggagagggaaatttatgtgcattggtagaaataatgaaaaggaaatttagcatcctccaaaaagtcataacattatatgaggatacctagtttatatgagaatacctatatgaggatagtgtgtctttcaaaaagtatttttaatattatattatttatatttgaaaataaataacaactttcattttcttaatataagttacttaaagtaaacattgtcaaaattgggatggtataaagaagaggcaattattattattattattatttttgagacagagttttgctcttttgcccaggctggagtgcaatggcgtgatctcggctcactgcaacctctgccttccggtttcaagcaattctcctgcctcagcctcctgagtagctgggattacaggcacccaccaccacgcctggctaatttttgtatttttagtagagacagggtttcaccgtgttgttcaggctggtctcgagctcctgacctcgtgatccgaccacctcagcctcctaaaatgctgggattacaggcgtgagccaccgcgccggccaaggcaatgatttttaatggtttttgggaagcagattttataatatattaaaggaaggtgtgtgtgtgtgtgtgtgtgggtacgtaatacatacaaatatatccattcatcttttaataaactaggttcagcatctcaacatatgaagaccatactttttgcctaggataagctcagtttattctcataccaaggaaaagcagggcagtatagtagcaaagttacagggacagaaattcaaagagctgggttcctattcagctggggttttaattctgaaaccttgagccaatcacttcaactcagtgagcatgtcttctcatctgtgaaaggggaataataataacatccttttatgatccataggataacaatgtacatatataaatgtcaaaattttttcaattgtgaagtgctaacaaataaagatactataataccataactgccatacctgaacttaaagcagacagcaaagactcactgccaatataaacacacacacacacacacacacacacacacttgagtattgttcaagtacaccataattttttgcatttttggctaggctgttcaatatttattttacaaatgtttgtcctatcttcactttagaagagagggtgaccagaagtgcttaaatcaatggtgaaggaaagcacaataactatcttttttaacctagctttatccaactcccccctgcctgctagcatgcctgatctgcgcatgaatataaatataaagaattattttaactttttgttagcctcttctccagataaatgggaagttttttttcttcaacttttattttaagttccaaggtacatgtgtaggacatgcagttttgttacatgggtaaacgtgtgtcatgtggtttggtgcacagatcaacccatcacctaagtattaagcccagcatccattagctattcttcctgatgctttcccctccttacttcccctgacaggccctagtgtgtgttgtcccccaaccccaccatgtgtccatgtgttctcatcgttcagctcccacttgtgagaacatgcagtgtttgattttctgcttctgcattagtttactgaggataatgtcttccaactccatccatgtccctacaaaggacatgatctctttccttcttatggttcctagtaaggaatgggaacatttaatgttcaggtctgaaataataatttctctgaaatgagcattcttttgcttattcagacttccttccattgcttctggcgtcattttggcatgaaacaaacatctggaaactcctaaccctacgggatcttgtcttctcccttgggaatttgtgattggacttttgacatttgacctcccccatactgctctcatggagagccttcatctcacagtagttgcaagaaggataagatatttatagaacatcccgttattgtacaggattgtgtctctagggttaaatactgggtttctgcctccaaatgagtagtttattgtcttcttaagtactgaaaatgtacagagttatcatagttaaattcttattcctaaaacaaaaacaaaagaaaatactacttgctaatttctttctatttttatatttttggatggcttctattgctttgcagtagcaaataagagtgttacagaattgttttccccagaatcgaattgcctttagggggtactccatgtatatgttttagcaatgatgctgttctcaaactcaaaaaatcactaatagaacagataagcatgttaaaatgttagccatttcttcgaccttgtaatatattttctgacagttgagataattggtgaaatacagaatctagatttgtgctgaaaagtacttaggaaaattagaaaatattgcaagtcattttaaaacaggaagaatatctgtggaggtgatgggattcctaagctagctcatgagattataaaagctcaagttaaaatgtgctgtggccttatggagaataattccaaataatttatgtagatactccccctacccaaagagggtagtgtaacttccattccttagctctcagttgaatgtagtgacttccttccaaagtgtacagtatggaaatgaggaaaggggaaggaagagtaattttacaattaagaaacctgtcagactataacagtcaggtggttgaggccaatgttgacagttataatgcatgttgacagtatgtaccattggtataatgggatgaaaatagctttttacttctggggacttcctcctaataatccgtaaccccagtctgaccttgaggaaaacaatatacaaatttcagtagaggtgtattctacaaaataactcatgagtagtcctcagtattgtcaaggtcatcaaaaacaaggaaaatctctgagaaactgccatagcaaagaggagtgagtcaaagaggcaagataactcaatgtaatgtggtattctgtttgggatgttgatgcagatgaagggcagtagataaaaactaaggaaatctaaataaaccatgggctttgggtaatagtactatattaatattggctcattaattgtaataaagatatcatgctaatgtaaaatgttaacactagaggaaacggggtgctatggtttgaatgcatcccccaaaaagcacatgttggaaacttaattttcagtccaactgtgttgggaggtagggcttaatgagaggtgattaggctgtaaggggtctgtcctcatgaatggattaatttgttattgagggagtgggtttgtggaaaaaaagggtacgtttggtccctctctctctcgccctccctctctcaccttctcaccatctgctaggtgatgaagcagcaaaaaggcctttaccaaatgttctttataaattactcagtctcagctattctgtgacagcagcacaaaatggactatgacaccgggtgtgggttatatgggaattctctgtactatccttcaattactctgtaaatctaaaactgctctaaaatataatgtccgttttattttaaaaaggcactttggcaactgtccagctgatacccttctagtgatcaaaactctgccaatatttggtgtcttcttgaattccttgaatgacaggcaattaaccatttccaaaagtgatacttcgattaatgcacaactcttagtgtttagtcctatttgtttattttttttggtagatagcagtagctaccaaagaaatttgaggtggctaggattagctactccccaacaaacatcctactaagctgtaaaaatacacatctcagaagagattctgcccccatgcacttattttactacctttcattagcaaatgggtacaaaatagttcatatagtttgtaggtctgataaagtctaagctctcttttctttttggcatactaaccacatttcatatgaaagattgactccaagcagatgtgatattcgagtcaggattttgtaccctacaataggcaccataaaatcagaattcctcttaaaccaatgattgaaatcaagcatcattcctaatcattcaaagtgcaggatttgttggattttccgactgtattcattcaagagtgcttctaaactgttttggcccatttccctgtcttggtacttctaatgtcaccattgaagccaagtttagtattcatcatgctggtcactagtttaatgaataaaacccatttttttaaagcattcaggatgctaattagcaaagcttgttgattgaggtactggtatctgaaggacttgtaatacatacttcagagcatggccttttctgatgtaatataggtgaccacccatgaactatgcattcttgatatcatgtcagctaaccatccttagaattaaagctttaactggtcaaacatcatagtacattgattatatgaagtaaattacagacattggtacaagtgagttctatttttatttttattattattttttgagacggagtcttactctgtagcccaagctggagtgcagtggtgcgatcttggctcactgtaacctctgcctccagggatcaagcgattctcatgtcccagcctcccaattagctggaactacaggcaaatgtcaccatgcctggctaattttttttttttttttttttttttttttttggattttactagagacaggatttcaccatgttgcccagagtggtctcgaactcctgagctcaggcgatccgcctgccttggcctcccacagtgctgggattataggcgtgagccaccacgcccagccaaattctatttttttaagaaacaactcaacccagaaatctacttttgtgtcccttctatccattgtttcctttgaggcaaaaagcattatgtgtgaatttgcatctgaggtgaatgctatgcttgggtgtgttatatctgagagtaaacttcaagtgctgataattcttggggcagcatggcaggggaggaggagaaaggaagaagtgggataaacatggtgacagagaagaagtgctttagatccactgtttgagaactctagtggactgcggaaatcctaccttcctctaatctagagtttttctattttttttttttttgacaatagaacacatttggaatgcaatgcctcctaataggccacagaagtaatattctgtgtaacacataatgcactctcttaatcaaaactataatagaaggtcaaatgggaaagggacagaatatgtattcccttggtaaaaacaatacaaatgataaacacaatcatagtcatagtagctaatgtttatgtagtatttaccatatgtgaggtataacttctactaactattctaagtacattatatacaggaactcatttaatcctacaatgaatctgggccatctattatattgatggaaaattgttaccaatgattgaatagactatcacacattgtatactagaagaaattgctattctatgacaaaatggtgagctggcaaagttagagaaaacctaaagcaattaaaaagaatgggcatacagagaactaaagaatttagtatcagtagcatgcattgtacctttacagcatgaaggtcttagtacctacaatgttaaaaattacatttagaaaattagctcacagctcttgcaggtactggtgcaaagcatgtcttatttaaatgtttattatcgtctaagcttttattattccttggctgtcctagagatgtatgataagatataatctttatagaaggaaaatgacaattatttcaagttctattccttaagaaattagggaaataagaattctgggaagatggcaacaatggcattatagcttacgactattcctgaatcctctaatgaacacagtcagagtagcaaaaccaaaactgcacagatgaaatctacaacaaagcaacaaaacatacaccctaatgcatgtgtatatggggatgaaactctgatagcaaaaagacttgtgtggtatcactaaaactttgcaagaagcagagagaaggaactgagacttacgatggatttgagtggtggagaacccccaaatcatcagtgatactcactggaaagctctgtggtgtgttctgagaggaacaactgattctttgaggacgctttacaggactcaattcataggtaactgcaaggaggccatcattaggtttgatgatgctgtggctgtctgagtcgaaactcttgaaactaaccaactacagatcactttcagaacaaagctctgcactgaggagagacttcatttagaactcatattgaggaggaggagaacaacaggagcaaaggaaagagaaaatccagccaagaatgaggtataggagaagagaaagcagatctcagagagcatgaagccatgtttttgaatccttcattaaaaaaacaaacagatgcaggtgtttccagtataaagttaggtccttgctaccattgtaaaagtgtaagaatattcattttaccctaacatgagcaacagaaaaggattacagttaaaaataccatgtaaagttattataagcaaaaagagaaaatgaataaaataatgtccctacaatgaaggcacaccagaaagataagtccacaaggcaaataaaaactgcaacctaatatttcaaaacaggccaaaagaagttgagaagcaaataatagatatgaaagaacaacacgaataagaattagaaaaagtcataaatgaggtgattggagaaaaatacgatttagaaagatggcagaacttaggaaataattttaaaataaaaaaaaatcaagttcagtgttgaattctaaattagaggaaacccaagagcaaattgataccttcagagaaatagaagaaagaacaaagaaaaaacttttaaaaataaagtgaatgaagacactaaaaggatggaagagaaggtgacagctataaaaataggcagggacattaacacatgtgtattgggagtcccccaaaaaggaaccaaagccatggtatagaacaagtatttgaaattatgattcacaaaaaaatgtcctgacttgaaactattgaaagatagtactgcaaacctgggaaaaaagactcaagagatattttcactaaaactatgaactttaaagaaaaggaaacaatcctttggtcaaccaggcaaaaaaatgaagtcactgataaaggaaagggaatcagattacataagacttttcaactttactgcagcagaccatacaataatgcatttaacaaagtcaggagttgaaacagtcaaagatatcataccttgtcaaactgacaaacttatttcattataaaggttagagataaactgtaataactatgcaaaaaaactcaaaatattcttcccttgagaattcatgaatattctactgaaaaataagtgttagtttgcaaaagcaaacttgaacacatgaaaaggcatacttcttggatcggaaaattcaacataataaagttgtcaatcctctttaaattaatttataaatgtaatgcaatcccagtaaaaattccatttttttttataatcaagtagacaggttgactaaaaagtttatttggaataagaaacaagaaagaatagccaggtaaagaacaaaaatggagaatatactaatggaaattgataatgcaaacattataaagccttataatttaaaaagtatggtttgcatacacgaataaacagaccaatggatcaagatagaaaatccagaaatggattcaattacatatgcaaattactggagaaaggagatggacttttgaaaagtgtttttgggaaaactggatgaccttttgcaaagataaaattggatccattcctcacactgcacatcaaaataaactttaaatatattagagatttaaatgtaagcaatgacactgtataagtaacagaaaaaacatagtgaagcactttcctaactatgactgaaaatgcagaagcaacaatgggaaaggttgatacacttgataatatatgtatacaaacaaattttacatgactgaaaaaactatcataagaaaagcaaaaaacaaaaagagagacaaatatgggaaaaattatttgcaatttctataatggacagaatgttatatttttatataatacagcttctaaagacagagaggtttttagagaccaatgactctatagaaaaatcacctagagatagacacaagtcacaaaaaaatgaaatgcaaatacccttggacatgtgaacagatacacaatctcgtgcatagtaagagaagtgcaagttaaaattatgttgacatagtacttaactatcagattgataaaaccccaagtttaaaaacattctgagtgtcatttagagctagagtttttggcatgcaaaaaagaaaattcaaatatgagatgaaggaggttgagtaaaaaggcagcagtgtaaactgagatatattttatctcaaaaaatatcctacatactaaaaaaatccatctttttaatgcaaagaaataaaacccatcaccagtccagtgacaatgagtagctgtaggattcagattgtgttctttaagtcccatttccccatagaaagaaccaggactccagagaaatgggtgattctaactctgggatagaaaatgtacagggatagtctggagcatcttgtcacaccagaaagcaatgacgctcaaggaagttataagactacgtaagaggatatgctgaaaaggaaacgttttgaagttgctcccactggctaagttttgagcaacaataaggacaaaagatgtcaatgaatcatgatacatgaaatatatttaaatgcatgacttttaatggtactaaaaaacatcacattggtcaccttagaaagacttgaagaaccaattcattattttaaagaatagtaaatagaaaagaaatagtaagcatttatcctgccttccctatactaaaagtacttcagaataaacaattgatgaagggaaatttctcttagagacagagtctaggtaatacatgggaaagagatgagaattaaagtattatcactttgcaacatttaatggattaacagatccaggcaattatcatcagtggttgccaatatatgtatataacttaatgtataatactaatttatattataatatatgctatattaatttaatatatattagcatatgtataatttaatatttaatatataattatatattacatatgtatatagctctataagtactatagataatatatattaatctaattttctctgtcatctattatttacctattatctctctctactatctgtctgtctatttatcatagaaaagaattacgccttggtaccaattcagtcaggtgggctcacatgattgacttttagccccatcttttgcttaaaaataaaaattacatagtactgtaggaagactgtagggagctgagtggggactaagagagcatacaaactttattttacaactatccagtccaccacctatctcacagatatgggtgcaatttctaagtcaaacactatctcataactgactatatatggcttttcctggggtgaaatactttgtttttgctttcggcattccttccctgacttgcctttttagttgttgtggggactatgtttttaaatccacgagatgcaaggaaacaatggacgcctttcttcgctgcttgtaaaggtcatatgagaaacaagcatgagcagagcagttctgactagacgtgcaagcacacacagaacgggacacattcaccgcgtcgtttgtcagcattaaccctttgcttataccaagaaaaggaggctgtgtttctatcttcagatggttttggactgaatttatgtgaagtagaaaacaggagtgaatcactgaaatttttgcttgctctgttagggcttgggaagacccaaaatggaggtggcgtctgagtccaggaagaaagaggacgtttatgaaacaagaggtcagggattttcctctcaggtctcacgactgtaagcagatcagagctgccagatgactatgcaatgcctctagcaccataaggaatattcccctccaacaccagttaaaagaaaaataataacaaactagaaataagcatagaaagtacagataagtacaagatagtaaaaaatactttaacttttattctttttccgtgttattattttaatagtttttataaaaaattaagtatcaaattctcacaaaggttattttctcatcatttagtgttctcaccttgttgggggcctaaacacttgtgttgcttttgggtaatctagtactggctcagatccatctcctcagaagtccaagaaattacttgtcaggaaacttggtaggatggtctgctcaccaacgtagtttattgactgctgcttttacactgatctaaaaatactctttatttttggttggaatatggcttattttgggagaaactggtgaggttaggtcatcctcagatttctgcaaaatattttattataatagacctagctattcatgggaagattataatacctcatggatcatctggggaaaatacctggccttcaaggccactatttccagcagcaaacataaaaatcctttaatccatgtcccacgcttaggtttcttaattcatgaaattctgcttatgattgccacatataaataagaaaggacttgaacatatgtgagctataagaaacttttgtaaagcaatgcaactcatgggtttaaacaaatacttttggcagctttgttaagcatacatgcaaaaagtgggtttgcttcaccagtaagggatacagaaaaatccaagctctctgacctacatgtgacacacacaggataataattaatgataataataagttttaaaaaatctagtatgcctttctatcaggatggagcaagagattaattacacattgtacatcataatgtctgaaagcctgagaacttgtgcaatctgaattaaattttatgaaacaaaatgcatggaattgatgctttcattttgaatacacaagtctttttcttcttatattctttccccctctcttttttccttctctccctccttatcttagcacccctcctccctgcttctaaaagaagagaatactgttctcaggactctctcagcctttctcaattgaaagcaatgattctgagtcactcctttatattaagtgaaatactcttgcatgaatctctagggatgaagtgattagcccagcaagaagccagcggattctggttgtccgtgaaagtggtagaaagaattaaatacaattttgcaaagataacactaaaagaatggtattttctttcaaaacatgtccttttctgaaacatcagtgcagacgtatgtcaagatagaaactggatcatatttctaacagttgaagactcagatttcatcaaacaggactgcttgttctcatgcccaaactgtatcctacactgtcctgttgtctggactataatggaacataacattaacttcggacagtggaggttgtgttggtgccaaccttgctaatgaacatgtggtttccataataatgtggctacttgcatattaggtggcaaggtgccaggtacgtacttaatgttgagggggcaactgatgtaaaaagtaccatctcctgatatgattgcatttccaaaaatactctgcacctggactgaaactcggcaaaatgaggaatgtcagtcagcatcaggaagtttaaggcattgacagataaggaggagccctgcagattccaggcatgcactctgtgagcctcaagcatccatcacaaggtcttgatgataacaaaatgggtaacgtcacagtgtgaaaaacagcccgacccaggagggtggtgggtgggggaaggtttaggaccactccctgcttcaagttcctggtgttctggactcaggcacttgagggtctgaaagctagaagacagtgaaatgagttacagtttaatgatattcccactacactgacaaaatggattcagttacataatggtagcattaaatgttattaagaagggatccaaagtcttggggccagactttcacaaaatcatgataagctgcgaaaaacagctgaaatagcacatttataggctttccagtcctcaatttgttgaaggggaaaaaagttgttatatttgctcaaacattctgcagtgttggcctataatcaggggcttagtggaggggcggggggtgtcaggacatatctgatttgattattatatcttaacttgcatttttgttttcctgaaagcttttgtgaagtacagagctaaatggtttgcccaaggccttggttgcttagtagggcagtgatttttcttggtgtcaagacctcctctgtagagtgaccaggtgtagagggtagactgtttttcttcatttctatcttctctttgtataagagaagcttcatttttttaaatctgcattttataaaattgattcattgtggtatgtagttttttttaatgtttaatttttgtgggtacatagtaagtgtatatattgatggggtgcattagatagtttgatacaggcatataatgcataataatcacattgtggaaagtggggtgttcatccccacaagcatttatcctttgtgttacagaccatccagttatactctgttagttatttaaaaatgtacaattaaattattttgactatagtcaccctgttgtgctatcaaacacaagatattattcattctttctgttttttgtacccattaaccattcccacctcctcccagcatcccagtacccttcccagcctctggtaaccatccttctacataagttcaattattttgatttttaccccctagaaataagtgagtacgtgtgatgtttgtctttctgtgcttggcttatttcatttaacatagtgacctccagttccatccatgttattgcaaatgacaggatctcatccttttttataactgaatagtactccattatgtataagtatgtagtgtatagtttggactaaggtatctactaccacaatcaacatgccaagagttccatcacttccaaaaaatttctcatgctgcctggttgtcatcagtcttttttctacctccagcctctgctaactgctgatctgttctccatccccatagttttgtcttgttttgaataacatataaagggaaactatagcatgtagtctcttgagtctgacctatttcattagcaaaatgcatttgagattcattcgtattgtttcatgcatgagtaatttacttctttttattgtaaaagagtattccattgtatggatgtatcagtttgtttatccattcacccatggaaggaaatttgtactatttccaatttttggctttaattattatatttttaaaccatcttattgaagtataattgacatacaaaatctgtccttatttaatttatacaacttgatgagttaggagataagtatgcactcatcaaatcatcaccataaacctatacttcaccataaatcatgccataaacctatacttcacttccaaaaatttcctcctgctttctttctttattataataataattattattattatttgtgataaaagcactcaacattagatctgcttttaaagcaaaattttaaggatacaatatattattggtaattacagtccctgtgctttacagtagatctctaagattatccattttatataatcaaaactttgtacactttgactcataccttccatttctccctccccacaatctctgaccactatccttctattctctgcttctatgagtttgactactttagattcattacataagtaatatcatgtagtatttgtccttctgtgtctggcttattttacttagcataatgtatcccaggttcatccatgttgctgtaagaggcaggattttcttcttttttaaggatgaataatattcccttgtatgtatatattacattttctttatccatttaggagtcagtggacatttaggttgttgctttgatgcctcggtgattgtgaataatgctgcagtgaatatggaaatgcagatagctcttgaaaatactattggcttattatttatacctcttttatatttttacttttagtggttgccctagagttacaatatttatctttaattaatctgagtttaccttcaaataatattaaatcacttcacatgtagtgtatggaccttgcaacagtatattcaaattccttcatcttttactttatgctatacatttaattttacatatgctgcaagcacatagtatattgctactattttttttctttgcataatcaattatcatttaggcacttaggagtaagaaaatgcatttttaaatctttatttatttcctttcccacaactctttatttgtttgtgcagatccaactttctctctggtgctatattacttctacctggatagccttctcaaacatttcttataatgcaggcctattaccaattaattctccatttttcttttcgagaaagattttatttcacctttagttttaaaagatgttttcctgggtacagaactctggctgacagtttttaaaaaatcttaatgatgtcactccattttctcctggcttacatgatttcccacgagaagtttgttcttatttttgttcctctgtatagaatgtatctttagtttagttttgttttaataaattttatttttagaagagttttaggtttacagagaaactgcaacagtagtacagagagttccagtatatctcatatccggtttacccattattaatatcttatgttagtatggtacatctgacccaatattgaaaaattattattaactaaagtctgtactttattcagatttccttagtttttacctaatggcatttttgtgctctaggatcccatctaccacattatgttgtgatcatgtctccttaactcctctaggctgcgacagtttttcaggatttctttatttttgatgactatgatagattgaggagtactggtcatgtgttttgtagaatgtccctcaatttggatttgtctgatgattttctcaagattcgactggggttatgggtttttggggaggaagaccacagaggtaaagtgccatttttgtaataatcatattaaggagacttactgttaacataacttttcactcttgatgttgaccttgatcacgtggctaagatagtatttgtcagatttctccactgtaaaattactcctctctcttttacttttgaaatctttggaaggaagtccatataaacagcccatgattaaacaatggggagttaggtttattctccttaagggtagagtaactacataaatcatttaggatcttctacaagtgagacttgtctcttcttccccgttatttatttatatcaatattaatgtcttttatttttggctgccttcagaaattttctctttctcctctctttgttttttatcatttggataagacatatctcaggtttgttttttaatttgtttgtttgtattgtgtgtatcctcactggtgttctttgtgtttcttggatctgtggtttggtgtctaatgttaattttggaaaaatcttggttattatatgttcaaatgtttattctgccctattccctctctcttcttgtagaatttcaattaaacacatcttaggtatatgtcattgttctacattcctttgatattctattctacttttttcattcttgtttttcttttaattcaaataacttatattgacctatatgaggcttactgattctttctttgactagtcaaatgtattgatgatacactcaaaggcattcttcatatctgttacttttttattattattatttgtagcattcctacttaaatcttccttagtactctctctctctgctgaaattacttatctgatcctgtgtgttgtctccttttcccattagaactttcaacatattaattatagttattttgaatttcctatttatggttttgatatttgtattatatctgagtctgcttctgtcgatttactcatgccactgtgttgtttttcttgctttatttttgtatgctttgtacttttttggttgaaagctgtatactttctgtaggacaatatatactaaagtaagtgatttttttttttttttgagacagagtcttactttgtcacccaggctggagtgcagtggcacaatccaggctcactgcaacctccacctcccaggttcaagtgattctcctgcttcacccttccaagtagctgggattacaggtgtgcgctgccacacccggctaattttttaaaattattatttctagtagaggcaaggttttgccatgttggctaggctagtctcaaactcctgacctcaggtgatccgcccgcctcggcctcccaaaatgccgggattacaggtgtgagccaccgtgatggccaggtaaatgatttttattcctggaaatgagcacatttccttctgctaggactctaatgtggattattgaaccaatctacttagggatttaattggaatagagattgctgttgctctggttaactacagtgtactacagacttcaaattcctgtagtgacactttgtgtgttgggtggaggctggttcgccagaaggctttttcttaatatccattctcagctttaggtctttattttacactatgccttagagatggtctctttccatactcatttaattcttccaccattactaactgttacttgttacttaatgcttgttagagtggtggcgtggggtcaggagtccattcttcattcttttcatgaagcttgtttttaggcaggcactgtgtgtctctggagacctttttctgtattttttactttaaaaagtatggagtccattcataaggatgctggcgggggcagtaaggagatatctggatgtactttaatccaaaaaccatattttagcatgttctatgtgccagatcctgggccagatgctctaaatgcaaatggacaatgacgtggttcttccaattcagaagctctgtatcagagaaccataaactggtaaataggtgtagactcaaggtactttgaaacccaacagagggcttttttgctcagtgcagatgagggtgatggtcagggaatctttcctagatggactccatccagaccaccatctctctaggacatctgattttgtgctccatcagacaaaaggcaatggtttgagatgagagagagaaagacctaagtatttgaagtaaggatacaggaggtgaggaaactatggagaaatacagtgccctctgaaggtcatactctcaacattacttcaggtatcttcatagtgctatctctagaaaaatcaagggtttttttttgtttcagacaaatctgaaatctgaaatttgaaatctggatttctcacctacaagttgaggaatcttaggaaaattactttcccaacgttcacttttctcatatataaaatgacaaagatgttttctgtcccattggattgctgtaaacattatgtgaaacatcagcttctagaagatccataataagtagttactattattgttgttgttatttgcagccactaaattgaattgtttttaattctttaggtaccctaatgacaagttcaccccagtgttttctgaggagtctacctggaa

SEQ ID NO: 900 - DNA, 1729 bp, Homo sapiens
acgagacttacatgcctctcttcagtgatgcagtattaattgtttatttaatttggttcaaagtaaggtcaaactctttcttattactgtatttttgctctgatttttttttcccaccatctcttcacggatgcataaaactgaatgttttcagaataatccaggtcacctcttgaatgcttaaaaacttattccaccagataccctaaatcatctctctcaaatttgaagtcccacatatctctagggcaggggcaaaatacggccagactccttgctaaagcataacaagagtcacctttattccagttcccaacatatacttcctgtcttcttctgagccctgtaaacagttccaacctccgcttgttattcagttccaaagttgcttccatattttcaggttatctttatagcagtattccactctacttataccagttctctgtattagtctgttttcacactgctataaagaaataacagagactggacaatctatggaagaaagaggcttaattgactcacatttctttatgactgtggaagcctcaggaaacttacagttatggcaaaaggtgaaggggaaacaagggatgccttacacagtggtaggagagaagtgtaaaggagcaacttccaaatacttttaaaaccattagctcttgtgagaactccctcactatcatgagaacagtatggaggaaattgcccccatgatccaatcaccttccaacaggtccctcccttcccttgacacacagagattacaatttgaggtgagatttgggtggggacacagagccaaaccctatcagggtatacacacatacttagaaggcgtaagttctgatgtttggcatcagaatagggtgactagaattaactgcaatgtattatacatgtcatagtagctagaagagataatctgattgttcccaacacatagaaatgataaatactcaaggtgatggaaaccccaaataccctaacctgatcattacatatactggcatataagaaagtatcacttgtaccccaggaatatgtaaaatcttatgtatccatacaaaattttttaaaataaggatagtatcttctctacataaaatttactttcatttttatactaactgaatcctatgaaacaactgtctttggctactataaattgctctctttcttacattatgtattttacatgtacctatttccccatagaaaatagattttaaaaacacacacacagaatatagtgaatattaagtatattaatttataattacttgggtaagaaccacacaggagagagagaaagaggaagaagagatctaatcaatgatacatctataaatctcatatatatatatggtctgattttttaaaaagtatacggatggcaaatacagacagcctggcaaataaaatagcagattttcacttatacttcccaactgtactgctaccattgagtaattcaaaatctcttagactaacaggagttcttaaccttttttacaccatgaaccccatcaacaatctggggatgtcaacgaaccctttttttccaataataatttaacatttgtaaataaaatgcatataataaaggatatcaattaatttttaaaatcagcaaaatcttaaaatcacaatatgaaaataagtatgagcatatctttgtatacgttaatatataaaagaaagaaaacattgcaggtataataga

SEQ ID NO: 901 - DNA, 35643 bp, Homo sapiens
ccaaaaccccaaaaaactaaatcaccttatagttcataaaggcaaagatattttatttcatagtttctcacaatgaaataaatagtaattatcctatgaggtagttactattattatatcattaccattttagacatgagtaaatgagggcatatatgtataaataacttattcaaagtcattagctaatgaggccgggcacagtggctcaggcctgtaatcctagcactttgggaggccgaggtgggcagatcacttgaggacagaagtttgagaccagcctgggcaatatgatgaaacctagtctctactaaaaatacaaaattagctgggcatgatggcaggtgcctgtaatcccagctacttggaaggctgaggcaggagaatcgcttgaacctgggagatggaagatggaggttgcactgagccgagattgtgcattgcactctaacctgggcagcagagcaaaacttcctctcagaaaacaaaaacaaaaaaacagtcattagctaatgagaccccagaacctgcacagggagattaccaacagggaaagcagatttcagaaaatgcagcctggccaacatggtgaaacctcatctctactaaaaatacaaaaattagctgggtgtggtggtgtgtgtgcctgtagtcccagctacttgggaggctgaggcaggagcatcgcttgaacctgggaggcagaggttgcagtgggctgagatggcgccactgcactctagcctgggtgacagaacttttgggaggccaaagtgggcagatcacttgaggtcaggagttagagaccagcctgggcaacatggtgaaaccccatctctactaaaatacaaaaattagccgggtgtggtggcactggcatgcaatcccagctactcgggaagctgaagcaggataattgcttgaacttgggaggtggaggttgcagtgagccaagattgcatcattgcactccagcctgggaggcagagcgagactctgtctccaaaaaaaaaaaaaaaaaaaaaaaaaattcagaaaatggtatggaaaagaaaggcatggtcctatggccagagacttgaaagggagttccagaagaaagaaaacttcccactgtcttagtcagcttaagactttgtggcttaaacaacagacatttatttctcatgcttctggaacctgggaagtccaagaccagggtgctggaagactcaatccttgataaggtcccactttttggcttttagtcagctgcgttcttgctgtatcctcatgtgactcagacactggtttcctcttcttataaggacactaatcccatcatgagggccctaccctcatgacctcatcgaaacctaaggacctcccaaaggccctgcctcttaatcctatctcattgaaggttaggccttcaacagatgaatttttggaggacacattcagtccataacacttcccaccccccaacacacaaacttttaaaaatctgtgttaagtatgtactttgtgctgtaaagtgctatgggttttttgtttttgtttcatttctgttatccaggctgaaggcagtggcactatctcacctcactgcaacctctgcctcctaggttcaagcaattttcccacctcagcctcctgagtagctgggactacaggcacgcaccaccatgcctggctaattttttgtatttttagtagagacagggtttcgccatgttggtcaggctggtctcaaattcctgacctcaggtgattggcccgcctcggcctcccaaagtgctgggattacaggtgtgatccctcatgccaggccaaaccatgaatcttttatctttctctatagttttgtcttttctagaatgacacattattgaagccatacgatttgtagtcttttcaggctggcttctttcacttagcgacatgcatctaaggttcctttatgtcttttccatagtttgatggctcatttatttttaatgctgaataatattacattgtatggacatgccataccatagttcatttgtgttttattttatttatatatatatattttttgagacagaggctcactctgtcacccaggctggagtgcagtggcgcgatcttttttttttttgagacagagggcacgatctcgactcactgcaacctctgcctcctgggttcaagtgattctcctgtctcaattccccaagtagctgggattacaggagcatgccaccatgcccggctaatttttatatttttaatagagatggggttttgccatgttgcccaggctggtcttgaactcctggcctcaagtaatccacctgccttggcctcccaaagtgttgggattacaggcatgagccactgcacccggccttagattacttttataataaaaaaataaatgcattatatgcacaagaatcgtgcttgaacctgggaggcagaggttgcagtgagctgagatcacgccactgcactccagcgtgtgtgacagaccaagactctgtctcaaaaacaaaaacaaacaaacagaaaaccaactatgaaaaagagagttagccctataggcatgtgtgatatatcgcaatgcataagcatacaggctctggaattggacaaacctagatttgaatagtagccctgtcacttattagccgtgggcaaattctataatctcgatgtgccactctcctccttgcaccatgggtttaaccacattgcctgggctactgtgcggattggatgagatgatgcatgtggagtcagcaagatgcctgtcactccccctccctcccaggtcttcactgatgaaagcaggtatcaaagtcaagcagatggaaatgaaactggcaattttattattggtggagttattggagaacaataggaatatttcaaaaaaaatgatgcctgcgtcaacataaaagcattttcaacaaattgtgttataatatccaggtctgcataagaagttttttttaacctacatgtatcttaatacttctttgttggtgcctctccattagttcatttgaataagagaaaaatgtcaaaatattttggtaatttttatagatttcataaggggagtttgtcattagtttgtgtggattttttttttttttttctggctgtggatgctttgaatggtagaagactgaagggaagggaagtgtggtgaggtggggcttgaacaagatactacatgttataagtgattttctgaatttctttttttaaaataagctaatttgtaatattttataactagatggttttattagatgctcataaggtctcaaacgtgcactaatgctcagattttacatttccatcagccagaaacctgttttttatttttttatttttggacagagtcttgctctgtggcccaggctggagtatagtggcgtgatctcagcttactgcaacctccacctcctgggttcaagcgattcttctgcctcagcctcccaagtagctggaattataggcacgtgccaccacgcctggctaatttttgtatttttagtagagacgagatttcaccatcttggccaggctggacttgaactcctgacctcgtgatctgcctgcctcggcctcccaaagtgttgggattacaggcgtgagctactgcgcccggcctagaaaactttttttaataaaaataaataatctcctttcttccttttgtcatatgtatgtgtacacacataaaatcaaaatcataaccacaatgtttttcttttcattttttgtttttctctacaacctgggcccaggagctccttcatctttttttttttttttaattgtggtaaaatctgcataacataaaatgtaccagctaatctattattaagcatacagttcagtgcattgagtacatttacagcgttgtgtaaccaccatcaccatccatctccagaaagatttcatcaacacaccatgtttcaaacttctcgattttataaagtgcctctcattcaaatagtaacagctgaagaaaaaaatgcaggtaccatgcaacatctgacttctcagctgccacactcagaagtaacaaagaacccccttttgaaaatctcttcccattttatctttctttacaactccatagcaatgttgttttatgcaaacaaaatgtaaaacagagaacaaatagtttgtcccctgctgctatataaaaaccaaagtttgtaacaaggtaactattttatagccctccaagctcaataaaagtacattcttcctgttgtgttctatcttttgggcaggtatgtaattaagatagatggtgtgtgatcctaagaactcccttaccggagcatgttctggccaaattcagtgtgttacattatactgttcctttatatgtcccttagtattatacttcttagctgtccacatcatatccaatataggtcactttccttcctaaaatgttttctaccatttttatatctactgagggcgttataattctgagatatctgaattttattgctgaatggttaaatctttttctggtgtgaattcattaaggtgctgaaacataaattgtactatgtttgtgggagttatctttcactttttctttgttttctgcaaattttttaatcctctgaaaataggccaggccaccttatcagtgcgaggtatccagagctccactctcttctgagcttaagaatgttctagaatattgtaaggggggaatggagtactcaggagcaggagagagggaatgtgcaaaatctctgggcacaagtgggtgttcccctcccagctggtaaccaggtgatgggctgactgcagggaagggaaggcctcgtccaggaagggacagctggtgcagcctgcggcagtctagtagaggccacgggctcctacttgcgccttcgtgctgggaaaccggatttttttccttcttcatgttttaagggcttcttcagcacagctttgccccaccacctccacagtcttctctccccctagtctggaataagatgttctagtccctcaaatcaaatcccacatgtaagcctcacatttccccaacttttacctaggactgcagacctccaagcccagaggctttggaaacaatcttcaactgctttctctctgctttccaccctgtgtccccctgcaggcagcttgcaaagagcagaggcttggaaaggagaagtggggcaggaagcgcagaaagtgcaggattctgcggttagcatttcaaaaacattgcccttctctgatataaagaagtggattttctctgatagaaagaaaacacagtcaagtcctatgcttggaatattgatctgtagaacagtggcccatctccagcctcaaaggctagtcttaaaagaaaaaggagaaaaaaaaagcaataggagagtttgctgctgcgaagcttaaggtcctatgaggaaaatactattagagccaggagcacaattctggctgcaattagagtcacctgggagaactttaaaaaaatgccaaaaatagaatgcctgggcctcgcccctggagactttgatttaattggtcttgagtgggcccccaagcaaagctttttttttttttttttttttgagacggagtctcactctgtcgcccaggctggagtgcgttggcgcgatctcggctcactgcaagctccgccttccgggttcacgccattctcctgcctcagcctcccgagtagctgggactacaggctcccaccaccacgcccggctaattttttgtatttttagtagagacggggtttcactgtgttagccaggatggtctgatctcctgaccttgtgatccgcccgcctcggcctccaaaagtgctgggattacaggcgtaagccaccgcgcccagcccagcaaagctatttttaaacgttccccaggtactgagtgtagggcagaaacccacgttatgttagcagggcccactcatcctataggcatagcaggcacagcacttgggcccaccatacttccaggacccacagaaaagttcaatttcttttagaatcagaagaaaaagaataaacttttaggtggaagaaaatgacttcatatataatattaacatgtatttctttatatcaatgaattcataaaatacaattttgggggctaggtttggtggctcatccctgtaatcccaggattttaggaggccaaggaaggaggattgcttgaggccagaagtttgagacccacctgggtaacatagcgacaccccgtctctaaaaaataaatttaaaaataaaataaaattacaattttttttaaatggggaaagagatccacaagtcagaagtgcatacggcctacaaaagccataatgcagccctatataaaagagacacgtggaggccaggtgcatgtggctcatgcctgtaatcccagcactttgggaagccaaggtgagcagacacttgaggtcaggagttggagaccagcctggccaacatggtgaaaccctgtctctactaaaaatacaaaaattagtcgggcatggtggcgtgtgcctttaatcctagctatgtgggaggctaaggcaggagaattgcttgaacccagaaggcagagtttgtagtgagccgagatagtgtcactgcactccagcttgggcaatagagtgagactccatctcaaaaaaaaaaataaagaaagaaagaaaaaagcccggtcgcggtggctcatgcctgtaatcccagcactttgggaggctgaggtgggcggatcacctgaggtcaggagttcaagacccgcctgaccaatatggtgaaaccccgtttctactaaaatacaaaaattagctgggcacggtggcaggcgcctgtagtcccagctacttgggaggctgaggcaggagaattgctcgaacccgggaggtggaggttgcagtgagcctgggatcgtgccattgcactccagcctgggcaacagagcgagactcggtctcaaaagaaaaaaacaaaaacaaaaaacacatgtaagggtacatctttgaatattactaaaaataattattcagttcacattaacacagcattgaaatacaccaatgatgtgtacaccttgcgctggcaatgattcctaatttttcccttatcattcccctatccactgcaagtggttcaaggtaggctccatcctgcttcaataagctacttataaattttgctgtgttgccaactcagacgtttttgagcgtctagtctttcatccaaacacacagtgcctttcttttcatttttgttttgtttttgttttttagagatgggagggtcttgctttgtcacccaggcaggaatgcggtggtaccattttggctcactgcagccttgaattcctggctcaagggatcctcccacttcagcctcctgagtagctgggatgaaaggcacgcaccagcatgctcagttaattttaaaagtttttttttttttttttttttttttgtagagacagggtctcgctttgttccccaggctgatcttgaactcctgggctcaagtgaacctcctgcctcagcctcccaaagtgctgggattacaggcgtgagccgccatgcctagcctctggtggctttctaatgtttgattccgagatgctcacctcagttcctgagatttcagagacacagtggattggaggcctcagagaaaaggaagcattggccctaagaggtatggagcgaatccagagcctcctcaatgtgagccttttcccctgggctttgctggcctctgtcgccccagctcagttccctcctggctcctctggcaggcagagcttcctaaggttgagttacaaaaaccaccgtggtcactctcacttttccccttttccaaacagatacccatatttgaaaagtcatcttcttcatattggcacaaactccagagttctcctggcaagggaaaggcatgtggacgccaatctccatgtccttgaatttcatggaagggaactcatgttgagggagactgaggtatcaggcaggaaagaacaggtcaatactcattccaccggcaccgggtggggcttggaaaagccagtcacctgcacttgctggttgcaagactaaagcacacagatggagactcacaggaaaatcactcatctgaaaactctctgtggctgccagaggctctgatgtcccttggctccgggtaggagctgtcaaggagaaagccaactgtggtctgaaatgagggaagcaaggcttgggataatgatcccttagatgccttctggtttgaggtcttatgactcttcagcaaagctctggttctgacagacccaggtctcaatctctgcttctctatttatttatcaagaataaataaatttatacattttatttatccgtaaattggagataagaacatgtacctcatgggttgttctgaaatttatttttattttttaaattaatttatttttgagatggggtctcagttctgtctcctaggccggagtgcagcagtgtgatcatagcccactgcaacctccacctcctgggctcaagcaagcctcccacttcagcctcctgggtagctgggaccacaggtgtgtaccacaagcctggctaatttttgtattttttgtagagatggggtttcaccgtgttgctcaggcttgttctgaaatttaaatgttgagtgtggaattcttcaaattgcccaagaaatccaagttccctcttgtaatcactgtcaccttgactgtagggctaaaagcggaaggaatcgccagtttgttgacttcagcctgctcttgggcagaccagctcaaaaacccttacatgaaagttttatgaaaataaattgtactacttctgcaagactaaatttgagttttcattatttcagccctgccaccaaatagtcccagcttgctacttttgctttagacatatccaagaaaaatgtgttctgaaaggtgaaatcccttgctagaaggctttggcagtcagaaatgagcaaaaatgcagaatttttttttttttttttttttgagacggagtattgttctgtcacccaggctggagtgcagtggtgtgatctcggctcaccacaatctctgtttcccaggttcaagcaatcctcctccctcagcctcctgagtagctgggattacaggcgcgtgccaccacacccagctaatttttgtatttttagtaaagatggggtttcgccatgttggccaggctggtcttgaactcctgacttcaggtgatctgcccacctcggcctcccagagtgctgggattacaggcatgagccaccgtgcccggcctaaaaatgcagaattttaaaacatttgtactggtgttttttggtctcatttgttgcccaattggtctgaatataatctgacaatatgtcactcaagatcaactataaccaaataattcaagccaaagaatggttgattaatttgctacaaataaaatgtggtccacagagtcaaaactttttaaatgtttcaaggtttttttttttttttaaatttctttttttctgagacagggtctcgctctgtcgtccaggctggaatgcagtgacacaatcatagtttattgtagccccgaccttatgggctcaggtcatcttcccacctcagcctcctgagtagctgggactacaggcgcgagccatcatgcctgacaaatttttttgtattttctgtagagatgaggtttcactatcttgcccaagctggtcctaaactcctgagctcaagtgatctgccctcctcggcctcccaaagtgctgagattataggcgtgaaccactgtgcctggctaaggttttgtttttaatcttggaattggagctatcctgactttgcccaaagcatggttcgaaagggacttttcgatttggagttgtttcaacataatcaaggacacattcccaataacatttagtacatgcatgtttattgaattagtattagttggtgttttggggatggctgaggggatggtgagtgtaaacttgccttgtttctggaaaattcctccttccactggtcagcagagctttgacattcctacactaagttcttcagtctccaagacaggcagtccaagcttctagaaactcaagccatgcttggatccaaccagggtccaaccgaccacaaaatgtatctaaaatacttttgactatgctggatccctctaatgttgctattggttctctcttgatttttcatttaccttgcacgttgaagtaactgtgggaagaaatctgtgttccccttaggggaaatactggaggattagcatggagtcaaactcaagctattagatgtttttctcttactgagaaacttcactcctctatcaacatttccaccatataatggggtatactacctttagagcgaattaaaaaaagtaatagtttatcttcttgtctctcccatggaataaggatgtgcaatagcatactgggtttcattgccttcctccatactatacacatacacagtgacttttccaaaggctacttaggaccatttattttgttttgttttgttttttttattttgttttgttttgttttttttagatggagtttcactctgtcacccaggctggagtgcaatggtgcgatctcagctcactgcaacctctgtctcccgggttcaagtgattctcctgcctcagcctcctgagtagctgggattcaggcacatgccaccatgcccggctaattttgtatttgtagtagagatggggtttcaccatgttggccagactggtctcaaactcctgacctcaggtgatctgcccgcctcggcctcccaaagtgctgggattacaggcaggagccaccgtgccctgccgaaccatttactgttttttgttttgttttgttttgtttggtgagatggagatttactcttgttgcccaggctggagtgcaatggcgcgatctcggctcaccgcatgctccgcctcccaggttcaagcgattctgctgcctcagcctcccgagtagctgggattaaatcatgtgtcaccacgcccggctaattttgtatttttagtagagacggggtttcaccatgttgcccaggctgatctcaaactcctgacctcaggtggtctgcccgcctcggcctcccaaagtgctgggattacaggcgtgagccactgcgccctgtcatttattgttaattaggtctcacctcttctgctatgaggtcaataaatatcacctgtctttgcaggtccagggatccaggctacacgttactagtcaaaggccatggggcaagtctttattggagatcagatgggctgggtcagtctggcctggccacaagaagtgagcctcacctcaaaacctgttccacaatggcatttcctgactggctatgtgtgtgtgcactgactagcatgtgctcattcattcatcaaacatttactgaacacctgctatgtgctagtggctagagactcagggaggaatctgacccattcccttcagttaagaaactcagtgtgtgggagggctgaattataagtaagtaggtgctatgataaaacaccccacaaggcagaaagggaggatgaaggaggaggatttcttagaggaggagggacttaagctaaaccttgaaagagcaagacggaagggtgttttagatgaaggaaccttgacagcaggcccagagtgtggatggctggctaggggcatagccctctcattgacttatctgccagtcagggccagattttgagggcttgccacaccttgccaaggggtttgattctttttccgtaggcctagcaagtttgcctgcccaaggggctctagaagttcaaacggaaacttaatatgattgtttgatgtattaagtctcttccctcaacacttgtaggagtgaacactttgaaaagtgaacagtttaagactgagattcttcacttcatgtgggaagtgtgcaaagtccaaaaatgagattgagcacccaaggaattagtctcccctctgctcctgctcagagccagaccttgttggagaggacacagctgggtctcactggaggggaaagaagtttctatggcgtcatgcccatggaacctactggtaatctgacctctggggttctggggaaagctgtttatggggaagcagagttttggtagagttgctccaccacacaacagcttggagtagagggatagtgccaggagaggctgctggctgtggaatgatgtaggcaccaggtcctgaaggagtcctggcacagcaggggcagagcttgaaaccatgtgcactgcagcagccgggaggtgcagaagctataggtgctgggagagctccctggaagctcagatcaactttgtgctgacagctttccatcacaagtgagcacttttgttccaaggagccctctcagcatgggaggtgggtagcctagaagtaggggtaaggcatgtaggagcggtctttgctggagacttggaaaaatactccagctacctgagcttcaggttgtcaattctggggggcattcagcatcttcccaggaggtcccaggggaatcaggccccctgcatatagcaccagtctcattaacacaccctaatactggcctttcctccttgcctgtcgcactcttcctgcttcctctctccggcttctagggatcaccctaaatacaccaccagcaggcaagtcttgtcacaggctcctccttcagggcaacccgtattaaggcagcctgtttcccaatgactccaagcaaaagccctcttcccaggtgcccttcccaatcccatcttgcttcacaagcggaatagcttttccacttcaatcaaataaaccgtgtattattttttgttttgttcacttcctcctgtttccctgtctcgggtgtatgaccacaccttccagaaatgccctccgcactctttctgttatccatgtgcattacatcttcttctttttcttttttcttttctttttttttttttttttgagatgaagtctcactctgtcactcaggctggagtgcgatcacgtgatcttggctcactgcaacctccgcctcctgggttcaagtgattctcctgtctctgcctcccgagtagctgggattacaggcgtgcaccaccacgcccggctaatttttttgtatttttagtacagatagggttttaccatgttggccagggtaatctcaaactcctgacctcaagtgatccacccatcttggccttccaaagtgctgggattacatgtgtgatccaccacgcctggccttgcattacgtcttccaagtgcacgccataagacctattccatgctgcagcctcccttctgtcactcttcctatattctgtgtcactactcaaatgtcatttatactgtagcacttatgtgaatatttttgtatcatgtattttatgtacagaaaatttggaggagaaaagaggtgatttttctctactcatcctcctggaaacttctctttggcaagttgctgccactgaccccgctcttcctccccttaatcgttctactggctcaaaaaccataattaagggagccagacttacattaaataaaaaaaaagacaaaaatgtttttcagaagcattccctggaaatgtttgctttaagttgaggttggtggggcttgagcattcatcttgacaataagagcaacgaaagcagtatctctggtagctgatctctctcacctctgtctttacctccaatgactcctcttatttttgtcatcagcaaaatatctgtatgggaggggaaattgctgatgaaatgcttttttgacagttaacaaatatttcctgagtgcacactctctacagatccttggaagggcccatgtgagaagtggattcgtgacattcggcactgccctctccttcaggagtccctcacccttgggcttccgtcaaagactcctgggttcttcccaacagctctcagttaccctcctctttctcccttgggtgatgccctctgcttcctccaccctcagtgaaggcactgcactctcctttcctggctcctggtcctcactctcccctcaccctccacatggatgctgcccagagacactcctccacttcccagctgcctgctggggcatttccactgaaaagttccaccattacttcatgctccatggaaccttcaggagctctcctgaaaagcagcctctttccatattgttcctatttctgatgctccaaggcacccagcctggaagcctcagctttgcctttgccagttccactccctcattgcacacatctggtcaccaagacatctggtcttccaaacaagagcccttcccttcccttttcccttcccttcccttcccttttcccttcccttccccttttccttccctgtgcttcccttccccttctccttcccttccccttctcctgccttccctccctccctcctttctctttttcttcccttccctttttccttcccttccttttccctcccttccccgtttccttcccttcccttccctttttccttcccttcccctttttcttcccttccccttttccttaccttctgcttttccttcccttccccttctctctctccttccttccttcattagttccttccttccttccttccctccctcccttccttccttctctccctccctccctccctctctcctttctctctttcttttcttttctttctttttttgagacaatttcattctgttgcccaggctggagtccactggggcagtcacagctcactgcaacctcaacctcccaggatcagttgatcctcccacctcagcctcctgagtagctggaactacaggcacatgctaccatgcctggctaatttgtgtgtgtgtgtgtgtgtgtgtgtgtgtgtgtgtgtgtgtgtgtgtgtgtgtatgcgctttttttctttttctttttcttttttttttggtagagacagttttcgccatgttgcccaggctggtcttgaattcctgtgctcaggtgatccactgccttggcctcccaaagtgttgggattacaggcataagccactgcacccagttggaaaattctttcctgtccctccctgctgcaactccccatctaccccatgactctgctggttcctaggccatgggtctcccccatctggttcccagggccatttaggtgccctctattgcatgcaggttccattctagtcattttgaggtgtccaagtactgtttggttgccttgagccccctcactttggcatttgatgccttttccaccctctgaccccatccacctttctagtatgcctcatcccattttctagcatgtgtgtcctgccccaggcagcctctgctcaggaaagctggtccaccctctgggcactgttcacacaccccatcaccttggctgtcttccccaacctagacctgctaactctggaatagtgcaataccgcttcctccaaaaagactcccttgaccatgctgcccacttgggataagtagcatctttttttttttttctttctttcctggcaatgaatcactattattaggtcggagcaaaagtaactgtggcttttcccattgaaagtaatagcaaaactgcaattacttttgcaccaacctattactttttcaagtccttttatattgttttgaattgttaagttttcaagggtctatttcattcaatatgtcagcaaacatgtattaagtacaggttgggcagggcgcagtggctcacatctgtaatcccagcactttgggaggccgaggcgggtagattacttaaggtcaggagttcgagaccagcctgaccaacgtggtgaaaccccgtctctactaaaaacacaaaaattagccgcgcgtagtggtggccacctgtagtcccagctactcgggaggctgaggcacgagaatcgcttgaacccgggaggcagaggcaatgagccgagatcgcgctactgcactccagcctgggcaaaacagcaagactccatctccaaaaaaaaaaaaaaaaaaaaaaagtacaggttgttgttttctcagggaatcctcatagctggtgaagtatccagcttttcattttacggatgagtgaactggggtttagaactgataacattttgcccaagttctcacagctagcgagaggcgtgccgcagtttatcgtggggtgggtctaaacaaggacctaaaaactgtattcgaatcccagccctactaccgccagctgtgtgaccttacgaggcgcctcactttactgtttctccaacagagacagacatttcttgttaccgcgcaagtgggataacctccccaccagtgtctagacacagtaggtgctcaataaataggtgtgggtttgcggtggcagaagagcgctatcccttaagtttctgacagtgagggggaaaaaggctaagcagggaaaggaagggaaaggggtaaactgagctcggcgcagtcgagagcgcgaaatagggagggcttcctgcaggccaggaatttggagaggccgaggctgggagaagaaaaatgcccggtgacggcggaggggaggtggaaggacgaacggctccgggaaggggtgaggtctaagcgcagccccgggcccagcggagccgagggcgggtggtgcgggggttcctgggtaggttcgtcccgacgggccgcgggcggattgaagggagggttgggcccgccggcagccccggcgggtccaggcccccggccagcccctgcccctcctcccaggagggcgggcggcgactgcggggcggggcgcgggctcgctcggcctcccggcggcgccgcggcccttgcactccggccgggctctgctggctgcggcgggagctggacgcgggaggaggcggcggcggcggtgagtgagctccgggctggagcggggcggggtgtgcgccggcagccgggtttcggggtgctaggggccgcccagggcggcgggacccccaggggttcgggctcagccaggtgcactgtgctcagtccgcgcgtccactctcggtgacccgcgccgcgcgtgtcctggggctcgaagatgcgacccggactcccgcgccgcgccccgccgagggcaggcgcagaacagatgcgggcgatccctggggaacccgcttcggggcggggtgggagggaggaggccctgcagaacctccctttagtgaagagggactttctgccttcgcacccctgcctggaccctccggctctagtgacagctgggagagactcacacgaagcagtttctgacctatcctgtcgtacacaagtcctcggcgtgctcggccggaccatcccctggaaagaaaggggcgtgtgacctttctctccccgatcctccagaccactgcgccgcccagggaggtcatccccgagagagcccccgcctcactcggagcacacattctagctctccccgggacttttccaagttgcatcactgtttggcctctagacaggtacttggctgtcatgttggagttagttacacaggatttttgaaactttgtatatttgctttgtgtgttcttcaccctaaggccgctgccctcccgactctgcttatgccgctcaaaacgttgctcaaagctcgctgggaatgcttttgcgggcattggttctcaaacttggccccacatctggagagttttaaaaaatactggtgcctgtgtcccactcccagagatctggattcggcttgcctgggttgcagcctggacaatggaatttttaagacgccgcaggtgattctaatgtgcaggcaagtttgaaaacctctgctttgagagttgctcccaccagccactcttcggacggctcaagatcagtcctgatctagaactcatctcaggtcctcatagctcttccctaatccacctctccacctgaagaacctgttgattggtgctttccaactttagacagtagatggtgcctttactgaagatccctttgtttctacctctctgtttacagtcaatactgccagggcactttctgccaaggaggtgggagtgtaggcattagaaccgagcagtccttgtcagggtcaaggttataatacagggttgtcctattcagggaaaaccaagtgataatttgacttgtcatattcgggaatgatttcagattaaaaggagaaaaaatactttagggtttggtcagcttttggagaccctccggagactcccccacgtagataatggagttgcataaatgtggagaattttccttcaaaaagccaaagctaacaacatccttaaggttttgtggttgatatttgtgttaacataagtccatttttgtagattaaacttattctggaagtatgatgaagccctgcagacagaacacagtgtataacatggcacatctgagatgacacctgagacacctgtcacatggtcttaaaaatgatagagaagtaggactaaggaaaatgtaaccatgcttatattggctaaattaggtcatatattttatcaagaaaatgtgttttcactgccctttttagtaatgtgatagtctccggggatcttggttaatttacttttgtaccccaaatatgatgtttgcattaaaatttccaccctgatgttgctacctgaccacaaatcagtggttttaagtttttcttagggggtggccctctatgtgtttttttttttttttttttttttttttttttttttgagacagagttttgctcttgtcgcccaggctggagtgcaatggtgcaatctcagcttacggcagcctcggcctccctggttcaaatgattctcctgcctcagcctcccaagtagctgggattacaggcacccgctaccatgctcggctacttttttgtatttttagtagagacagggtttcgccatgttgtccaggctgttctcaaactcctgacctcaggtgatctgcccacctcggcctctcaaagtgctgggattacaggcatgagccaccgtgccccgcctgtatttttattaacagtgggatgacatccttccaagaatgccttgctgaagtgaaagaacatttacattcatttctagctgctaatgtaagtccaaagaacattcattttgaaaaatacaaaaatgacataattttgcccacttggttttctcgcttttccccaacttccacgaccatgctctgctgctactactgtattcacttgctggaggtgtgcaccctgtgggagccgtcttcattgtcttggctttggcttgaaatggaggttacatgcagcgcattgtcttacagggtgtcccctgacccgaatcatcaccctttggggagcaagactatatggaaagtgttttcctactgttttttttgtgtgtgtgtgtgtgagtgagtgagaccatgccaacaaaatgaagccatattattaaatggtttgttaacttccaaatcttgtctcaattgggaaaagaaaaatgcttattcgaggatgctgttgaattcatggtgtctgaaaagtcacccctgaacagcaatagttacactgtgaatataataatacactctacccccccaaaaagaaaagtttatgtaaatgtgggcctaagcacatttattgcaatttctcactttggagtagcagctctaatatcctaaagtgattagaagaaagtaagtgaagaaaaatatgaagaaagggttagtgagatactttttcatttagggaaaggggatacagcaactagaaaaggccttgggtttgtgttaagaatttattgccctggtggcttcctttttttctttgtttaatttgcttgtgctgatgggtgagggagagttaaagaaatttaatggcctcctaactctctttccccgtgaaacccatttatctaagagatgccattggccttttaaaaatatccaactgattttatgcttttcctttcttttcatcttctgatctcggcactaaagggcggtggcatggctgagaggttggcatcagagcaggaaaacaaagttcaaggggaaaccaaaaattgggtaattttctctgaatgaccaagtgcttacttttttcaggcatgtgacattgctgttatcaagaaaccagttatgacatgaaaatcctgaaaatggaaaaggaaaaaagaaaaaaaaagggaatggggtgggggatggaaatagcaccagggttgactgacctttaccgaggagggaaggcttagtgttttcagcctggtgtcccccgtgtcccgattgcagccccctgtacttctctcctcatgcaccctcctgcatccctcaagccaatatccttgggggagatagtgcttcatcttaaattcacactaaggtgtctttttgtttttgttatttgagactctgctctgtcacccaggctggagtgcagtgatgtgatctcagctcactgcaacctccgcctcccgggttaaagcaatcctccctgcctcagcctcctgagtagctggaattacaggcatgcgccaccataccccgcttatttttgtatttttagtagagatggggtttcaccatgttggccaggctggtctcgaactcctgacctcaggtgatccacctgcctcggcctcccaaagtgctccgattacaggcatgagccactgtgcccagctgttagtagcccctgttactagcaaaagctatgtattacccagagttgttggtaaacaggataaggttcctgccttaaggggcctgagtcaggtggggatgtaaaccctgggttgcaataagttaggaacttttctaatcaagaggaacacagtggcccgtggggtactgtggggcacctggctagcctcgcctgggtagatgcctcctcaattcattggcacaggaggcataagacatgctttacttgggtttacattaaagcttattctattaggcccgtaccccaaatgactgattttggaaatgtccgactccaggagcgagaagggtgcaggtatccatcatgcaaaggggaggtgggaggtggaggaagagaacagattctggcaggtgtcttttgcttctggagtctactgaacaggggtacttcctgggagtgggaagctcatggagaatgtggctggatccatttttggcacattagtaactggtaaagtaagcttagtagcggctacctccgcaacagagctgaaaggagaatgcaaagtgcagtgtgaaagccgcagctgcagcactttttggagcaagtggttgggtttgtatctatggctcctgccaatgggcagacattggttcctcatcataccatggttgctgtagctcaggcttccttgggcaggctgaaaactggacttcacactgtttttcccttgggtaggtggtttccaaatagctgacccatagggctaataacctcatggttataatagttactatttgtttattgactgcctttcaagtgccaggtagcatgctcagcacttttcgttcattactgtaaaccctttacattcctgagaggcaggtggcagtgacctcattttacatatgaggaaactgaggcccaaggaggtgctgaatcctgcaaaggtgcatagtagttgacagtggcaaagttctcatgcctgtaatcccagcactttgggaggccgaggcaggtggatcccttgagcccaggaggtcaataccagcctggacaacatgctgaaataccgcctctacaaaaaaatacagaaattagcctggtgtggtggtgcgtgcctgtggtcccagctactctggaggtcgagatgggaggatggcttgagcctaggaggttgaggctgcggtgaaccatgatcatgccactgcactccagcctgagtcacagagtgagaccctgtcttaaaaacaaacaacaaaaataaaatggcagagttgaagttcgagagtactctggtctgtctgaatacaaagctaagttctctctactgtttctcgctcctcttaagctgagctgattaagaaattgtgttctcagtgccttgtttattttttaacatcacagtctccttaggtctgaactgatttactattttcctctacctcgtgtaaataggaattttactattttcctctacgtgaggtagaggaaaatagtaaatcagttcagacctaaagagaaagtattccgctaaaggccactgcgaccttgtgatcccaagggaaatttatggactgctgcttttctaggtgtcttaaagaagagggtagattaggctgtgcagaaagtctctgaacgggtcccacatcctaggttagagagacgtgatttccacccttcttcaagttctgcaaacctctgagtttctgtagataattggttgttgggtaagagattaaaaacaaaattcagcgttgggcattctagaataaaacgaagctgtgcacatccaattcctgtttatgtggtactcgcgacaaaaacaaaactttgctgcatagtaattacctcaagctcttaaaattacaggtagtaagggcttagaggccatatggagttataattagagatgagtttaaaaaagggctagtgaatgaatgttcattactacaatgagcactagctgaatatttcaacccgagaaggatcagctccaaggaacatttccagggagttagcggagggtcgtcatggagttagagtgtttgggattagtgcacagagcatttgttatgaacgtgcaatatttctgccagcctggccagaagcctctttgtttacagggcagggtttcttccctgctgcccaatcacagggatttctgctttgctttggtagagtacgtaatcgttcaggtgattgctttgtagtgtgttaggtctgtaaagctcctcgactgttaataatcttttcctgttacttatctctttgctggaagattgaggtaagatgacctctagttttggcctcaagaattctcttgtttttgaccttttcccttagttttctatctttgtgtttcattgcattcaaaacaggccctctgttttcccttgcaaatttatagtccacatagggaagaggaacgactgtgaccaggactatccaggaatcctgtgatgggagtgttgttagtcccattttccaagtgaggaccccttcctctctaaggctgggagtttgggtattccaactaggactgttaaactttcaacaatggggctcttttgacttgattacaaaagaaaaggaaatggcccagttttcaaagtcatgaagaggttctagtatatcttatgaactaatatatatccttgaactcttttgtagctgacagtattaaaaaaggtttgattccccaccttttttgcctgtgtggtttttatcttcctttctataaacaatgacttactcagaattatacagcagcagctgaaaagttgattagcctccgtccttgccctaatcaagtatcaaaaacctggaatgttcacttagagtggtgattactgtgaaagctttaggtgctggagaggacctgataaagaatggagtgagagataagagagagagagaaaatagcttgcaaagggattgcagggtggagtttaacaaacttaagatttctttcttcctttttttttttttgtttttttgatacagagttgcccagccttgttgcccaggctggagtgcaatggcacaatctcagctcaccacaacctccgcctcctgcattcaagccattctcctgcctcagcctactgagtagctgggactacaggcacgtgccacgacgcccggctaattttttgtatttttagtagagatggggtttcaccatgttagccaggatggtctctatctcctgacctcgtgatccgcctgcctcagcctcccaaagtgctgggattacaggcgtgagccaccacatctgccttttcttttcttttcttttcttttcttttcttttctttttttttttgagataatctcactctgttggccaggctggagtgcagtggtgtgatcacagttcactgcagcctcaacctcccagactcaggctcaagtgattctcccacctcagcctcccgaggagctgggaccacagatgcaggctactatgcctggctaatttttatgtgtgtgtgtgtgttttgtagaaatggggttttgccatgttgcccaggcaggtctctaattcctgagctcaagccatccacccacctaggcctcccgaagtgctgagattacaggcgtgagccaccgtgcccagcccaaacttaagatttcttttacttgtgagtttcaggtttggggcttaaatgcatttggtctggttgtggccagactagctcagccctaacagtctgtgctgccttgggccacctataagctttggggagtggggtgggtgggttgggaggagaaggtagggtgaagggagaggggaaatagtgggtaggagataagacccaccagttagctgattctccaggcctggcttgctcatggcatgactgcttctccctgcaggcctgagtccaactttctgggtgtgaggcagctggatggggtacaaaagagggagagagttgccagacactttccaggagacctgcccaagatcagtaattctcataatagcaaatgctcccatagcatttgcctccagccccatcctagagcttttactatagcaattctatgggataggtgctatcataaacccattttacaggcgatagaaacaaggccacgggaaattgggtaacttgtcaaagtgctgaaatccagggttgaaacccttgctgtccggctctgagctatgctaacaactaccacctcattaggcatagaggcctggatgctgcacctgctcttcattcattccttgaactcacccacgtatttcttcaacaaattattgatagcctgtatatgcctttatcttggcaatgagaacaacataagtgctctttgtttatgtgtctgaattcccataaactttattttctttcttttttaaaaaaattgccataaactttcaaacaaacctttaaagagacgagacctctttactgaccttgtatacctggtgtctggtagaaaataggtgctcaataaagctttgtggaagaaggaagaaagacagtgttttgaaacttgacatccttgtatttcctctgtctctagcagccacagtgatatctaaacagaaaaacagacaagccttaagtaaagtgagagtgtgtggggagtgttttgcaaaaataacaggagagaatttttgataaaagcatgctgtcttgtatgcatttcaagttctcatggtgaatcattttttgcttgtttgcttaaagcatttcttatctgaagggcatcccgacacccagcttgcagactactgagtgaatcagggaggcccttcagacttccatgcattgttcggggctgctcttgtcatcagggtctgcagaatatattttctttgcagttgaggaccaaatacctggtaaggttcaagtccaccatccattttcctgtttaacatttaaatgcatgagctagtagaaagtagtttcaccttgggctgggtgaagtggctcacgcctataatgctagcagttttggagtctgaggcaggccgatcagttgggatcaggagttcaagaccagcctagccaacatggtgaaaccctgtccctgctaaaaatacaaaaaattagctgggcgtgggggcgcatgcctgcattcccagcttggcttgaacccaggaggcggagattgcagtgagctgagattgtgccactgcactccagcctgggtgacagagaaaaataaagtagtttcatctcctgtattttcattccttcttcacactgtggggcaaagaaaggtctcattcacttggattggaagctctatttgacgatcactaggagtgatggctctttggttcctcttccatttcaggtttgtttcctcctctgtaaaatagatgtaatgcctaccccatacagtcaagccatatctctttgacatagtacagtggttctcaaacagggtccccccaacctccccacccgggggtacatttgacaatatctgggggcattcttggtagttatgactggggtggtgatggctcctggcatctaatgggccaaggccaaggatgctgctaaatatcctttgattcaaaggacagtcccccacgggaattatctggcttaaaatgtcagtagagccaaggctaagaaaccctgacaaagtggaacctcaaacaacggtagctctttttaacatctctgatccaagggagctattggccagggacaaagatccctcctttcttaagtagggtggaaagaatggaatttaacgttttattgatgcctctgggtttccccacaggtgcccctgaggtgggaacacctccttttctctccattaaacatgacttaacttcatttgaaacttgcttgcatcgtttacatataaatagccatgctaaaaccagtgaaaccacttagcctgtggggtggttaaacccattccctgcagaggacattggtggagtggggcctgtgctgctacaggcttgtgagcctcgcttttctcccctgttaaagggcagataggtaattgtgtcaccctcccatctcgtcatgttgctctgactctgcacgtgtgaaactagctctacgtatgtgaatgtgctgtgtgattcctaaggtatgccttttgaaggcatttttcacgggatccgtttcagtcaaggacactaaaatggttggggctcaacaaagaatatctgtgttacgggcatagtaggaggccccccaaatagttcctgcagcagggtgtgtgattcgggaagcagtgtggcccagtggttgacagcatgaggtcagccactcacaggctgctctgtgtacaacctttggcttttcccgtgcttgttgtgtgaccctgggttagctacttcacctcgttgcacctcagtttcctcacctgtaaaatgaggataacgacagtgacgacgataacacccagctgaagatgggtgcgaggcttcagcgactggtccttgtgaggtgtgcggtgaagatgggagcttagctcaataaatgagttgctgttagtaaaatactatttgatgttggcttgtagcttgtgtatttttactcagatgaagagcttgctcctgatttaggagctgaaaaaggatctttctggttcttggtattttttttggtggcaaaatacagcataaaatctccattttaaccaatttaaagtgtacagtgcagtggcattaagtacactcacaatgttgtgcaaccatcaccactatctaattccaaaactttttcatccccctgaaaggaaaccctggacccgtagagcagtcactccacgttcctcccttcccccagccactccctccctgcgagcccgctcatctattttctgtttctgtggaactgcctagtctagatatttcatataaatgtatttcatgcaatagatggccttttgcatctggcttctttcacttagcataatgttttcaaggtgccatctgtgtattgtaacatgcaccagcacttcaccactttttacctggtgtcttttttgcagagcaccccaagcctcagtgtcatcaggcctgtggttctctgaagtcatgccctgttttcaagttttaaactgtctttcttcattgattttgatccttcttggccagccttattttttccacttttcccatccagtacttctaatgacccttgaaatgaatgtggaatgaagccctcatgccaggttcttggtgctggggaataggtcttattaggtatcttacttctgtgaaagaattagcagcaggagcacacataggggccctgagtggtgcttcatttccccatgactctgcgtgacaggttttaaaaacaagtgtctggaaaacaccaccaggccccttttattcatcagtttaaaagcttcccacaatgagaagtggccctcaattaagtcgtttaataaaaacctccccctgttttaaagcattcttgggaagtgtttacatttgacgccactgcaggcttctaaatgaggagctgtggagtgagtgatccttaacctgtgactttaataatatcctttgctttagatttccaggtggaggcctgggccagatttgtagcttgtcattgacccagactgggttcagagatgggggctgggcagggggtggaggacattcttggctatcctgcccccctcagctgccactagtagaagattcagaaaggctgaaagccacatagatatgtaaaaccagctccttggagagagactggactggaaggaggtgaagcatttccctacctgggaagggcagttaccctgccccacttctgaccttatctgcagtgtcggggggcttcagtgggcagagattaaagcatttaggagagcagtgccaggctcctgagattctggggccttagggtctgagagctggaggaggctctacttttttctctgattctggagaggtgagtaggccccgagaagaggaagcaggctgctttagcttcagggaaaactccggagttgtcattagaggagtcctgggaaaagctaaaataaagaaaattctagggtggtctttcctttgtgctggacgaagacaggagggtgaggggagcccggagctgctgacacgcactggtgatttgtagaggttgccaaggtgggcagttagcagtctggattctgggcctggactgcccggatctgaatcctccctccggggttctgttctatgaattcttgtgtgtccagtgctcagagcagtgtctgcagaggtagctgtagatatgtgtgctcgcacgactgtactgacacttcactttggtgagtttctggttagaatcatagaaatgcttcttgttatcagagctaatttgcctgcatacctggcagccttgtgcagtccatgggacagggtgatgttactggactctgaagaaaacatgactcgcagatggagaaattatgcttggcaaatctattaaagttctccgagggagagaataaatgtgggaagaaggacaaaccagtggatctagattttatttagacttccaaaagattgttggaaagacttcatggcaaaggctattagatgtgggagtctcccatgactttctgagtggaggtgaatggaagaaggagtctggctgaaatttgtctttttccattgtcctttagaggaggaatcttcacatttgcagatgaaataaaattctaaaggtaaaaatgaagacttcggagtcaaactatagagaggtgttttttttttctttttaaatttaaattttgggcacgaggggatgtcaactaccctttaaaataattcgtgatcagtggctgcacctgggcagctgggctttggaactaggaatgatgtgtgtgctgctttctagcaaagttaaaaatcatgtgcctggggcatcagagtgctcaggaaataaatgaagattagtggaaccaaggagttcattaaaaatgattcaagttccactccagcctgggcaaaaagaacaaaactccatctcaaaaaacaaaaaacaaaccaaaaaaacctgtagtttccaactgtcttttaagtgaatagtacatttgtagaaaaagtagattctgctatcaacaaatgtaagagttcacttaaatgcacagatgttgaatttcatgccttttgtgttttaacccaggatagtaaatgaatgaatgaaatgagcagacactttttcaacacagacccttccctctcgcccaataggatttaggaagcttggagttacgcttgaccaaaaagacacgtgcaggagttagttacctttgtgtttttctttttactcagtgtcctgtgggccttgcctggtgccttatgtataggagtgctctgtatgtgtttgaatgataaatggactcagatttccttaacataagcgtaaatattttatcatcgtgtgtcattatgtgccaggcaaacttagttatatttgctcttacaatggttgtattggatattgctgcttaatattgccgtgtaacaagcaatcccagatctcagttttttgtttttgtttttttttgagatggagtctcactctgttgcccaggctggagtacagtggtgccaccttggctcactgcaacctcccacctcctgggtccaagcgattcttctatctcagcctcccaaggagctgggattacaggcacgtgccaccacacccagctaattgttatatttttagtagagacagggttttgccatgttggccgggctggtctcgaactcctgaccttgggtgatccacctgccttggccttccaaagtgctgggattacaggtgtgagccaccgcacctggccccagatcccagttctttatgaccacaaaggttcattttcccctcgctcagctgttggttgggtgtggtttggttgagccaggctgtgcttcacttggccaagccagactccaggcttccatctgggttgaggtctattccacatgtgttttattcagcagcccaggctgcaggggcaacaaatatgcagggccagcttgccttgggcagattacagaggcataagaaggcaagcagaaatgctggaagcctcttaaagctttggtctataagcagcccactgtcagttctgccaagattcccttggccaacacaaattgcattgtcaagccccacatcagcagggtgaggaagtatacctggccagttctagtaggaggtaactcgaagtcatatggcaaagaaggtagatgtatatggaggagcaaagcactgagaacaataatttcattcacaatggtagagaatgaataagacggaagagagcagtttgggccaaactagccttttgggagcttgcgagacctaggctgactgggtgaaaaatcatatgcatttggtgcaggtaccagcccaggccttggcatttcctgtacattcgctggcatgcgctgcctctcggctggctggacattgatcatatcctttcactgcgatggggctcgtgggagtgctgcctatctgtgggaggagcagaaggatgggcctgattttcttcgggttagccatcatgacctgacaggctgccagctgtggtggcaggagtgtgacaagctgagagggcaaagaggacaaagaaggaccacagtgttgaaggaggccaggggcttgcctcagcctaagtcccacctgtaatagtcagtgacaggttagcatcagtgcctgtgtgtaccatgtcccaatcttcataaggatcctaggctgtagcttccagaccctgccttttacatccaaagaaacaggcttcaggaggtgaggtgacttgtcttcagccaaccagctcaaaaatggcagatgagagccaggccaccctgttcccagtctagggtctgtctttccacaccctgtggttgtcatagtctagcagagtccggactggtgttgtgtgttatagtatattctggccctgtgatgacagagtctgctttggaagaagccatgtgagcctcgtgcccataagggatgacataggcgaagcagaatgagtgaaatactggccaatgataagcagccttgctgttactgctttgcaatgggccatttctttagtgaagagctgctagactttgaggaagaaaaggctctagccacttgtgaaaatgaaccaggaatagatggggaccaaaaccttgtaaagccaagggtgtgaggagacagacactctcacatgtgctgagtgtgggattataaattcactgggcttctatctagagagcagtttggcaatggggctgcttttacttgcaagtaaacaaaactcagttgaaggtggtttacataagaataaaaacagcaaaaagtggttaaaaagtggtttaaataagacatttcaaaatgacatttgttacctcatgtaaacaagaagtccaaagtctgggctgttgggggagttagtttgaagacccaggcttatttcctctttcctcgcctcagtgtttgatgtttgccttcaagcttgtttcctcatgatctcagtgtggctgttgctgctccacccatcgtatccttattccatatccttattcagagtgatgtccacaggcaggaaaagaggaaagaacagaaaagatgcaaatcagcatgtattctgagatcccatttttttgttcgcaaaaataaacaccttcacatttttctttcccccccctcacctgacaccatcacaataaaagtcttaattttttcagcaccataagatggtgaaaaaaaagtcttaatttttgattgtgaatatcaatttctggaaccaagaattttggttatttctgggccatgggatggtgctgtggttttgttttccatttcatgcccttcttggctgtttgaattttataaatatcactgcatgtattacctttataatacaaaagaaagtgataggtgttttcttagtaggggtgggagatattaaagagaggaaaccaaggccctaacaggggcattatctgagacatgatgtgataggataggagtgcatttagctgtgtgtgatcagcctagagggaggttggggaaggggaaaagtccaggagtgaaataaggtcattttaaatctcttttggtacctggcacagtgtcttctacctagtagagacaaaaactcatttgaagtatgaatgaatgtttaggtcaagacctaacacaactttatgaggggctgaaacccaaccaagcagctcaagtcagcaagaaagtacattctgctggaaatttatcttgcaaagaagtatgactgtcatttcctaccttttccttgagctcccagaatctaattcattgctaaggaaacagtgtaagtatgagaccttctgttcatcatctgtctcctactgaaggctattgtcccaggatctggataataaagctgtataaggtttttacaactgagggtagagcaaaggcaagaaaccaccatctcatgttaactgtgttaatagtctgtggcttgaatggagtctagatgtttaaagtctactaagtgtagaatgaacagtcatttttttttaaaggaaaaataaagttctttgataccctggactaatacataaaaaattgttatcttaatgatgtgacacagataacagttgtgagatagggattttcaacctgattggccagtattagtagaagagtgtgaatatgcctgttggtgagatgaaagaattatatgtagtggtattttcaagtctaattctcttccatatacaaaaataaaatgggtattgaaggcctttttaatggcaagggtggaaggaggggaggtagagtactacccttacattgtgccatagtcttaattcccttgctccagggttctaagtttgatgctcataaatcaaaagaaagaatgttgtaactgacatttctattgagttacttttaacttttgtacccttgggttttagcattgaggccttctgcaatggccaccggatacccactttattcagacaatgataatatcgttgagctatggtaagatcatttcctttggaacaaaatgaaaagctttcagtgttcacaattggaggaaaatgtaaaagcttagtaggcctcctctgctgcagggtgaagagtttgtgtttgaacaccatccactttgctcctcaaatgtgcagtggaatgattccagtgtgcttttgaaatacagaaaacaagtgtaccttttcagtgtgtgtgtgtatttatgcatgtgtgtgtttaatgggttcttggaaatacttggaagaaaagtaatatttaacatctttttttgggatcattttgggatccaaagaatctgagatcattggtacgttatgttccagagtagccccgagttaaatttcttgagagagagagaaagtgcatgtgtttgtgtgtgtgcataagtattactctaaagaccaaatgtcatgcttacttgacatgatcttagtatatatccttatctgcttctcagtctatattatatctgcagattttgtgactaagtggtgtaattttacatgaattctgcatctgcatcagaaagtatgataacaattaatgatactaacacttctatgtcactaaacagtgcttgatactgttctaagtacttaacatgtattaactttttttttttttttttttaaagccaaagccttttgtcacccaggctggagtgccatggcacgatcatggttcactgcagcctcagcctcctaggctcaagccatcctcccatctcaacctcccgagtagctaggaccacaggcacgcaccaccaaaccagggtaatttctgtttgtttttttttttttttttgagatggagtttcgctcttcttgtccaggctggagtacaagctcatgttgcccaggctggagtacaatggcgtgatcttggctcacggcaacctccacctcccgggttcaagcgattctcctgcctgagtagctgggattataggcatgtgccatcaagcccagctaattttttgtatttttagtagagatggggtttctccatgttggtcaggctgctctcgaactcccgacttcaggtgatccacctgcctcagcctcccaaagtgctgggattacaggcgtgaaccaccatgcccggcttatttggtttttatagtaacgctattgattccatttttaccaaggaactgagatacagagagatttagtaacttgcccaaggtgacataactagtaaatggtgggggtaggttcaaaatcaggcagtttgctatttcttatttaaagccacaattcatgagaattgagccattctcaaatgtacaggttattcttgtaaattggagactattgtatcagtgttacaaatgacctattgtaatctcccatccaagaactaaccatttctgaccctgcttagtgtcaatagtcaggtgcattcagggtggtgtggctggagatgatcttatatgatctgagccccttgcttcatgaacaatattttcagttactttacacagtaagcacgtacttaaacaattatttggctgggcgcagtggctcatgcctgtaatcccagtactttgggaggctgagatgggaggctcacttgaggttaggagttcgagaccagcctggccaacatggtgaaaccctgtctctactaaaaatacaaaaattagctgtgcatggtggcatacgcctgtagtcccagctacctgggggttgaagcaggaaaactgcttgaacctgggaggcggaggttgcggtgagctgagatcatgccactgcactccagcctggatgacagagtgagactccgtctcaaataaacaaacaaacaaaaaccccaccaaaccaaaaaacccaattattttaattataaatctgaactgcattaaaagatagtaaatttagctagtcaacttgaataacttttaacagagagttagttgtctcttctgtttccttagggaagaaagatgagttcctt

SEQ ID NO: 902 - DNA, 136485 bp, Homo sapiens
tttcaggaagcactgaattaattatttccactcaggaaaagactatgttggagtccattgctgcttctcgatcccaagtgaactccaggaagaagcaaatgaaaagcaatcataggccgggtgcggtggctcgtacctgtaatcacagcactttgggaggccaaggcagatggatcacctgatgtcaggagttcaagaccagcctggccaacatggagaaatcccatctctactaaaaatacaaaaattagccgggtatggtggcaagtgcctgtaattccagctacttgggagactgaggcgagagaatcacttgaacccgggaggcggatgttatagtgagctgagatcgtgccactgcactccagcctgggagacaagagtgaaactctgtctcaataaaaaaaaaagaaagaaaagaaagaaaataaaagcatcgatagtgtatatagatcaaaggaggaagggacattttccttagaataaaactttaataacgaaaacaataaactccctcctttccactcgtagaatagtcaagcactcatttctcatttgcttctcagccatcagctgtcctaatctgttatctattacgctgtgtaacgaaactcgtcccaatctagtagctgaaagcaacaaccatttattatggcacatgtctacatggtggctgggtggttttggtgatttgggcccaggctggctgaatccaggtgggcttgttcagtggtccctggcagttgggttgggggctggcctgtctagcatggcctcaggtaggaagagttggctctgctccacagactgacccgtgcctgttctcttcctctggcaggttagtccaggcttgttctctcagtggagacaggggtcctacgagaagagcagaagcagtaaaggcctcatgaggcctggacttaaaggacacattgccagttccgctatattctgttggccaaagcaggccagccaagatacaagcggggggagaaaatatgctctaccttttaatgaggcattgcaaactcacattgccaagggtgtggatacagaaggtcactagttgtggccatgaatgccatccatctatcagacctgccaacgtagtttttcttttaggggcggacttagtccgatttcagacattagtaaaactgattcggattccatttccaaattcctaattccaagagaactggaaaagcagagcgtgccaacctcttataatccttcttaatgtgacaaatgtttctacagcgtccactgagccaggctcagtaggtccctgggacatatatgaaacaacagttctcctgccctccaggtgctcagcacagcaggagaatcccggctgggaacagagagcaaagcgaccacatagctctagtgggaatcctggggaagtggtatgtggtcttgaatagtgacttagagttttccagaaagagaaggaaggggagttcattctagaggcctggaggatgtaaagatggttgtgttttcatgaaaccgagctgtggacacaaagggcaaggccaaggttgcaaggggccttgcccgactctctgtggagagaggattttattgtgaagggtccacgaagtcaccgcagggcttcagctggatgagtgtgctctgcttggcctgttggaaagattgctggggcagcagggaggtgaagaggaagctaaagatagggtgaccagttgggagactatttccagtccaaatacatcctcttgggtttgagtttctgtgaccgtcctcctgctggctggaactgggaggtcctctggggtctctaaacgctctcagttgcttgcctagagttatgcaagcgggcgtggggtcggggcaggaccaggaagctttgcgctttctgctcttggctgatttcataacaggttagcttttaaacttctggctcattccagacactatgcctctggccctgggagagaacttggtctcccagaccgcgcataacatttccactttccggcaaacacagtctgtgcgtgatcaggtgaggctggcgcacacaaatccttgatgtctagaccgcctttctccagctgctgtgtttactgcagaaaggttccatcctgggatgatcgcctggggggagttttcttcttgcgacacctagttcagctctgctgagcttttggattcccagcctttctcccaccacaacccggtggtcatgaagtctcacaggaagtgtggtaggcacaataatggtccccaaggatgtctaggcccccatccctgcaacctgtaagtgtgttgttacacggccaaggggattgaattaacagatggaatgaaggttgctaatcagctgactttaatacagggaaatgagcctggattatccaggtggggccaatatcatcatcaaggtccttaatagtggaagaggaggcagcagaggagcgcagagtgttgctttgtgagaaggacccgcccagcgttgctggcctttaagatggaggaagggggccgtgtggtaggagtgtgggggcctcaggagggaaggaaattggctctcccaggagcttccagaaaggaatgcacccctgctgacactttgattttggccccagtgagcctcgtgttggactcctggactacggagctgtaagataataaatgtgtgctgttttaagccagtagctttgtggtaattggttacagcaggcatgggaaagcagtgcagggtgtgtgagctgaacccttgaagacggggttctccactacgtccccagtgtggagcacaagctggctctatgcccggtgctcggaagcattttcagaatgaacaggactgactgagatgaagccgcagacatctgctctctccaggcccctatctggctgtgtgaccataggtgggtcccttcactttcagtgactatgttcccatgtctcttaaggcagttgatgacctcaagggtgggtgacttttgaagtgactctcagatgtgttaccactggagccaccgccagatctcctgactctcctctctctgactggtctcattcttagtctaataccatcattctccaatgctaaggtcattaattagcaccccaggccctcactgactctgctctcaccctgtctctggggctccctgcctacaggttcactgcggaggtcatggtagacgttgctgcccagaacctccaaccgtaggaaacctctcctccttattctcagccatgaagtgtgggagcaaaactgctacacagttttgctcagggtcagacgctgggacatccccagggcctgtaatgctggtctcaccagagctttgactgtgaatgctgcttttcctcatagcagtgtgtggcccctaaggtcccctattcaatgaccagggacaatcatcaaatcaatgcaaagagaaaatgaagccttgtgtttctatctaacgggtgagctacactggaagtataagaagtacttatggggaaatctgctttcctgactcttacttctgtttccagagggtgatataatgtgtgtaaatgcagattcagcttcgaggaaactttcgtctaataatgaactgaaccacattatggcatgctatctccaaggtatgatagtatctgttatactcatggggtccaaattttctttagcttagaggttattctactttagagcaggagttctctattttggccacccactaagaatcactcgaggggagtatttaaaaatccaagccaggctgcactctagagccacagaatcactgggctgaaacagttccccaggtgacgctgatgtgcagcgcgggttgagaaccactccactgccttagctaacactggctactcttgcctttgcctttgctatttacaaaaacaattattttttagtatctaaaggccaacatcaataaacccttacttgttatactagaagatgctctgtcctcattgacctgagtcccatcttagtggggcttattataatgacccaggcacgtgagtctcatgcaaaccagtggggcaggctcttgggagcagtggcttctgcattatgcctggaatgcaggaatacatggggatcagtccgactgacaaatgcaactcacccaaagtgactatgaatgactgcaagggcatctgggtacagcagtgggactgtagttcaggtcagggatctggtctctggtgttggccctgggcagggagggagctctaacaggaaccgaggcacccagtgtggtacctgcagtttccctgacccccactgcaatccttcacccccgggctccccttggtttccctgcctcacccacagtcattggcctcagctggtaaagggcagcttgagccagtgcgtcctcggagcgttagtcccagccagtttttgctgactcctctcccttcccagctgccatggcaagtgggtgcccagtcccacagcagcctctctttcctaagtaaaatcccacgccccgtggctaactgttcacaacctgaaggaagaaatgttctactttcaaaggaaaaacagccctccttccatgtagctcgccagctgcccaccgctagccaggtgtcgcttgcaatccatggacaccgttcccgtagcaaccccaggtgactgtcacagctgcccctgacacaaactgctttagcaaaggggtgtcaaaaaatattttaaaaacaagttttaaacacaatttttagggagaaatcaagagggttctcaactgaggtaattgaccgacttggtgggggttcagtccatgaatgtagcttcactcttgtggctattaatggcagggaggtggggggacagttggtataaaggcaatgagactacatatcaagatggaagggggcatcctaggcttggcatggtatttggaaaccttgactagccttttatgcccaatgctgtttggaaatcttgctgggaatcacagaagctatagatgcttaatggtgtcagcactgatatgcgccaccatcagcttgaattacatattaaccacccatctgcatttaatccctatacctggccatcttctgatgagacgagctatttcctctctctcctctcttgtactctccagtggataagtgagtttctctccatgccttctctggagtgggctgtttcgcccactggagggggattctcaaggtctccaccactccttggaaaaatggggtgaggactccagggctgggaaagggaaagtgtaagatgatcctgaaccagcttatggtgcctggaagtaaggaaatgctagaaaaatggtgagaacatgtcagaagatcacaggagccagcttgaaagggctcaaaacagccaaacctagggaatctgagcaataagagaaataataacagtggattgtgacctgtagagtacaatggatgtattctgctaagtgagagaagccagaccccaaagtctacatactcaaatccacttatatgacattctggaaaaggcaaaactataaggacaaaaaccagatcagtggttgccaaaaataggaggtgtgggggggttgattaagctgtatgagggattttgggggctgatgcagctgttctgttgcatgactgtggtgtagatacatgactctacattgtcaaaactcatagaactgcaaactacagagagtgaattttactgaatgtaaattttaaaaaattaagatgtttgggagccccaaatggaacccaattacaaataaacccaaccaggctgggcatggtggctcacacaggtaatcctagcactttgggaggccgaggtgggcagattgcctgagcccaggagtttgagaccagcctggggaacatagcaaaatcccgtctctacaaaaaatacaaaattagccaggcatggtggcgcatgcctgcagtcctagctactcagggactgaggcgagaggatcacttaagcctaggagattgaggctgcaatgagctgagatcatgccactacattccatacattccagcctcaatgacagagtgagtccctgtctcttagaaataaaaaaaaacaaaagaacccaaccataatacagatgaataacataaccacactgaagggggtagggaagaaaagaaccaacctgagtacccagggaaaatagggttttgacttgatacacaaatactgtatggttaatacacttctcatgggcggggggtggaggttaggaattctgcaactactttctgtgtatactaaagctgaaaaaataggtacagctgacccttcaacaacacaagcttaaacttcaagggtgcacttatccaaggattgtctttcacttctgccaccctcgaggtagcaagaccaacccctcttctttctcctcctcagcctactcagtgtaaagacgatgaggatgaagacctttaggatgaccaccttctacttaatgaacagtaaatatattttctcttttttatgattttcttaagaacatttcattttctctaactgtattttaagaatatgtaataaatacatgcaaatcaacttatcagtaaggcttctagtcaacagtatgctattagtattaatagttaagtttatggggagtcaaaagttatatgtagatttttagccaggtgtggtggtgcgtgcctatagtcctatctactgggaggctgaagcaggaggattgcttaagctgaggagtttgaggctgccatgagctatgattgtgccactgcactccagcctggacaacagtgcaagactctattaaaaatttttttttaaattatctgtggttttttgattccacataggagtggcatcccaaccctcacattattcaagggtcatctgtaaatgcattaaagatgttgagagccaggtttctcaccgccaaagaagttacaaataagaggaaggggggctacaatgaaccctgtcatgttggattggaatctgagctatcacagtatgaatttgttttttaacattttatgtatatacagttacagaaatatagatgtgcatggcttagtatacatatgtattatttcaagctctgttctctatgaggccctagaagcaatgacatccagtgacaataaacacactcagtgcccagatttttgtttctaaataaaaggaaccaggcctccctggagcagtgattgattccaggctcctaggcagggaaaacacaagaagagcctggaacatcttgaaatgcaagaaagtaaggaagtgctcatgaaaggatggggcaggtcacaagtgtgcaggagccaacctgaaagagctccccgtggccaagctgggacaatttgagcaataaaataatgatggtattataatccataaaataaatatccatgagtccatactcatataaacaagcaaacaaatagatgagaaaggacagtaattctccagatagaatttcaattacttataataataaatgaggaaatcatgataattaatgagggaaataaaaaatcaccattaggcaaacactacagtaataattattacaggcacaatctactaatagatgttaagatgactgggcaaaaatttgaggtgaatcaggatatttgcatagccttaaactatctctcccaagatatttattaattacaaaggtaaaaatagtaactttacagtgaagaaacccagcagacacaactttaaccaggcgaccaaggttaacatcaccagtggcaggacatagcagcatcctatcccactaacaatatgcattgagggtttattaccttggtgatattcttcgaaggatggataacctacatttaatcttgagaaaacatcagataaactccaaatgagggagattctacaaagtaactgaccagtactcctcaaaaatgtcaagatcatgaaagacaaggaaagatagaggaactatcacagatgggagaagaccacagacctgaccactaagtgcagtgtgggatcctgagtggctcctgaagaagaaagcagaagttagataactagatagacaattagtgacaatttaataagctctgtcagttatatagtagtattgcctttatgttaatttcctgatttttttttttttttgagacggagtctggctgttacccaagctggatgtggtggcaccatcttggcttactgcaacctccacctcctgaattcaagcgattctcctgcctcagcctcccgagtagctgggattacaggtgcgtgccaccatgcccagctaatttctgtatttttagtagagatggggtttcaccctgttggccaggctggtctcaaactcctgatctcaagtgatctggctgtcttggcctcccaaagtgctgggattacaggcgtgagccactgcgcccgaccagtttcctgattttgatctttgtactttgggtgatgtaagatgtcaacacttgggagatttgggtgaaggattatgggaattctttatactacttttccaaatttttttcaagtctgaaatcatttcaagatgaaaagttgaaaaaaatcgagggtcagaaagtacatagtatgcttcttttccataagaatattagagaaataagtatttatattttattttaatttgcttgtatttgcttacaaaagcactggaaagataaatgagaaattaataaaaactgttacttatgggcgaccagatgaggaatgggtggatggggcagagtgagagtgaggcttctctgtgtacacctttttaaattatgtaaatgtactatctatcctctgtctcaaaaaccaaaaccccaaaaaactaaatcaccttatagttcataaaggcaaagatattttatttcatagtttctcacaatgaaataaatagtaattatcctatgaggtagttactattattatatcattaccattttagacatgagtaaatgagggcatatatgtataaataacttattcaaagtcattagctaatgaggccgggcacagtggctcaggcctgtaatcctagcactttgggaggccgaggtgggcagatcacttgaggacagaagtttgagaccagcctgggcaatatgatgaaacctagtctctactaaaaatacaaaattagctgggcatgatggcaggtgcctgtaatcccagctacttggaaggctgaggcaggagaatcgcttgaacctgggagatggaagatggaggttgcactgagccgagattgtgcattgcactctaacctgggcagcagagcaaaacttcctctcagaaaacaaaaacaaaaaaacagtcattagctaatgagaccccagaacctgcacagggagattaccaacagggaaagcagatttcagaaaatgcagcctggccaacatggtgaaacctcatctctactaaaaatacaaaaattagctgggtgtggtggtgtgtgtgcctgtagtcccagctacttgggaggctgaggcaggagcatcgcttgaacctgggaggcagaggttgcagtgggctgagatggcgccactgcactctagcctgggtgacagaacttttgggaggccaaagtgggcagatcacttgaggtcaggagttagagaccagcctgggcaacatggtgaaaccccatctctactaaaatacaaaaattagccgggtgtggtggcactggcatgcaatcccagctactcgggaagctgaagcaggataattgcttgaacttgggaggtggaggttgcagtgagccaagattgcatcattgcactccagcctgggaggcagagcgagactctgtctccaaaaaaaaaaaaaaaaaaaaaaaaaattcagaaaatggtatggaaaagaaaggcatggtcctatggccagagacttgaaagggagttccagaagaaagaaaacttcccactgtcttagtcagcttaagactttgtggcttaaacaacagacatttatttctcatgcttctggaacctgggaagtccaagaccagggtgctggaagactcaatccttgataaggtcccactttttggcttttagtcagctgcgttcttgctgtatcctcatgtgactcagacactggtttcctcttcttataaggacactaatcccatcatgagggccctaccctcatgacctcatcgaaacctaaggacctcccaaaggccctgcctcttaatcctatctcattgaaggttaggccttcaacagatgaatttttggaggacacattcagtccataacacttcccaccccccaacacacaaacttttaaaaatctgtgttaagtatgtactttgtgctgtaaagtgctatgggttttttgtttttgtttcatttctgttatccaggctgaaggcagtggcactatctcacctcactgcaacctctgcctcctaggttcaagcaattttcccacctcagcctcctgagtagctgggactacaggcacgcaccaccatgcctggctaattttttgtatttttagtagagacagggtttcgccatgttggtcaggctggtctcaaattcctgacctcaggtgattggcccgcctcggcctcccaaagtgctgggattacaggtgtgatccctcatgccaggccaaaccatgaatcttttatctttctctatagttttgtcttttctagaatgacacattattgaagccatacgatttgtagtcttttcaggctggcttctttcacttagcgacatgcatctaaggttcctttatgtcttttccatagtttgatggctcatttatttttaatgctgaataatattacattgtatggacatgccataccatagttcatttgtgttttattttatttatatatatatattttttgagacagaggctcactctgtcacccaggctggagtgcagtggcgcgatcttttttttttttgagacagagggcacgatctcgactcactgcaacctctgcctcctgggttcaagtgattctcctgtctcaattccccaagtagctgggattacaggagcatgccaccatgcccggctaatttttatatttttaatagagatggggttttgccatgttgcccaggctggtcttgaactcctggcctcaagtaatccacctgccttggcctcccaaagtgttgggattacaggcatgagccactgcacccggccttagattacttttataataaaaaaataaatgcattatatgcacaagaatcgtgcttgaacctgggaggcagaggttgcagtgagctgagatcacgccactgcactccagcgtgtgtgacagaccaagactctgtctcaaaaacaaaaacaaacaaacagaaaaccaactatgaaaaagagagttagccctataggcatgtgtgatatatcgcaatgcataagcatacaggctctggaattggacaaacctagatttgaatagtagccctgtcacttattagccgtgggcaaattctataatctcgatgtgccactctcctccttgcaccatgggtttaaccacattgcctgggctactgtgcggattggatgagatgatgcatgtggagtcagcaagatgcctgtcactccccctccctcccaggtcttcactgatgaaagcaggtatcaaagtcaagcagatggaaatgaaactggcaattttattattggtggagttattggagaacaataggaatatttcaaaaaaaatgatgcctgcgtcaacataaaagcattttcaacaaattgtgttataatatccaggtctgcataagaagttttttttaacctacatgtatcttaatacttctttgttggtgcctctccattagttcatttgaataagagaaaaatgtcaaaatattttggtaatttttatagatttcataaggggagtttgtcattagtttgtgtggattttttttttttttttctggctgtggatgctttgaatggtagaagactgaagggaagggaagtgtggtgaggtggggcttgaacaagatactacatgttataagtgattttctgaatttctttttttaaaataagctaatttgtaatattttataactagatggttttattagatgctcataaggtctcaaacgtgcactaatgctcagattttacatttccatcagccagaaacctgttttttatttttttatttttggacagagtcttgctctgtggcccaggctggagtatagtggcgtgatctcagcttactgcaacctccacctcctgggttcaagcgattcttctgcctcagcctcccaagtagctggaattataggcacgtgccaccacgcctggctaatttttgtatttttagtagagacgagatttcaccatcttggccaggctggacttgaactcctgacctcgtgatctgcctgcctcggcctcccaaagtgttgggattacaggcgtgagctactgcgcccggcctagaaaactttttttaataaaaataaataatctcctttcttccttttgtcatatgtatgtgtacacacataaaatcaaaatcataaccacaatgtttttcttttcattttttgtttttctctacaacctgggcccaggagctccttcatctttttttttttttttaattgtggtaaaatctgcataacataaaatgtaccagctaatctattattaagcatacagttcagtgcattgagtacatttacagcgttgtgtaaccaccatcaccatccatctccagaaagatttcatcaacacaccatgtttcaaacttctcgattttataaagtgcctctcattcaaatagtaacagctgaagaaaaaaatgcaggtaccatgcaacatctgacttctcagctgccacactcagaagtaacaaagaacccccttttgaaaatctcttcccattttatctttctttacaactccatagcaatgttgttttatgcaaacaaaatgtaaaacagagaacaaatagtttgtcccctgctgctatataaaaaccaaagtttgtaacaaggtaactattttatagccctccaagctcaataaaagtacattcttcctgttgtgttctatcttttgggcaggtatgtaattaagatagatggtgtgtgatcctaagaactcccttaccggagcatgttctggccaaattcagtgtgttacattatactgttcctttatatgtcccttagtattatacttcttagctgtccacatcatatccaatataggtcactttccttcctaaaatgttttctaccatttttatatctactgagggcgttataattctgagatatctgaattttattgctgaatggttaaatctttttctggtgtgaattcattaaggtgctgaaacataaattgtactatgtttgtgggagttatctttcactttttctttgttttctgcaaattttttaatcctctgaaaataggccaggccaccttatcagtgcgaggtatccagagctccactctcttctgagcttaagaatgttctagaatattgtaaggggggaatggagtactcaggagcaggagagagggaatgtgcaaaatctctgggcacaagtgggtgttcccctcccagctggtaaccaggtgatgggctgactgcagggaagggaaggcctcgtccaggaagggacagctggtgcagcctgcggcagtctagtagaggccacgggctcctacttgcgccttcgtgctgggaaaccggatttttttccttcttcatgttttaagggcttcttcagcacagctttgccccaccacctccacagtcttctctccccctagtctggaataagatgttctagtccctcaaatcaaatcccacatgtaagcctcacatttccccaacttttacctaggactgcagacctccaagcccagaggctttggaaacaatcttcaactgctttctctctgctttccaccctgtgtccccctgcaggcagcttgcaaagagcagaggcttggaaaggagaagtggggcaggaagcgcagaaagtgcaggattctgcggttagcatttcaaaaacattgcccttctctgatataaagaagtggattttctctgatagaaagaaaacacagtcaagtcctatgcttggaatattgatctgtagaacagtggcccatctccagcctcaaaggctagtcttaaaagaaaaaggagaaaaaaaaagcaataggagagtttgctgctgcgaagcttaaggtcctatgaggaaaatactattagagccaggagcacaattctggctgcaattagagtcacctgggagaactttaaaaaaatgccaaaaatagaatgcctgggcctcgcccctggagactttgatttaattggtcttgagtgggcccccaagcaaagctttttttttttttttttttttgagacggagtctcactctgtcgcccaggctggagtgcgttggcgcgatctcggctcactgcaagctccgccttccgggttcacgccattctcctgcctcagcctcccgagtagctgggactacaggctcccaccaccacgcccggctaattttttgtatttttagtagagacggggtttcactgtgttagccaggatggtctgatctcctgaccttgtgatccgcccgcctcggcctccaaaagtgctgggattacaggcgtaagccaccgcgcccagcccagcaaagctatttttaaacgttccccaggtactgagtgtagggcagaaacccacgttatgttagcagggcccactcatcctataggcatagcaggcacagcacttgggcccaccatacttccaggacccacagaaaagttcaatttcttttagaatcagaagaaaaagaataaacttttaggtggaagaaaatgacttcatatataatattaacatgtatttctttatatcaatgaattcataaaatacaattttgggggctaggtttggtggctcatccctgtaatcccaggattttaggaggccaaggaaggaggattgcttgaggccagaagtttgagacccacctgggtaacatagcgacaccccgtctctaaaaaataaatttaaaaataaaataaaattacaattttttttaaatggggaaagagatccacaagtcagaagtgcatacggcctacaaaagccataatgcagccctatataaaagagacacgtggaggccaggtgcatgtggctcatgcctgtaatcccagcactttgggaagccaaggtgagcagacacttgaggtcaggagttggagaccagcctggccaacatggtgaaaccctgtctctactaaaaatacaaaaattagtcgggcatggtggcgtgtgcctttaatcctagctatgtgggaggctaaggcaggagaattgcttgaacccagaaggcagagtttgtagtgagccgagatagtgtcactgcactccagcttgggcaatagagtgagactccatctcaaaaaaaaaaataaagaaagaaagaaaaaagcccggtcgcggtggctcatgcctgtaatcccagcactttgggaggctgaggtgggcggatcacctgaggtcaggagttcaagacccgcctgaccaatatggtgaaaccccgtttctactaaaatacaaaaattagctgggcacggtggcaggcgcctgtagtcccagctacttgggaggctgaggcaggagaattgctcgaacccgggaggtggaggttgcagtgagcctgggatcgtgccattgcactccagcctgggcaacagagcgagactcggtctcaaaagaaaaaaacaaaaacaaaaaacacatgtaagggtacatctttgaatattactaaaaataattattcagttcacattaacacagcattgaaatacaccaatgatgtgtacaccttgcgctggcaatgattcctaatttttcccttatcattcccctatccactgcaagtggttcaaggtaggctccatcctgcttcaataagctacttataaattttgctgtgttgccaactcagacgtttttgagcgtctagtctttcatccaaacacacagtgcctttcttttcatttttgttttgtttttgttttttagagatgggagggtcttgctttgtcacccaggcaggaatgcggtggtaccattttggctcactgcagccttgaattcctggctcaagggatcctcccacttcagcctcctgagtagctgggatgaaaggcacgcaccagcatgctcagttaattttaaaagtttttttttttttttttttttttttgtagagacagggtctcgctttgttccccaggctgatcttgaactcctgggctcaagtgaacctcctgcctcagcctcccaaagtgctgggattacaggcgtgagccgccatgcctagcctctggtggctttctaatgtttgattccgagatgctcacctcagttcctgagatttcagagacacagtggattggaggcctcagagaaaaggaagcattggccctaagaggtatggagcgaatccagagcctcctcaatgtgagccttttcccctgggctttgctggcctctgtcgccccagctcagttccctcctggctcctctggcaggcagagcttcctaaggttgagttacaaaaaccaccgtggtcactctcacttttccccttttccaaacagatacccatatttgaaaagtcatcttcttcatattggcacaaactccagagttctcctggcaagggaaaggcatgtggacgccaatctccatgtccttgaatttcatggaagggaactcatgttgagggagactgaggtatcaggcaggaaagaacaggtcaatactcattccaccggcaccgggtggggcttggaaaagccagtcacctgcacttgctggttgcaagactaaagcacacagatggagactcacaggaaaatcactcatctgaaaactctctgtggctgccagaggctctgatgtcccttggctccgggtaggagctgtcaaggagaaagccaactgtggtctgaaatgagggaagcaaggcttgggataatgatcccttagatgccttctggtttgaggtcttatgactcttcagcaaagctctggttctgacagacccaggtctcaatctctgcttctctatttatttatcaagaataaataaatttatacattttatttatccgtaaattggagataagaacatgtacctcatgggttgttctgaaatttatttttattttttaaattaatttatttttgagatggggtctcagttctgtctcctaggccggagtgcagcagtgtgatcatagcccactgcaacctccacctcctgggctcaagcaagcctcccacttcagcctcctgggtagctgggaccacaggtgtgtaccacaagcctggctaatttttgtattttttgtagagatggggtttcaccgtgttgctcaggcttgttctgaaatttaaatgttgagtgtggaattcttcaaattgcccaagaaatccaagttccctcttgtaatcactgtcaccttgactgtagggctaaaagcggaaggaatcgccagtttgttgacttcagcctgctcttgggcagaccagctcaaaaacccttacatgaaagttttatgaaaataaattgtactacttctgcaagactaaatttgagttttcattatttcagccctgccaccaaatagtcccagcttgctacttttgctttagacatatccaagaaaaatgtgttctgaaaggtgaaatcccttgctagaaggctttggcagtcagaaatgagcaaaaatgcagaatttttttttttttttttttttgagacggagtattgttctgtcacccaggctggagtgcagtggtgtgatctcggctcaccacaatctctgtttcccaggttcaagcaatcctcctccctcagcctcctgagtagctgggattacaggcgcgtgccaccacacccagctaatttttgtatttttagtaaagatggggtttcgccatgttggccaggctggtcttgaactcctgacttcaggtgatctgcccacctcggcctcccagagtgctgggattacaggcatgagccaccgtgcccggcctaaaaatgcagaattttaaaacatttgtactggtgttttttggtctcatttgttgcccaattggtctgaatataatctgacaatatgtcactcaagatcaactataaccaaataattcaagccaaagaatggttgattaatttgctacaaataaaatgtggtccacagagtcaaaactttttaaatgtttcaaggtttttttttttttttaaatttctttttttctgagacagggtctcgctctgtcgtccaggctggaatgcagtgacacaatcatagtttattgtagccccgaccttatgggctcaggtcatcttcccacctcagcctcctgagtagctgggactacaggcgcgagccatcatgcctgacaaatttttttgtattttctgtagagatgaggtttcactatcttgcccaagctggtcctaaactcctgagctcaagtgatctgccctcctcggcctcccaaagtgctgagattataggcgtgaaccactgtgcctggctaaggttttgtttttaatcttggaattggagctatcctgactttgcccaaagcatggttcgaaagggacttttcgatttggagttgtttcaacataatcaaggacacattcccaataacatttagtacatgcatgtttattgaattagtattagttggtgttttggggatggctgaggggatggtgagtgtaaacttgccttgtttctggaaaattcctccttccactggtcagcagagctttgacattcctacactaagttcttcagtctccaagacaggcagtccaagcttctagaaactcaagccatgcttggatccaaccagggtccaaccgaccacaaaatgtatctaaaatacttttgactatgctggatccctctaatgttgctattggttctctcttgatttttcatttaccttgcacgttgaagtaactgtgggaagaaatctgtgttccccttaggggaaatactggaggattagcatggagtcaaactcaagctattagatgtttttctcttactgagaaacttcactcctctatcaacatttccaccatataatggggtatactacctttagagcgaattaaaaaaagtaatagtttatcttcttgtctctcccatggaataaggatgtgcaatagcatactgggtttcattgccttcctccatactatacacatacacagtgacttttccaaaggctacttaggaccatttattttgttttgttttgttttttttattttgttttgttttgttttttttagatggagtttcactctgtcacccaggctggagtgcaatggtgcgatctcagctcactgcaacctctgtctcccgggttcaagtgattctcctgcctcagcctcctgagtagctgggattcaggcacatgccaccatgcccggctaattttgtatttgtagtagagatggggtttcaccatgttggccagactggtctcaaactcctgacctcaggtgatctgcccgcctcggcctcccaaagtgctgggattacaggcaggagccaccgtgccctgccgaaccatttactgttttttgttttgttttgttttgtttggtgagatggagatttactcttgttgcccaggctggagtgcaatggcgcgatctcggctcaccgcatgctccgcctcccaggttcaagcgattctgctgcctcagcctcccgagtagctgggattaaatcatgtgtcaccacgcccggctaattttgtatttttagtagagacggggtttcaccatgttgcccaggctgatctcaaactcctgacctcaggtggtctgcccgcctcggcctcccaaagtgctgggattacaggcgtgagccactgcgccctgtcatttattgttaattaggtctcacctcttctgctatgaggtcaataaatatcacctgtctttgcaggtccagggatccaggctacacgttactagtcaaaggccatggggcaagtctttattggagatcagatgggctgggtcagtctggcctggccacaagaagtgagcctcacctcaaaacctgttccacaatggcatttcctgactggctatgtgtgtgtgcactgactagcatgtgctcattcattcatcaaacatttactgaacacctgctatgtgctagtggctagagactcagggaggaatctgacccattcccttcagttaagaaactcagtgtgtgggagggctgaattataagtaagtaggtgctatgataaaacaccccacaaggcagaaagggaggatgaaggaggaggatttcttagaggaggagggacttaagctaaaccttgaaagagcaagacggaagggtgttttagatgaaggaaccttgacagcaggcccagagtgtggatggctggctaggggcatagccctctcattgacttatctgccagtcagggccagattttgagggcttgccacaccttgccaaggggtttgattctttttccgtaggcctagcaagtttgcctgcccaaggggctctagaagttcaaacggaaacttaatatgattgtttgatgtattaagtctcttccctcaacacttgtaggagtgaacactttgaaaagtgaacagtttaagactgagattcttcacttcatgtgggaagtgtgcaaagtccaaaaatgagattgagcacccaaggaattagtctcccctctgctcctgctcagagccagaccttgttggagaggacacagctgggtctcactggaggggaaagaagtttctatggcgtcatgcccatggaacctactggtaatctgacctctggggttctggggaaagctgtttatggggaagcagagttttggtagagttgctccaccacacaacagcttggagtagagggatagtgccaggagaggctgctggctgtggaatgatgtaggcaccaggtcctgaaggagtcctggcacagcaggggcagagcttgaaaccatgtgcactgcagcagccgggaggtgcagaagctataggtgctgggagagctccctggaagctcagatcaactttgtgctgacagctttccatcacaagtgagcacttttgttccaaggagccctctcagcatgggaggtgggtagcctagaagtaggggtaaggcatgtaggagcggtctttgctggagacttggaaaaatactccagctacctgagcttcaggttgtcaattctggggggcattcagcatcttcccaggaggtcccaggggaatcaggccccctgcatatagcaccagtctcattaacacaccctaatactggcctttcctccttgcctgtcgcactcttcctgcttcctctctccggcttctagggatcaccctaaatacaccaccagcaggcaagtcttgtcacaggctcctccttcagggcaacccgtattaaggcagcctgtttcccaatgactccaagcaaaagccctcttcccaggtgcccttcccaatcccatcttgcttcacaagcggaatagcttttccacttcaatcaaataaaccgtgtattattttttgttttgttcacttcctcctgtttccctgtctcgggtgtatgaccacaccttccagaaatgccctccgcactctttctgttatccatgtgcattacatcttcttctttttcttttttcttttctttttttttttttttttgagatgaagtctcactctgtcactcaggctggagtgcgatcacgtgatcttggctcactgcaacctccgcctcctgggttcaagtgattctcctgtctctgcctcccgagtagctgggattacaggcgtgcaccaccacgcccggctaatttttttgtatttttagtacagatagggttttaccatgttggccagggtaatctcaaactcctgacctcaagtgatccacccatcttggccttccaaagtgctgggattacatgtgtgatccaccacgcctggccttgcattacgtcttccaagtgcacgccataagacctattccatgctgcagcctcccttctgtcactcttcctatattctgtgtcactactcaaatgtcatttatactgtagcacttatgtgaatatttttgtatcatgtattttatgtacagaaaatttggaggagaaaagaggtgatttttctctactcatcctcctggaaacttctctttggcaagttgctgccactgaccccgctcttcctccccttaatcgttctactggctcaaaaaccataattaagggagccagacttacattaaataaaaaaaaagacaaaaatgtttttcagaagcattccctggaaatgtttgctttaagttgaggttggtggggcttgagcattcatcttgacaataagagcaacgaaagcagtatctctggtagctgatctctctcacctctgtctttacctccaatgactcctcttatttttgtcatcagcaaaatatctgtatgggaggggaaattgctgatgaaatgcttttttgacagttaacaaatatttcctgagtgcacactctctacagatccttggaagggcccatgtgagaagtggattcgtgacattcggcactgccctctccttcaggagtccctcacccttgggcttccgtcaaagactcctgggttcttcccaacagctctcagttaccctcctctttctcccttgggtgatgccctctgcttcctccaccctcagtgaaggcactgcactctcctttcctggctcctggtcctcactctcccctcaccctccacatggatgctgcccagagacactcctccacttcccagctgcctgctggggcatttccactgaaaagttccaccattacttcatgctccatggaaccttcaggagctctcctgaaaagcagcctctttccatattgttcctatttctgatgctccaaggcacccagcctggaagcctcagctttgcctttgccagttccactccctcattgcacacatctggtcaccaagacatctggtcttccaaacaagagcccttcccttcccttttcccttcccttcccttcccttttcccttcccttccccttttccttccctgtgcttcccttccccttctccttcccttccccttctcctgccttccctccctccctcctttctctttttcttcccttccctttttccttcccttccttttccctcccttccccgtttccttcccttcccttccctttttccttcccttcccctttttcttcccttccccttttccttaccttctgcttttccttcccttccccttctctctctccttccttccttcattagttccttccttccttccttccctccctcccttccttccttctctccctccctccctccctctctcctttctctctttcttttcttttctttctttttttgagacaatttcattctgttgcccaggctggagtccactggggcagtcacagctcactgcaacctcaacctcccaggatcagttgatcctcccacctcagcctcctgagtagctggaactacaggcacatgctaccatgcctggctaatttgtgtgtgtgtgtgtgtgtgtgtgtgtgtgtgtgtgtgtgtgtgtgtgtgtgtatgcgctttttttctttttctttttcttttttttttggtagagacagttttcgccatgttgcccaggctggtcttgaattcctgtgctcaggtgatccactgccttggcctcccaaagtgttgggattacaggcataagccactgcacccagttggaaaattctttcctgtccctccctgctgcaactccccatctaccccatgactctgctggttcctaggccatgggtctcccccatctggttcccagggccatttaggtgccctctattgcatgcaggttccattctagtcattttgaggtgtccaagtactgtttggttgccttgagccccctcactttggcatttgatgccttttccaccctctgaccccatccacctttctagtatgcctcatcccattttctagcatgtgtgtcctgccccaggcagcctctgctcaggaaagctggtccaccctctgggcactgttcacacaccccatcaccttggctgtcttccccaacctagacctgctaactctggaatagtgcaataccgcttcctccaaaaagactcccttgaccatgctgcccacttgggataagtagcatctttttttttttttctttctttcctggcaatgaatcactattattaggtcggagcaaaagtaactgtggcttttcccattgaaagtaatagcaaaactgcaattacttttgcaccaacctattactttttcaagtccttttatattgttttgaattgttaagttttcaagggtctatttcattcaatatgtcagcaaacatgtattaagtacaggttgggcagggcgcagtggctcacatctgtaatcccagcactttgggaggccgaggcgggtagattacttaaggtcaggagttcgagaccagcctgaccaacgtggtgaaaccccgtctctactaaaaacacaaaaattagccgcgcgtagtggtggccacctgtagtcccagctactcgggaggctgaggcacgagaatcgcttgaacccgggaggcagaggcaatgagccgagatcgcgctactgcactccagcctgggcaaaacagcaagactccatctccaaaaaaaaaaaaaaaaaaaaaaagtacaggttgttgttttctcagggaatcctcatagctggtgaagtatccagcttttcattttacggatgagtgaactggggtttagaactgataacattttgcccaagttctcacagctagcgagaggcgtgccgcagtttatcgtggggtgggtctaaacaaggacctaaaaactgtattcgaatcccagccctactaccgccagctgtgtgaccttacgaggcgcctcactttactgtttctccaacagagacagacatttcttgttaccgcgcaagtgggataacctccccaccagtgtctagacacagtaggtgctcaataaataggtgtgggtttgcggtggcagaagagcgctatcccttaagtttctgacagtgagggggaaaaaggctaagcagggaaaggaagggaaaggggtaaactgagctcggcgcagtcgagagcgcgaaatagggagggcttcctgcaggccaggaatttggagaggccgaggctgggagaagaaaaatgcccggtgacggcggaggggaggtggaaggacgaacggctccgggaaggggtgaggtctaagcgcagccccgggcccagcggagccgagggcgggtggtgcgggggttcctgggtaggttcgtcccgacgggccgcgggcggattgaagggagggttgggcccgccggcagccccggcgggtccaggcccccggccagcccctgcccctcctcccaggagggcgggcggcgactgcggggcggggcgcgggctcgctcggcctcccggcggcgccgcggcccttgcactccggccgggctctgctggctgcggcgggagctggacgcgggaggaggcggcggcggcggtgagtgagctccgggctggagcggggcggggtgtgcgccggcagccgggtttcggggtgctaggggccgcccagggcggcgggacccccaggggttcgggctcagccaggtgcactgtgctcagtccgcgcgtccactctcggtgacccgcgccgcgcgtgtcctggggctcgaagatgcgacccggactcccgcgccgcgccccgccgagggcaggcgcagaacagatgcgggcgatccctggggaacccgcttcggggcggggtgggagggaggaggccctgcagaacctccctttagtgaagagggactttctgccttcgcacccctgcctggaccctccggctctagtgacagctgggagagactcacacgaagcagtttctgacctatcctgtcgtacacaagtcctcggcgtgctcggccggaccatcccctggaaagaaaggggcgtgtgacctttctctccccgatcctccagaccactgcgccgcccagggaggtcatccccgagagagcccccgcctcactcggagcacacattctagctctccccgggacttttccaagttgcatcactgtttggcctctagacaggtacttggctgtcatgttggagttagttacacaggatttttgaaactttgtatatttgctttgtgtgttcttcaccctaaggccgctgccctcccgactctgcttatgccgctcaaaacgttgctcaaagctcgctgggaatgcttttgcgggcattggttctcaaacttggccccacatctggagagttttaaaaaatactggtgcctgtgtcccactcccagagatctggattcggcttgcctgggttgcagcctggacaatggaatttttaagacgccgcaggtgattctaatgtgcaggcaagtttgaaaacctctgctttgagagttgctcccaccagccactcttcggacggctcaagatcagtcctgatctagaactcatctcaggtcctcatagctcttccctaatccacctctccacctgaagaacctgttgattggtgctttccaactttagacagtagatggtgcctttactgaagatccctttgtttctacctctctgtttacagtcaatactgccagggcactttctgccaaggaggtgggagtgtaggcattagaaccgagcagtccttgtcagggtcaaggttataatacagggttgtcctattcagggaaaaccaagtgataatttgacttgtcatattcgggaatgatttcagattaaaaggagaaaaaatactttagggtttggtcagcttttggagaccctccggagactcccccacgtagataatggagttgcataaatgtggagaattttccttcaaaaagccaaagctaacaacatccttaaggttttgtggttgatatttgtgttaacataagtccatttttgtagattaaacttattctggaagtatgatgaagccctgcagacagaacacagtgtataacatggcacatctgagatgacacctgagacacctgtcacatggtcttaaaaatgatagagaagtaggactaaggaaaatgtaaccatgcttatattggctaaattaggtcatatattttatcaagaaaatgtgttttcactgccctttttagtaatgtgatagtctccggggatcttggttaatttacttttgtaccccaaatatgatgtttgcattaaaatttccaccctgatgttgctacctgaccacaaatcagtggttttaagtttttcttagggggtggccctctatgtgtttttttttttttttttttttttttttttttttttgagacagagttttgctcttgtcgcccaggctggagtgcaatggtgcaatctcagcttacggcagcctcggcctccctggttcaaatgattctcctgcctcagcctcccaagtagctgggattacaggcacccgctaccatgctcggctacttttttgtatttttagtagagacagggtttcgccatgttgtccaggctgttctcaaactcctgacctcaggtgatctgcccacctcggcctctcaaagtgctgggattacaggcatgagccaccgtgccccgcctgtatttttattaacagtgggatgacatccttccaagaatgccttgctgaagtgaaagaacatttacattcatttctagctgctaatgtaagtccaaagaacattcattttgaaaaatacaaaaatgacataattttgcccacttggttttctcgcttttccccaacttccacgaccatgctctgctgctactactgtattcacttgctggaggtgtgcaccctgtgggagccgtcttcattgtcttggctttggcttgaaatggaggttacatgcagcgcattgtcttacagggtgtcccctgacccgaatcatcaccctttggggagcaagactatatggaaagtgttttcctactgttttttttgtgtgtgtgtgtgtgagtgagtgagaccatgccaacaaaatgaagccatattattaaatggtttgttaacttccaaatcttgtctcaattgggaaaagaaaaatgcttattcgaggatgctgttgaattcatggtgtctgaaaagtcacccctgaacagcaatagttacactgtgaatataataatacactctacccccccaaaaagaaaagtttatgtaaatgtgggcctaagcacatttattgcaatttctcactttggagtagcagctctaatatcctaaagtgattagaagaaagtaagtgaagaaaaatatgaagaaagggttagtgagatactttttcatttagggaaaggggatacagcaactagaaaaggccttgggtttgtgttaagaatttattgccctggtggcttcctttttttctttgtttaatttgcttgtgctgatgggtgagggagagttaaagaaatttaatggcctcctaactctctttccccgtgaaacccatttatctaagagatgccattggccttttaaaaatatccaactgattttatgcttttcctttcttttcatcttctgatctcggcactaaagggcggtggcatggctgagaggttggcatcagagcaggaaaacaaagttcaaggggaaaccaaaaattgggtaattttctctgaatgaccaagtgcttacttttttcaggcatgtgacattgctgttatcaagaaaccagttatgacatgaaaatcctgaaaatggaaaaggaaaaaagaaaaaaaaagggaatggggtgggggatggaaatagcaccagggttgactgacctttaccgaggagggaaggcttagtgttttcagcctggtgtcccccgtgtcccgattgcagccccctgtacttctctcctcatgcaccctcctgcatccctcaagccaatatccttgggggagatagtgcttcatcttaaattcacactaaggtgtctttttgtttttgttatttgagactctgctctgtcacccaggctggagtgcagtgatgtgatctcagctcactgcaacctccgcctcccgggttaaagcaatcctccctgcctcagcctcctgagtagctggaattacaggcatgcgccaccataccccgcttatttttgtatttttagtagagatggggtttcaccatgttggccaggctggtctcgaactcctgacctcaggtgatccacctgcctcggcctcccaaagtgctccgattacaggcatgagccactgtgcccagctgttagtagcccctgttactagcaaaagctatgtattacccagagttgttggtaaacaggataaggttcctgccttaaggggcctgagtcaggtggggatgtaaaccctgggttgcaataagttaggaacttttctaatcaagaggaacacagtggcccgtggggtactgtggggcacctggctagcctcgcctgggtagatgcctcctcaattcattggcacaggaggcataagacatgctttacttgggtttacattaaagcttattctattaggcccgtaccccaaatgactgattttggaaatgtccgactccaggagcgagaagggtgcaggtatccatcatgcaaaggggaggtgggaggtggaggaagagaacagattctggcaggtgtcttttgcttctggagtctactgaacaggggtacttcctgggagtgggaagctcatggagaatgtggctggatccatttttggcacattagtaactggtaaagtaagcttagtagcggctacctccgcaacagagctgaaaggagaatgcaaagtgcagtgtgaaagccgcagctgcagcactttttggagcaagtggttgggtttgtatctatggctcctgccaatgggcagacattggttcctcatcataccatggttgctgtagctcaggcttccttgggcaggctgaaaactggacttcacactgtttttcccttgggtaggtggtttccaaatagctgacccatagggctaataacctcatggttataatagttactatttgtttattgactgcctttcaagtgccaggtagcatgctcagcacttttcgttcattactgtaaaccctttacattcctgagaggcaggtggcagtgacctcattttacatatgaggaaactgaggcccaaggaggtgctgaatcctgcaaaggtgcatagtagttgacagtggcaaagttctcatgcctgtaatcccagcactttgggaggccgaggcaggtggatcccttgagcccaggaggtcaataccagcctggacaacatgctgaaataccgcctctacaaaaaaatacagaaattagcctggtgtggtggtgcgtgcctgtggtcccagctactctggaggtcgagatgggaggatggcttgagcctaggaggttgaggctgcggtgaaccatgatcatgccactgcactccagcctgagtcacagagtgagaccctgtcttaaaaacaaacaacaaaaataaaatggcagagttgaagttcgagagtactctggtctgtctgaatacaaagctaagttctctctactgtttctcgctcctcttaagctgagctgattaagaaattgtgttctcagtgccttgtttattttttaacatcacagtctccttaggtctgaactgatttactattttcctctacctcgtgtaaataggaattttactattttcctctacgtgaggtagaggaaaatagtaaatcagttcagacctaaagagaaagtattccgctaaaggccactgcgaccttgtgatcccaagggaaatttatggactgctgcttttctaggtgtcttaaagaagagggtagattaggctgtgcagaaagtctctgaacgggtcccacatcctaggttagagagacgtgatttccacccttcttcaagttctgcaaacctctgagtttctgtagataattggttgttgggtaagagattaaaaacaaaattcagcgttgggcattctagaataaaacgaagctgtgcacatccaattcctgtttatgtggtactcgcgacaaaaacaaaactttgctgcatagtaattacctcaagctcttaaaattacaggtagtaagggcttagaggccatatggagttataattagagatgagtttaaaaaagggctagtgaatgaatgttcattactacaatgagcactagctgaatatttcaacccgagaaggatcagctccaaggaacatttccagggagttagcggagggtcgtcatggagttagagtgtttgggattagtgcacagagcatttgttatgaacgtgcaatatttctgccagcctggccagaagcctctttgtttacagggcagggtttcttccctgctgcccaatcacagggatttctgctttgctttggtagagtacgtaatcgttcaggtgattgctttgtagtgtgttaggtctgtaaagctcctcgactgttaataatcttttcctgttacttatctctttgctggaagattgaggtaagatgacctctagttttggcctcaagaattctcttgtttttgaccttttcccttagttttctatctttgtgtttcattgcattcaaaacaggccctctgttttcccttgcaaatttatagtccacatagggaagaggaacgactgtgaccaggactatccaggaatcctgtgatgggagtgttgttagtcccattttccaagtgaggaccccttcctctctaaggctgggagtttgggtattccaactaggactgttaaactttcaacaatggggctcttttgacttgattacaaaagaaaaggaaatggcccagttttcaaagtcatgaagaggttctagtatatcttatgaactaatatatatccttgaactcttttgtagctgacagtattaaaaaaggtttgattccccaccttttttgcctgtgtggtttttatcttcctttctataaacaatgacttactcagaattatacagcagcagctgaaaagttgattagcctccgtccttgccctaatcaagtatcaaaaacctggaatgttcacttagagtggtgattactgtgaaagctttaggtgctggagaggacctgataaagaatggagtgagagataagagagagagagaaaatagcttgcaaagggattgcagggtggagtttaacaaacttaagatttctttcttcctttttttttttttgtttttttgatacagagttgcccagccttgttgcccaggctggagtgcaatggcacaatctcagctcaccacaacctccgcctcctgcattcaagccattctcctgcctcagcctactgagtagctgggactacaggcacgtgccacgacgcccggctaattttttgtatttttagtagagatggggtttcaccatgttagccaggatggtctctatctcctgacctcgtgatccgcctgcctcagcctcccaaagtgctgggattacaggcgtgagccaccacatctgccttttcttttcttttcttttcttttcttttcttttctttttttttttgagataatctcactctgttggccaggctggagtgcagtggtgtgatcacagttcactgcagcctcaacctcccagactcaggctcaagtgattctcccacctcagcctcccgaggagctgggaccacagatgcaggctactatgcctggctaatttttatgtgtgtgtgtgtgttttgtagaaatggggttttgccatgttgcccaggcaggtctctaattcctgagctcaagccatccacccacctaggcctcccgaagtgctgagattacaggcgtgagccaccgtgcccagcccaaacttaagatttcttttacttgtgagtttcaggtttggggcttaaatgcatttggtctggttgtggccagactagctcagccctaacagtctgtgctgccttgggccacctataagctttggggagtggggtgggtgggttgggaggagaaggtagggtgaagggagaggggaaatagtgggtaggagataagacccaccagttagctgattctccaggcctggcttgctcatggcatgactgcttctccctgcaggcctgagtccaactttctgggtgtgaggcagctggatggggtacaaaagagggagagagttgccagacactttccaggagacctgcccaagatcagtaattctcataatagcaaatgctcccatagcatttgcctccagccccatcctagagcttttactatagcaattctatgggataggtgctatcataaacccattttacaggcgatagaaacaaggccacgggaaattgggtaacttgtcaaagtgctgaaatccagggttgaaacccttgctgtccggctctgagctatgctaacaactaccacctcattaggcatagaggcctggatgctgcacctgctcttcattcattccttgaactcacccacgtatttcttcaacaaattattgatagcctgtatatgcctttatcttggcaatgagaacaacataagtgctctttgtttatgtgtctgaattcccataaactttattttctttcttttttaaaaaaattgccataaactttcaaacaaacctttaaagagacgagacctctttactgaccttgtatacctggtgtctggtagaaaataggtgctcaataaagctttgtggaagaaggaagaaagacagtgttttgaaacttgacatccttgtatttcctctgtctctagcagccacagtgatatctaaacagaaaaacagacaagccttaagtaaagtgagagtgtgtggggagtgttttgcaaaaataacaggagagaatttttgataaaagcatgctgtcttgtatgcatttcaagttctcatggtgaatcattttttgcttgtttgcttaaagcatttcttatctgaagggcatcccgacacccagcttgcagactactgagtgaatcagggaggcccttcagacttccatgcattgttcggggctgctcttgtcatcagggtctgcagaatatattttctttgcagttgaggaccaaatacctggtaaggttcaagtccaccatccattttcctgtttaacatttaaatgcatgagctagtagaaagtagtttcaccttgggctgggtgaagtggctcacgcctataatgctagcagttttggagtctgaggcaggccgatcagttgggatcaggagttcaagaccagcctagccaacatggtgaaaccctgtccctgctaaaaatacaaaaaattagctgggcgtgggggcgcatgcctgcattcccagcttggcttgaacccaggaggcggagattgcagtgagctgagattgtgccactgcactccagcctgggtgacagagaaaaataaagtagtttcatctcctgtattttcattccttcttcacactgtggggcaaagaaaggtctcattcacttggattggaagctctatttgacgatcactaggagtgatggctctttggttcctcttccatttcaggtttgtttcctcctctgtaaaatagatgtaatgcctaccccatacagtcaagccatatctctttgacatagtacagtggttctcaaacagggtccccccaacctccccacccgggggtacatttgacaatatctgggggcattcttggtagttatgactggggtggtgatggctcctggcatctaatgggccaaggccaaggatgctgctaaatatcctttgattcaaaggacagtcccccacgggaattatctggcttaaaatgtcagtagagccaaggctaagaaaccctgacaaagtggaacctcaaacaacggtagctctttttaacatctctgatccaagggagctattggccagggacaaagatccctcctttcttaagtagggtggaaagaatggaatttaacgttttattgatgcctctgggtttccccacaggtgcccctgaggtgggaacacctccttttctctccattaaacatgacttaacttcatttgaaacttgcttgcatcgtttacatataaatagccatgctaaaaccagtgaaaccacttagcctgtggggtggttaaacccattccctgcagaggacattggtggagtggggcctgtgctgctacaggcttgtgagcctcgcttttctcccctgttaaagggcagataggtaattgtgtcaccctcccatctcgtcatgttgctctgactctgcacgtgtgaaactagctctacgtatgtgaatgtgctgtgtgattcctaaggtatgccttttgaaggcatttttcacgggatccgtttcagtcaaggacactaaaatggttggggctcaacaaagaatatctgtgttacgggcatagtaggaggccccccaaatagttcctgcagcagggtgtgtgattcgggaagcagtgtggcccagtggttgacagcatgaggtcagccactcacaggctgctctgtgtacaacctttggcttttcccgtgcttgttgtgtgaccctgggttagctacttcacctcgttgcacctcagtttcctcacctgtaaaatgaggataacgacagtgacgacgataacacccagctgaagatgggtgcgaggcttcagcgactggtccttgtgaggtgtgcggtgaagatgggagcttagctcaataaatgagttgctgttagtaaaatactatttgatgttggcttgtagcttgtgtatttttactcagatgaagagcttgctcctgatttaggagctgaaaaaggatctttctggttcttggtattttttttggtggcaaaatacagcataaaatctccattttaaccaatttaaagtgtacagtgcagtggcattaagtacactcacaatgttgtgcaaccatcaccactatctaattccaaaactttttcatccccctgaaaggaaaccctggacccgtagagcagtcactccacgttcctcccttcccccagccactccctccctgcgagcccgctcatctattttctgtttctgtggaactgcctagtctagatatttcatataaatgtatttcatgcaatagatggccttttgcatctggcttctttcacttagcataatgttttcaaggtgccatctgtgtattgtaacatgcaccagcacttcaccactttttacctggtgtcttttttgcagagcaccccaagcctcagtgtcatcaggcctgtggttctctgaagtcatgccctgttttcaagttttaaactgtctttcttcattgattttgatccttcttggccagccttattttttccacttttcccatccagtacttctaatgacccttgaaatgaatgtggaatgaagccctcatgccaggttcttggtgctggggaataggtcttattaggtatcttacttctgtgaaagaattagcagcaggagcacacataggggccctgagtggtgcttcatttccccatgactctgcgtgacaggttttaaaaacaagtgtctggaaaacaccaccaggccccttttattcatcagtttaaaagcttcccacaatgagaagtggccctcaattaagtcgtttaataaaaacctccccctgttttaaagcattcttgggaagtgtttacatttgacgccactgcaggcttctaaatgaggagctgtggagtgagtgatccttaacctgtgactttaataatatcctttgctttagatttccaggtggaggcctgggccagatttgtagcttgtcattgacccagactgggttcagagatgggggctgggcagggggtggaggacattcttggctatcctgcccccctcagctgccactagtagaagattcagaaaggctgaaagccacatagatatgtaaaaccagctccttggagagagactggactggaaggaggtgaagcatttccctacctgggaagggcagttaccctgccccacttctgaccttatctgcagtgtcggggggcttcagtgggcagagattaaagcatttaggagagcagtgccaggctcctgagattctggggccttagggtctgagagctggaggaggctctacttttttctctgattctggagaggtgagtaggccccgagaagaggaagcaggctgctttagcttcagggaaaactccggagttgtcattagaggagtcctgggaaaagctaaaataaagaaaattctagggtggtctttcctttgtgctggacgaagacaggagggtgaggggagcccggagctgctgacacgcactggtgatttgtagaggttgccaaggtgggcagttagcagtctggattctgggcctggactgcccggatctgaatcctccctccggggttctgttctatgaattcttgtgtgtccagtgctcagagcagtgtctgcagaggtagctgtagatatgtgtgctcgcacgactgtactgacacttcactttggtgagtttctggttagaatcatagaaatgcttcttgttatcagagctaatttgcctgcatacctggcagccttgtgcagtccatgggacagggtgatgttactggactctgaagaaaacatgactcgcagatggagaaattatgcttggcaaatctattaaagttctccgagggagagaataaatgtgggaagaaggacaaaccagtggatctagattttatttagacttccaaaagattgttggaaagacttcatggcaaaggctattagatgtgggagtctcccatgactttctgagtggaggtgaatggaagaaggagtctggctgaaatttgtctttttccattgtcctttagaggaggaatcttcacatttgcagatgaaataaaattctaaaggtaaaaatgaagacttcggagtcaaactatagagaggtgttttttttttctttttaaatttaaattttgggcacgaggggatgtcaactaccctttaaaataattcgtgatcagtggctgcacctgggcagctgggctttggaactaggaatgatgtgtgtgctgctttctagcaaagttaaaaatcatgtgcctggggcatcagagtgctcaggaaataaatgaagattagtggaaccaaggagttcattaaaaatgattcaagttccactccagcctgggcaaaaagaacaaaactccatctcaaaaaacaaaaaacaaaccaaaaaaacctgtagtttccaactgtcttttaagtgaatagtacatttgtagaaaaagtagattctgctatcaacaaatgtaagagttcacttaaatgcacagatgttgaatttcatgccttttgtgttttaacccaggatagtaaatgaatgaatgaaatgagcagacactttttcaacacagacccttccctctcgcccaataggatttaggaagcttggagttacgcttgaccaaaaagacacgtgcaggagttagttacctttgtgtttttctttttactcagtgtcctgtgggccttgcctggtgccttatgtataggagtgctctgtatgtgtttgaatgataaatggactcagatttccttaacataagcgtaaatattttatcatcgtgtgtcattatgtgccaggcaaacttagttatatttgctcttacaatggttgtattggatattgctgcttaatattgccgtgtaacaagcaatcccagatctcagttttttgtttttgtttttttttgagatggagtctcactctgttgcccaggctggagtacagtggtgccaccttggctcactgcaacctcccacctcctgggtccaagcgattcttctatctcagcctcccaaggagctgggattacaggcacgtgccaccacacccagctaattgttatatttttagtagagacagggttttgccatgttggccgggctggtctcgaactcctgaccttgggtgatccacctgccttggccttccaaagtgctgggattacaggtgtgagccaccgcacctggccccagatcccagttctttatgaccacaaaggttcattttcccctcgctcagctgttggttgggtgtggtttggttgagccaggctgtgcttcacttggccaagccagactccaggcttccatctgggttgaggtctattccacatgtgttttattcagcagcccaggctgcaggggcaacaaatatgcagggccagcttgccttgggcagattacagaggcataagaaggcaagcagaaatgctggaagcctcttaaagctttggtctataagcagcccactgtcagttctgccaagattcccttggccaacacaaattgcattgtcaagccccacatcagcagggtgaggaagtatacctggccagttctagtaggaggtaactcgaagtcatatggcaaagaaggtagatgtatatggaggagcaaagcactgagaacaataatttcattcacaatggtagagaatgaataagacggaagagagcagtttgggccaaactagccttttgggagcttgcgagacctaggctgactgggtgaaaaatcatatgcatttggtgcaggtaccagcccaggccttggcatttcctgtacattcgctggcatgcgctgcctctcggctggctggacattgatcatatcctttcactgcgatggggctcgtgggagtgctgcctatctgtgggaggagcagaaggatgggcctgattttcttcgggttagccatcatgacctgacaggctgccagctgtggtggcaggagtgtgacaagctgagagggcaaagaggacaaagaaggaccacagtgttgaaggaggccaggggcttgcctcagcctaagtcccacctgtaatagtcagtgacaggttagcatcagtgcctgtgtgtaccatgtcccaatcttcataaggatcctaggctgtagcttccagaccctgccttttacatccaaagaaacaggcttcaggaggtgaggtgacttgtcttcagccaaccagctcaaaaatggcagatgagagccaggccaccctgttcccagtctagggtctgtctttccacaccctgtggttgtcatagtctagcagagtccggactggtgttgtgtgttatagtatattctggccctgtgatgacagagtctgctttggaagaagccatgtgagcctcgtgcccataagggatgacataggcgaagcagaatgagtgaaatactggccaatgataagcagccttgctgttactgctttgcaatgggccatttctttagtgaagagctgctagactttgaggaagaaaaggctctagccacttgtgaaaatgaaccaggaatagatggggaccaaaaccttgtaaagccaagggtgtgaggagacagacactctcacatgtgctgagtgtgggattataaattcactgggcttctatctagagagcagtttggcaatggggctgcttttacttgcaagtaaacaaaactcagttgaaggtggtttacataagaataaaaacagcaaaaagtggttaaaaagtggtttaaataagacatttcaaaatgacatttgttacctcatgtaaacaagaagtccaaagtctgggctgttgggggagttagtttgaagacccaggcttatttcctctttcctcgcctcagtgtttgatgtttgccttcaagcttgtttcctcatgatctcagtgtggctgttgctgctccacccatcgtatccttattccatatccttattcagagtgatgtccacaggcaggaaaagaggaaagaacagaaaagatgcaaatcagcatgtattctgagatcccatttttttgttcgcaaaaataaacaccttcacatttttctttcccccccctcacctgacaccatcacaataaaagtcttaattttttcagcaccataagatggtgaaaaaaaagtcttaatttttgattgtgaatatcaatttctggaaccaagaattttggttatttctgggccatgggatggtgctgtggttttgttttccatttcatgcccttcttggctgtttgaattttataaatatcactgcatgtattacctttataatacaaaagaaagtgataggtgttttcttagtaggggtgggagatattaaagagaggaaaccaaggccctaacaggggcattatctgagacatgatgtgataggataggagtgcatttagctgtgtgtgatcagcctagagggaggttggggaaggggaaaagtccaggagtgaaataaggtcattttaaatctcttttggtacctggcacagtgtcttctacctagtagagacaaaaactcatttgaagtatgaatgaatgtttaggtcaagacctaacacaactttatgaggggctgaaacccaaccaagcagctcaagtcagcaagaaagtacattctgctggaaatttatcttgcaaagaagtatgactgtcatttcctaccttttccttgagctcccagaatctaattcattgctaaggaaacagtgtaagtatgagaccttctgttcatcatctgtctcctactgaaggctattgtcccaggatctggataataaagctgtataaggtttttacaactgagggtagagcaaaggcaagaaaccaccatctcatgttaactgtgttaatagtctgtggcttgaatggagtctagatgtttaaagtctactaagtgtagaatgaacagtcatttttttttaaaggaaaaataaagttctttgataccctggactaatacataaaaaattgttatcttaatgatgtgacacagataacagttgtgagatagggattttcaacctgattggccagtattagtagaagagtgtgaatatgcctgttggtgagatgaaagaattatatgtagtggtattttcaagtctaattctcttccatatacaaaaataaaatgggtattgaaggcctttttaatggcaagggtggaaggaggggaggtagagtactacccttacattgtgccatagtcttaattcccttgctccagggttctaagtttgatgctcataaatcaaaagaaagaatgttgtaactgacatttctattgagttacttttaacttttgtacccttgggttttagcattgaggccttctgcaatggccaccggatacccactttattcagacaatgataatatcgttgagctatggtaagatcatttcctttggaacaaaatgaaaagctttcagtgttcacaattggaggaaaatgtaaaagcttagtaggcctcctctgctgcagggtgaagagtttgtgtttgaacaccatccactttgctcctcaaatgtgcagtggaatgattccagtgtgcttttgaaatacagaaaacaagtgtaccttttcagtgtgtgtgtgtatttatgcatgtgtgtgtttaatgggttcttggaaatacttggaagaaaagtaatatttaacatctttttttgggatcattttgggatccaaagaatctgagatcattggtacgttatgttccagagtagccccgagttaaatttcttgagagagagagaaagtgcatgtgtttgtgtgtgtgcataagtattactctaaagaccaaatgtcatgcttacttgacatgatcttagtatatatccttatctgcttctcagtctatattatatctgcagattttgtgactaagtggtgtaattttacatgaattctgcatctgcatcagaaagtatgataacaattaatgatactaacacttctatgtcactaaacagtgcttgatactgttctaagtacttaacatgtattaactttttttttttttttttttaaagccaaagccttttgtcacccaggctggagtgccatggcacgatcatggttcactgcagcctcagcctcctaggctcaagccatcctcccatctcaacctcccgagtagctaggaccacaggcacgcaccaccaaaccagggtaatttctgtttgtttttttttttttttttgagatggagtttcgctcttcttgtccaggctggagtacaagctcatgttgcccaggctggagtacaatggcgtgatcttggctcacggcaacctccacctcccgggttcaagcgattctcctgcctgagtagctgggattataggcatgtgccatcaagcccagctaattttttgtatttttagtagagatggggtttctccatgttggtcaggctgctctcgaactcccgacttcaggtgatccacctgcctcagcctcccaaagtgctgggattacaggcgtgaaccaccatgcccggcttatttggtttttatagtaacgctattgattccatttttaccaaggaactgagatacagagagatttagtaacttgcccaaggtgacataactagtaaatggtgggggtaggttcaaaatcaggcagtttgctatttcttatttaaagccacaattcatgagaattgagccattctcaaatgtacaggttattcttgtaaattggagactattgtatcagtgttacaaatgacctattgtaatctcccatccaagaactaaccatttctgaccctgcttagtgtcaatagtcaggtgcattcagggtggtgtggctggagatgatcttatatgatctgagccccttgcttcatgaacaatattttcagttactttacacagtaagcacgtacttaaacaattatttggctgggcgcagtggctcatgcctgtaatcccagtactttgggaggctgagatgggaggctcacttgaggttaggagttcgagaccagcctggccaacatggtgaaaccctgtctctactaaaaatacaaaaattagctgtgcatggtggcatacgcctgtagtcccagctacctgggggttgaagcaggaaaactgcttgaacctgggaggcggaggttgcggtgagctgagatcatgccactgcactccagcctggatgacagagtgagactccgtctcaaataaacaaacaaacaaaaaccccaccaaaccaaaaaacccaattattttaattataaatctgaactgcattaaaagatagtaaatttagctagtcaacttgaataacttttaacagagagttagttgtctcttctgtttccttagggaagaaagatgagttccttcagttcccaaatgagtcctcaattcaacatgagtgatttcaccagaataaaatcttcttacttctgcaaaaagcagctaatgctttcggaagctaaataatcccaatgtgtgactcctgccagtttcttttctttgaaacctcagcagcagcataactagtgattcacccttcttgaaatgaatgctgtgattcgcgttatgcacagatggctactgaatgcccaggtcacagcctttgcgtctggccttgactcgttaataagaacaggaactgggcatggtgtattgcacagtgattaagggcttaaagctaagagcagtgcctggccccaagtaagacatgagtagaactttgctgctgctatttttgctgttgtatattgggctctaccttgtgctgggcactacgttaagcacgctatgtgcattgcctaattgaattctcatcacattcccatgaagtagttgatggttttgtttttatcttcattttcaaatgtagaaactgaagcttaaggttatgacatttgcccaagaccatgcagctggtaagtggttagcgccatggtacgaaccaagttaaaaaacattttttttaattcataaattataatgtacagaatcttctagaagctttcttgtgcctcctcctgattgttatttttcaacaaagttgcctactattctatcaccacagaaaagctttgactgttcttgaacttcataaaaacagaatcatattcatacagtatgtactctttgtatttggctttttttacttagtattatgtttgtgaaattcatccattgatgtgaaatacatggatttgcatgtagcgataatttgtttttcctcattgctaaatatattgctacatttcttattgtatagtttaatgtacaaatatgcctcactgttgatctcttctactgttgatggactttggttgtttttagttcttggttgttatttattgtgctacttactttctttctttgtttttttttttttttttggaaacagtctcctctgttgcccaggctggagtacagtgatgtgatctcagctcactgcaacctccacctctgggttcaggtgattcttctgcctcagcctcccaagtagctggggctacaggtgcatgccaccatgcctggctaatttttaatttttaaaagagacagggtttcgccatgttggccaggctggtcttgagctcctaacctcaagtgatcttcctgccttggcctcccaaagtgctgggattataggtgtgagccaccatgcctggcctaattgtgttcattcttgtacatgatttgtatacgtatacggctctttgagtacatttctaggtcagcactgctgggtcttaataggtgtggagctgtattctatactgtgaaactgttttctacactcccacctagcagagggttcagtggttctgtcctaacactgtaatgactatcatcattctggtgggtgtgtagtagaatccatatcaaacttgatatggattttgactccatagcctatggacttacctggtaagaacaattttaacaattatagcgctcttgctatacggaaggtgttgtgctgatatgtaataatgaatataacttgatttctgccctctaggagtttatagtccagtggaagagaaagactcagaaatcacataatcatagtccaacacagaatccatgcatagggcactgttggagcactgggagagtctacttcaatctgtgggttcaggacggggtcgctaaagtcttgcagaaagaagtcagtcttctgggatatggcttcttcgggaaggtgacatttaacctgaggctgggggggatgaaaatagagtcatgtgaagaggaatggatcagaagcctgtgtagccacagggaggaagtgaacaggtgatggtaggctgaggtcaaagagccctggagtccatggcatttgtaaaccattgcgggccttgaagtagagagccaatgttgctatgaagcagtcaaaacggttctccttcatcagcctgtgacccacaggggacccgcaggcctttgtggaggctgcctccatttggcggagtggtggtgttggagaaaatggccttactgactcctgaactaggaagctcctgatcctaactctcttagtatctcatcttgcgaattactaagacagggtctttaagatgtcttatttattttttgatgtacattttgtaaattaatttttataatgcttcaaaagctaatttttaaattataaaagtaatagaatcacattacagaagccagaaaatggagaaaaaacccccactatcattttattatatagtttttcccatcgttttaattgtagggtatagattattttatgttatccccgtgtcctttgacatgtgacgagccttttttcttgattatgtagtcttcattactattttattattgtagaatatgaagtggaacaccttgtaccacttaaatttcctctttttttttttttggagatggagtctctctctgtcgcccatgctggagtgcagtggtgtgatctcagctcactgcaatctccacctcctgggttcaagccattctcctgtctcagcctcccgagtagctgggattataggtgcgtgccaccacaccatgctaatttttgtattttcagtagagatggggtttcttcatgttggtcaggctggtcttgaactcctgacctcgagatgcgcctgcctcagcttcccaaagtgctgggattacaggcgtgagccaccatacccagcaccatttaaatttcaatctttctttcacttttaattgtaatgagaaaaaaccaatagatgcttattgtaaagcatttggaaaatacagaaaagtataagatgaaaattaaaaacttttcagttctaccatgaagataaacacatgttaatatttgggtatatttcttttttcccctctgcttttatttacatatatgtatgcttttctttccttttttgtttttttgaatacaaattggggttttttttcctgcaagcaagatactgttaatggggattttggatggccatataatgaaataggaaaacgattaatggaagcccaggaggaaagacttggtgttattataggtttgtatcatatcaccattttcctgttctatttggaggaagagggaaaggggaaaggaagccagcccttattgtgtgcctgccacgcacctggtcctgcagtgctgggaagcactgtgagctctgactcccagaaaagtagacgctggcactgtgggaaagtgggaccctcatggcagcgtgttgtttgaaaaaccagtctttcaaacataataactgagcatgttggaaaaccaggctggcgtcatggtgtaaattgagtttactcaaaccggcaggttgttgggaaggtacacatacctctattgttttaacccacttgaagattaaaatgtgggaagagcattttgaatagagaacaccgtactttatcatttggtgcagaggccttgtatttttaacaaaaattgccccaaagtttcctccaaatgcattaaatccatgtttttgttgtttaaccatgaatattttgaaaaaatttattattttgaaaatccaggccctttaaattttatttttgctctcacaaatccttctttccttttgagttggcacataattgtacatacttatgagaaaacaaagtgatattttgatacatgtatacaatgtgtgatgaacattaatagaggattggctaaattatgatatatataaagtgctcagagaggtggaggaggtaataagatagaaggtggactttttagggaagtcctttagagtaattagtatattcatcacctcaaacatttgtcagtcctttgcattgtgaacatttgaaatcctatcttctagctatctgaaaatgtacaataaattaacttatttctcctatctagctgtaactttgacctgttcaccaacttctttctatcctaccctcttctctacctttcctagcctctaataaccatgattccactctctacttcttcaatatttaatttaatccccaaattctaattgtagtccatatttgaatacttcatattattggtcacaattttgggctttgtattattggtcacaattttggttgattattttttgaaaagtagaatcttgttttttgaagccaggcttaatcacctgaagacccaggacatctatagttgttttttttttttttcctaacaaaattctgtatgcggaaaataggaaaaataatacaagaaagacacaagaaatggacagtgctacatttctgattttacatcttcatgacaatgagtaaagatctctgagttttgtcttcggatcggagtatggaatctgtccattgaggattgcaggtcgagtgcaggggctcatgcctgtaatcctagcactctgggcggggagcctccagcactgaggctggaggattgcttcagcccaggagtttgagaccagcctgggcaacatggtgagaccccatctccatgaaaacttagacactaaataaaactcactattttcattcttattaatcttatttattacttggagatatccttagaggctctaggtgtgtaagtctccttgttcctaccctaaatagctatagaaattgctgtatttctaatacctttttttttttttttaatggggtctcactgtgtcaccaaagtggtggtgcagtggcataatcaaagctcactgcagcttcaaactcctgggctcaagtgatcttcctacctaagcctctcgagtagttgggagtagagatgtgcaccatcatgcctagccaagttttaaatttttttgtttgtagagatgggggtcttgctatgttggccaggctggtcttgaactcctgacctcaggcccgcctcggcctcccaaagtgctgggattataggcgtgagccattgcacccagcctcttctcattcttaggtctgccttttgtggttcttctgtcactttctgtaactgatactgttagcagcttatgcttttgttgcttctacttggctttgggctaaggattgtaacttccatctgtgtcaagttgtgtgtgaaggaggctgagtttgaattgtgttttatgctgggtgctgtgcttgaggcagcttgttgcctaaaaagaaaatggtgggcttcacagcacacacagctttggatgctcaaagcccatttgagcttccattcacttattttctttcttattgtaaaaacaatacatgtttgtgcgggcatggtggctcatgcctgtaatctcagcattttgggaggccaaggcgggcggatcatctgaggtcgggagttggagaccagcctggctaacctggtgaaaccctgtctctactaaaaatacaaaatttagctaggcttggtggcgcctgcctgtaatcccagttacttgggaggctgaggcaggagaatcgcctgaacctaggaggtagagtttgcagtgagccaggattgcaccgttgcactccagcctaggcgacagaatgagaccctgtctcaaattaaaaaaaaaaaaaaaaaaaaaaaaggcatgtttgcaatgaaaattgaagcattacaaaaatgtgttatttaaatgaaaggtaccctgttttatcatctctagtcataactacgctttaaggatttgataatttttttttagatttttctgtaactttatattttttacagagatggggttactctatgttattttggtactgatttttgtatttttaaaaatatatttgtatactttctatggctgtgtatataaatttttgttggttgtttttaatagcttcctggtgttccttggtatagatatatcgtaatttagccaatcttctattaatggatatttggactattataaatacctcatatataagtatttgtactctctgaagtgtttgtataattcttctgttcagagttaattactggaaatagggttggacggtgtatacattgagccagtgcgcccagctgcttttttcttttttaaatgcagaattttaagcctcaactccaaaccgtccgtcagaatttccaagaatgggtctcagggatttgaatttttaaaaagttcccaagtgattctgctggtgcccgagttctagcatgcctaagacatttccttaccagctcgagtgtttcataaaatatgttcaattcaaaggtggatggttgtggaaaattattcaaaacagcttcaacctgatgaagtgtttagttgtccttgaagaatcatttcatttgagccttcatgctttaatacctatccttttttctactaccaattcttctgaacttagtagcactccaaattggctcattctcaaatttccttatgacgcattctgtggtaaagactgctaattttatatccagcagtctttatattctcctcttcttcagtaaccaaaaacttgatttttttggagggtgtacagtgtgccatgccaaaagacagtatttcccagcctccccttctcctgttgatgggctagtgagttaagctctagtaagtgaaatgtgaaggcttgtggaaaggttctagggactgacttctatggacaatgtaccctttttctttttctctgtccttctacatactgcttggaacatggacacaatggctgaagtccagcagccatcttggattgtgaggtaacgatgaagatggaagccatgtgatatggcttggatgttttgtcccctgtaaatctcatgttgaattgtaatcccccatgttagaggtggggcctggtgggaggtgtttgggtcatgggagtagatccctcatgaatggcttggtgctctccccatagtgagtgagtgagttcttgttctatttcatgtgagagctggttgcttaaaagggtctggcacctctgttgctcctgctcttgccatgtggcatgcctactccatctttaccttctgccatgagtaaaagcttcctgaggcctcactagaagctgagcagatgctggtgccatgcttgcacagcctgcagaaccgtgagccaagtaaacctcttttctttataaattacacagcctcaggtattcctttacaccaatgccaaatggactagcacaccatgctctaagtagggcataaagaaaggagcctggatccctaatgactgcagagccatgatcccagccctggactgcttgcctccacacttctgtcttattggttaagccaaaattattttgggttttccgttacatgctgcagaacctaacctaatgaatacccctgctctctgttggtttcacagtgtgtctccaacaccatcttgaaggtgcagtgacttgcatatagtaggtgcttggtaagtgtttgacaagttaagtacccaatggcattgaggtaaagagttcaaaggcttcagctgctctgacctgtccccttttctgctttagattaagttattcatggggaccttttgttttttgccatctcaccccccaggaaggtatttcccagccctcagtgcagggctttagggctacaggcttgaatcattttgacaagacagcaggcagaagacattggagattctaactgcacatatgcgtaattccaaatgaaaatataaggggtgggcacttttctgaatctcctagagaaactggaggtggtggttcaaatgatgtcagaaaaggccaccattgaatcctttgctatcatttggaggctgtactttccacaatgcttgccaggacttgatgtcagggaagactttcaaggagccttgattgccagctattgacgaaggggtctgtctgctcagtggcaacctccatggtggtcttggccagaccagcctgcccctgactcatgctgagctttgtcagccaggttgaaacgcccctctttggggcccaggacaacatgctggtttcccggaagcatctgggccaagactctgctgctaagaaaatgatattgtttttgcaagcatgggagtgtgtttaaaatgcttcccctttccccccaacaacattaaacctccatgcaaagaaacacgaggttaaaaaccatctcccaaacccagaaaacagaatgcaaaacctgggaggtgaattaactctttactgatgccaaggagtttatttcaaaacaggattcatcgactacagggatttgcagtctgccctcctgtgtgcccactgagagcaatgggcagaggctgacccgcagccctttgtggggaaaagtaaattccatggcagacctcagtggctgaagattatttgcttctcctggaaataattagaaaaatacttactctttgaaaggcaacatctggctggctagaggcaggctggaaaatactcaatctaaatagatggaggtgacgttgtgcagaaggaaagaaacatcccgagggagtgtccagtgggttttaatggccgtgtctagagaggcactcctgctctgtacaagggctggcttcttccctggatctaggggttgcccctgccttttagaagacagatgcacagccccagagcctagttgcctcccctgaccccctccaagccttccatagaggaaaggggcctcccatagcactggctgatgctcagagccaagagtttgctgcccagggagtaccttgagctagtgctgggtgtcagacttgactttccaactacttccagtgcaattcaaggtgttgattttgactgctggaactgtctcttccttctcagccctttctcaaggctgcctgtgtgcttgttcttattaaccaagcccagaagccagggatctggaagcctggcagtatttccaggaaagtagcttatttctctcacttgcttctccctgctgagcttagaacggcccagctttggacctcttgaaacatcagggcaaatttttccccctctttcaatttgcatctacctgctggtgaaaaaagcagaacagcatcttcatggatttatgaacgctcagagtttttaaaatgttttatagcttgtaagatattttcaagtgaagaatgcagttctaataaatccaatgaacctgtcacagattttctgaaaccaagtgtctatgaaaaactatggtgatgacatgttgaaggtgcttattgaaaaatatggatccttgtagcgaacatttttgcaaagggtgcattttcacataaaaatgcttttagtagtggcttcgtttagttattctgcagctacttggctgtgggttcccagagagccctgaggcaacctttataaaaggcctaggtttgacttctctttggtcacttcagctttagagcaccctaagaaggctcagagaaccccaaatttcttcccagtaaagaggtcatggaataaatctggaggaactcaagaggggcgcctgcttttgaacagtcattagccaaacatgggtagattcctattaatcatgtcaagagggtacttgggaatcaagttcatgtggaattgggagattaaaagggttaggagtccttggagccgtaagacccctgaagttccaactatgctacttgctttctgtgtaatcttggataagaaatcacttgacctttctgagccttgatttccttacctgtaaaatgggaatgctaatcattgtactgcccaccatactgtctttttatgtgaatcaacaaagccacatttgtattggtgctttctttcctttcttttttttgaaatatgagatgcttcatgaatttgcatatcatctttgtgcaagggacatgctaatctctattgttttaattttagtatatgtgctgctgaagtgagcccatattggcactttctaaagtgtaaggtgctgcgtccacattaggcattaagatgatggctgcctttttcacttcacccaccccattgcctccattgtcaatgatgacgttaacatatcattgtttccctactcttgagcggggctgctttctatctcacactctgactcgggtgtctgatttctcccatcactctggcattgactctgggctacccttaggtgctgctcccgatttgggagctgtgtgtgacctttgcttttcctgccttcaggtaagattttctctttccaaacctttgtgctgtgatactgtctaggttcctgaatttctgtgacatcctttgatctgtcatttgcaatctccagctctttcctacctttcaagggtgtgtggtaagcttggtgagtggggagcagagtggagctggggatcctgagaaggcagttcattcatagggctctttctgtgccttcttatgtcctcctccctcagcccagactctgagcctttccccagggctctaagaagatagaaaaactcgcagaaggtgtggaccttttctttcttttcctttttctttttctttctttctttctctttctttctttctttctttctttctttctttctttccttctttctttctttctttttctttcttttctttttctttcttttctttttctttctgtctgtccgtctgtctgtctctctctgtttctttttttcctagtggggctacaacttatgcttaatacaaataaatgccttttattcatttaatacagatatttaccaagtaccccctgtgggtcaggccctactctcaccctaaggatacagcaggaagcaaagcagaggtggagaagatcccactaaacacacaggcaaggcacatcagtgggtgatgagcgctaagaggaagtatggccagatgaggtagagggtgaggatggggcggagagaatcctacctgttggcaaagccttttctaccagatggtccaggaagatttatctgataagcaacaggagggtgagacctgaaggagcctccagatcagggctgcctgggggaagggcactgtgaagaggggacagggacgctgaaggccctaaggcatgaagcataagagcaggaggctgctgggtgtgttctgggaacagcaaggaggccacagtagctagagggagggagtgagggtgggggttctaagagaaggagggcagagcattctgaactttacaggctggcataagggttttcatctgatgggagttagaagccagttaagggttctgagaagggtggaggcgagtggctcagctaggagcctagtgaagtagcctagaactttctgtggaatttgttctgcaatcatgcgaagtggcagtggcatggtaacatgggtaagtggtagtgactagatcctgagatgggaactgaaagcctggagtgaatgtctcaggaaacccgacacccgtctggcccagagggtccttatttcaaaactgtgtttaaaatggcaaacacatgagatcatggtaatcaaacttacataagtactgtgcaaatccagaaaatttgtagtgagtgtactgaattatttgccaatgatcaatagtgctgggctctgaatgcaatctgaaataaaaattgttttcctgaatgtatttatcaaaatactgagtgcttaccaaatactggtgcttactgtactagttgacccgtacaatcagtttaagtaagctaacttaaatttatgacttttgacttattcctgatctattcacaggccgcttggaatgttgggccatctgtccttttgacatgaattttccctgtaatgggggtagagctggtaactgttggatcatctgattattggagacagaagtcctgtcacttgcccctgctgttaggaggtgggcttcctgaatggctttctgtatacatgaagaatttcaagaccttccgttaaggtggtcagagctaagtttcagcgtttacaagaggtctcttggctgacttgctataacttacagcaacctgatgtttggacaccttttcctttttttgtttttagtaaatatgatgagaaaaaagactcctcatctgttttgttttattttgtgaattacttctattcttaccactcaaaaaaatgtttaaataagtaattgcgaaaaaatagggggttttgccaggcacagtggctcatgcctgtaattccagcactttggaaggattccctcaatttttagagggaaggactgcttgagaccaggagtttgagaccagcctgggcaacatagtgacaacctgtctcaacaaaaaaaatttaaaaataaccgggcgtggtgtgcatgcttgtggtcccagctacttgagaggctgaggcaggagggtcacttgaccttgggaaattgaggctaccgtgaactgtgattgtgccaccacactactttggcctgggcgacagagtgagaccctgtctcagaaaaaaggcagggtggtggggcttgacaatttgtttaatatctgaaagtattagaaaaaattattctcaattttttttttttttttttgaggcagagtttcactctttttgcctaggctggagtacagtggcatgatctcggctcactgcaacctccgtctcctgggttcaagtgattctcctgcccccgcctcctgagtagctgggattacagatgcccaccaccacgcctggctaatttttacatttttattagagatggggtttcaccatgttggacagggtggtcttgaactcctgacctaaggtgatccacctgtctcagcctcccaaagtgctggcattagaggtgtgagccaccgttaccagcagaaaaaaaattattctctttggtattttcaaaatatgtggcagtgagagggtgcagtaagttaggagttaagtgacctgactaaatatctgtgttctgctgaaatcttgcagaaagtgggatgctcaggaagaaaatagtctatcccacgaagccatttcccacaagcagctgaaggcagggcacaccgttatgtttattttggtaaagggaaaacagagttaagtttctcaggggccccaaacctcaaggatgatgaacacacacattcatacacagaagtgacttgcgttgatagacatccttatcttgaatgcctcactcagagacaaatctttccacaaatgtgcactgcccaggtgagccttttggaatcggagaatcaattattcaagaatgtgacttttaagccccaaagcaaagtttggacagttttcccagagccaaacctctggatattagtccacttttccgggataatataatttaattttagtttagttttttagagatgaggtctccctttgttgcccaggctggtcttaaactcctggcctcaagcagtccttccaccttggcctcctgagcagctgggactacaggcacacagaccgcacccagctcattagtgtccttttctgtcaatgagcataggggttcgtagacgccctttttataaagagatacgttcttgaaattgcctttaggccagacacagtggctcatgcctgtaatcccagcactttgggaggccgaggcagcgggatggatcacttgaggtcaggagtttgagaccagcctggccaacatggcgaaacctcatctctactaaaaatacaaaaaaattagccaggcatggtggtgtgcgcctgtaatccagctactcagaaggctgaggcaggagaatcgcttgaactcgggaggtggaggttgcagtgagccgaaatggcaccactgcactccagcctgggtgagacagtgagactctgtcacacacacacacacacacacacacacacacacacattgccttttgacttcctaccctcaggcatgtgtgcattaattgaggacattaggaactaaccacgtgcacacgcgtgtgtgctgagggaacaaaaggtctgaaatctggtccaggggagagttggcaaggtaaggcctggggaaagcaggctggcaagctcaggaagcagaggggcgccatgcatttggagacgtgtgagtaggtgcagagcctgcgcaggggaggcacatgggctggagatgtctggggcctggtcttgaattccatgctgaggagattgtgtttttatgctgaaagcaaaagaagaaacaaatcactgagtaatttttaggctgaagtacaaatttgaaaagatgacggtggccatggggagaacaggttggaggaaaacaagcctgaagactgaggatcaacttagaaggccacagctgtaatccaatagagatatgcatatagctctaattagggccatggtgtcgggatggagaagtatggctgagaggtttcaggaggcagggtcaacaggaagaaatcactaactgatgttgtgtgaaagggggagggagaaggtaggatgcttgcaggtcccgagagggcgtggagttgactgatgccatgttccatgtaagtcaggagctgttaggaagagtcaagtcgggctgggactgataggacttttagacatttagaagctgctaaaacaagaatagaagttctaagttgagtctaaccagggagttgttcttaccagaaaaaaatagagaaataagtccaataaaaccactgcttggtttgaaaaatcaagtgggaagggaatgaagaacaggaatttctctgcagagcatcttcatctgatgcctcgtgtgaggatctcgccctttctgagcctgagagatggcaacgatccttctgttctggaagattaaaggcacaagccgttagcccagaaggtacttcagctgagatggtttggggttctgaccagtgaggactcaccacttcaaggaagtggaatcctgtcttagttcaggggatcatttgcagtgtgagggtcaggcccgaggtagcctggcctaggaaaggaggcaagagaggactgtggagtgagacagactccgtcaggatcctaggtctgtcagttgtcagcttcacaatcaaattacttgaagtcattgtccttcagttttctcattttacatgtcgttaagtagattaaatgtgaacctaggcaaagtgcacaaaacagtacctgactcatgatagttcctcagtaaaccctagttccttagttgatatggaggatggtttataccaccattgggctgtatttcctacccttggccttttgacctaaatgaggcttgatccctggggctgactgccatcatctctcctctcttctattccatgtcgctggctatgtcagcagatgggagagtgttctggaagctttcccatcaccacctctctctttctaggcaggcattttggctgtgtctgtgtggtcccaacatgtgtacgtgtgtgtagcagggagggaggagtgagtatgaagaggtccaataacaacaattgagaaagataaaataaattctttccacaatatcggaggctatattatctgctaaactagtttttcaaaatgctaaacttttgcctcttaattttctcatgcttatgaggagtgcccttcaaatcttgtattagtcaggatgtaattgtatcgctttagcttcttttctctcttgctaaaaaaataaaatgcaatccttaataagagactgaagttcgtaacgtttgtgtcttgtcagattcagtggggaaaaatcagatttgcttgaaaacaagatgataaatatgtggtgttggtgttttcatacaagaatctaaagataagctgtaacagcttagagaacataattgttactgtaccacaaagaccaagttttttaaaaaataacttttgaaggtcttactaaaatttatcacatttataccatgttggatggtgatattggccatgttttcttaatatcaaaatatgactaaagagtgtcatatgttggactccatccacagacacagagacttttctgacatgagccggtctctgagtcttcctttttagaatacgagcttattttctccagaatcatcacagctgtctagagccttcctgttcctcctttcttggagtcactgctggcttcatatttgttcacttggacgttctcttgtataccaactgtgatctctctggggagtcaaaaccagatctggttttccttgtcctcagggaacttgcagtttagctgttctgatatttgtgccatgcactgtccagatgccactagttttctttttttctttttcttttttttttttttgagacagagccttgctctgtcacccaggctggagtgcaatggcgcaatctcagctcactgcaacctccacctaccaggttcaagcaattctcatgcttcaccctcccaagtatctgggattacaggtgtccgccaccatgccaggctaattttttgtatttttggtagagatgaggtttcaccattttggccaggctggtctccaactcttgacttcaggtgatccacccacctcagcctcccaaagtgctgggattacagcatgagccaccgcacctggcccagatctcactagttttttttttttcttccccaattctcttttgatgtggataattccactggcctttggctcagctgctgtatagagcttcttaatatcttaaaaaacctcactgagagccttggtgctgtcttccacccctttcctagtcctggaagtttacttattttaaacaagagcatcaaatgcttcttggaaaattccatcagcgctcatattttctgtgtttgctgtcgattatctagcattcaaagccccgctaacgttcagagcttcttgttgtgtgacattcgcaggtttccttttgggacaggtttggattgacttccttcctctgccaagagggcaaccagctgatgacagtttggagagtttgtgttggcatcagacgggtgctggtgatgtgcctgaaagtcactcctgagattctcgtttatttctgtcccaggctggagtttcacaggcagtggatgttagtgggtggcccgaaccaccctcatcctagctgtagacagaggcagcttcactcagcagggagccttttatcctcaagaccttttctgtacagataaaacgctcagataagatctggagaaaaccctttgttctttggtggctctgcatcctcttttctcttaaatgctgttccttactctgctctcctctggcctctttggtgtgattatcttgatgttctctgtatctgttaagggatgattgttgtctgagtaaatatgagatggcatctttgattatcacatttcccaggaacctggctgatgcgggactcctttctcaaacctgcttgtgaatggatagccaggccctgtttgccttcctccacctcatggggaactcattgtctcctgaaacagcctagtttatcttgacgcatctctgtgagaaagctcatttccccctttcgattgaagtggagtttgtgtccctggcacatctactctttattggttgttctaacctttggagccacacagaccaagtttaatcttcttttcacatgacaaccattctggtattcatatgtgatgagagttgatcatgcttccagctctactcccctccttctgtacccagtgccatctcttagtatctcagtttctttttttttctttttgagacggaatctcactgtcacccaggctggagtacagtggcgcgatctcggctcactgcaacttctgcctcctgggttcaagggatttctcctgcctcagcctcctgagtagctgggatgacaggtgcgtgccaccatgcccgactaatttttgtagttttagtagagatggggtttcaccatgttggccaggctggtcttgaactcctgaccccgtgatccactcaccttggcctcccaaagtgctgggattagggcgtgagccaccacacccggccttcttctccttctttctttctttctttctctctttctctttctctctttctctcttcctctcttcctccctccctccctccctcccttcttccctccctccattcctccttccctccttccttccttccttttgagacagggtcttgctctgtggcctatgctggagtgcagtggcatggtcaatcatggctcactgcagccacaacctcctgggctcaagccatcctccgagctcagcctcctgagtagctgagactacaaggtgcgcaccgccatgcctggcaaatttttgtgaagatgggggttttgcccaggggttgtccctaggggttgcccaggctagtctggaacttctgggctcaggccatccatccccctcagcctcccaaagtgttgggattataggcatgagccaccatgcccggccagcatctcagtagggaaaccactccttcctggccgctcttttttctcttttcttttaaaaaattaatcaacagacattttatttagaagataagcatagctaactagatttcttcccatacccacattcagtgataaaaagtagatcaaatgctttttggatcccttttgacctttttgacaacaatgttgctgggtagatttttgtgggagttctctaccatcgggcacgcttggctgccacagggcaactgcttggccttttcatcccccagtgtcggcatcagttttacagggaacattctgtggctctttcaaggagatgcctccagagccccatttgcagtcatataagttgtgttgtagtacccggggctatggatctcatgaagttatttgtaatattctaacagaaatgaaaagtcttaaagcctcaagtgacttgaaggcactatgtgaagagaaggtttactaaagtgatctggatgtaatataatctggctgctgttttttgtaaaccagactcttggtgatcagcctcaagcagagggggctgcctacatcagctgggcatggagctgatagcagcatcagcaggttccctttgctaagggggctgctgggctggtggccccttcatcctttgggctccctgcatgttcctcagaggctccgaagaaggcagacggggctggccgtccatcacaggcagatttgaacagggaatctaatgtcagccccacaataagagcaggtttcttccaaatctgagagtcgaggatcccatcttgtatttactcagtaacagtcatccctttatgtatacacagaaaatcaagataatcgcaccaaagataagcatagaggtgagtgcagtgaggaacagtacttgtgtgaagagacagacttttgagatagctgtgtggagttgttctgggttcaaggggagtctgcagtgtggttaactgccctgccctgttgaaactagatatatcatttccagaggtcaccgtggtgtttgccaattatctcacagtgaatttgtcacctgtgttcctcacacttttttaaaaccaaaacaacaacaacaacaacaaaccaacaaaaacaatccaccaaaaccaagatttgctttcacgtctcatccaccctacaatcaaatgattggtttcttaggccgaggttagggttaggggcttcaaattctccttattaaacctcatttttgttagacttgatccatgattccagcctgctgatctgtttggctcctgaactctcatatattgcattgtctatgtttccgaagttgtagtggttaaggacacaggctttgggggtgagagagaatgggcataaatcccattccaccacttagtgggttgtgtggttttgggtaaaggcacaatgaagaatcttctggggcatttcacggagcagatgaatggtgtcttatggaacccatggcaggaggcagcagccttgggaaggtagaactcggacaactgagatcaaatacatctccttatctcatctcagcttcggtctgaacatttaagtcctttttcttttcttcctggaggctgactcttccatctgcatgataggcataacagtgtctctccaaagatgcccaattcctaatcctggaatctgtgactatgccatcttgcacagcaaaaaggatatgcttaatttaaggaccttgagctggggagattatcctgcattatttaggataatcacaagagtccttatatgggagacagggaggcaggaaagttggaatccaagaaggagatgtgacaatggaagcaaagccagagaagatgctacgctgctggcgttgaagatggaggaagggaccaagagctgagaaatgcaggtggcctctagaagcaggaagaggcaaggagacagagtctccctaaaatgaggaatgcagccctgttgccccttgattatttgaatcattttaagccactaaattgccaaaagattccttcccttaaaagtcttccagattctacccaccctcttgcagtaatgagctccccacctatctctgagccccatttggaggcagggttgttcctgctttcacatgtcctccatcactcttgtctccctcagtgcctggcacgggcccaacgtagagcatgttcttggtaaatgtctgtggaaccaaagcccccaagggaaagctgatgatgcctttcagaaatccagctgcatgattacagttctttgggctccttctgtagtagctctgccagaaaagggaacaaggttagtttctcctgattttttcccagcgaacctccagtgggattagagatggcggctgcttccctgagtttccctttgccggccgtgggatccctgctctggggcctccgtgttgtgaatgcacctcctctctgagactgaaccgctgtctctgtagtcctcaaatatcagaggttgggttgaaaaaacccacagaaatacagttttgaggccttctagttcttgagtgtactacaattgaaaaggtacttccacattgctgatcccttttagtccctgtggtagccccttgaagcagccaccctcttttcgatttgctcagtgttttttttttttttttttaaattgtaaggatgagtgtaacaacttctagcctctttacatgtagggttggaaaccgaccattcctttattttttgttcagagttgcaggttggtaacttgcccaaagtctcactgcttgtttaggcagaagaggtttctgttcccagtgctgttggaacctcagctcaccacctcttcaaagtcgtcaggaacattctcattttcctctaagatccctggctagacctttgcatcctgctcttccttctacttaagccagcatcctctcctgacccctctatccctgctgttaagatagccttcttggtgtcagggcctacagctgcctgcagccatcttgcttctgttttgaatttgtgttgctccaggaaggcctccagattggcatgctgctctcagaaggcacttggtatcacagtgtcctaggaacttgtctctactgctggggtgcacacacagatgctttagtcagtgctggagtgttggttacctggaaactgcatcctcagccttctttctcttcataatcctctacaggtggtccccaacctacaaaccagatgagttctaacagcttattttgcagttagttgattgtttggagttaggctgcatcttcctgaggattcagtgtcatgaatggtggttaggttctaggcccccaaccaacatctattccagagttcagctacaatagtagctgttgtatagctgaactctggagtcatgaagagaatggtctttggactcagacaggccttgatgacttctgattctgctctatctgggtgaccctgggcaagtgatttaaccactgagcctcagttgcttcacctgcaaaatggtgttaattaatacttacctggcggggttgctgaacagtgaatataaggtgtttaacatagtacttagcacttggtaaatgctcagtattatttattactgcactattacgtatctagtttgtttaatagcactaaatacctaattgtttatactgccctttcttcctttcctttcctttcttttctttctttctttcttacagagtcttacccaggctggagtgcagtggtgggatcttagctcactgcagcctccatctcctgggttcaagcaattctcatgcctcagcctcccgagtagctgggattacaggcgtgtgccaccacacccagctaatttttgtatttttagtagagatggggttttgccatgttggccaggctggtcttgaactcctggcctcaggtgatccacctgccttggcctcctaaaatgctgggattttaggcatgagccactgcacccagcctattgtgccatttctgtgggtaaactgactccaaggtcaaatgctacattagtcactcagaattgaaatagtgcttttttttttttttccttctggggatttcagattgctggggaaaaggagtctctctcgttcatttattcattcaattcataagcaattgcattatgccagatatactggggggaaaaggtgagcaaaagccaatatagcccctgttctcatggatgttacagatggatgatggagacaaatattaattaaaacaaaaatcatctaaatgtgaaaatacagctgctgtgaaggagaggtgatgggaaagggtctagggaggtgtttcctgggtatttgatggatctctggattggttctttgtcattgggtggcagacactgtcttcagctaagtggctcagagctttgacagcattgactttgcatacgaacaggggtggaggtggcttgagcctttgggggttggtagtagaagcagcagtccaagttgtctgagatgttggggacaccatcagggacacctaagtggcgggttaagggggaagcatttacaagagaggagtagctgggaagaggcattgctggggaggagaggaggcttcttgtctgtggatcagggatgctgggttctcaggtggtgcttattaaggagtgttttaacttggctaccccttgttttcagccaaaataacaccccagtccatatttcctgccactgtggcttcctatggctaaacaagcgtaatgaatatcttgttccatataattgcctccatctcatgcctcattttttggtactcatttcttgctctcaattcctttctgtttctctttttttctctcctattcggtttctcccgttctgctctgtgattaatcagttcggtttttcatccaattatcatgtctgtcttggagaagcatgtttcctggggaaggttggtctaccatggttgcccagctctctgcctgctccttcttccttctgtaagatggcagtttgctgtatttttagccctctagttctactctttggcttgtgggaaactgtccacagctcataaattatcaccacattgctcataatcacaccctaccttgtctagtcccctgagcttggagacttactgggcttctctttatgtacctgtgatgtgatgctgtgtgttcacgggcccagggagatgtttgccctgttcttcctggcagaagaagagcagtgttctgagacctgaccagcatgtgtgcccggtgacctattgaatgatgtgagtttctctgcgctggccgtccgacatgccagagctggcgggtgagtcgggagttggacatgcagccctggagtgaccacactgactgcgtcagtgggtttcactgcctggtgccttttttttttttgagacagagtcttgctctgtcgctcaggctggtgtgcagtggcgcaatctcggctcactgcaacctccgcctcccggattcaagcaattctccttcctgcctcagcctcctgagtaactgggattacaggcatgcgccaccacgcccggctaatttttgtatttttagtagagacggggtttcaccatgttggtcaggctggtctcaaattcctgaccttgtgatccacctgcctcggcctcccaaagtgctgacagtaaggcgtgagccaccgcgcctggcctcccttttcttgacattgctttaaaaaaaaccctttaattttagaatagctttagactgataaggaaattgcaaagatcatacagaaactacacccaatttcccctattatcaatatcatgcaattggtttgccataattaatgaaacatttttgataaattattattagctagagtccacactttatcccgattttcttagttttatttaatgtcctttttctgttgcctgatcccatccaggatactacatttagttgtcatgtcttggctgtgatgctttgagatattccttgtttttgatgaccttgacagttttgaagggtattggttgggtatttgctaggattggaatttgtctgatatttttctcatgattagactgcgattaggaagtcccattatggggcttctatgtgggaggaagaccacagagataaagcacccttctcatcaaaggacatatcaacatgatttatcactactgatattgatcttgataaagcatgtgcttggctcaatcagtgtctgccaggtttctccactgtgaagttattcttttccccctctttctatactctagcttctgtgaggaagtcactatgtgcagcccacacataagaagtgaggagttatgttccctgtcctctggggcaggttatctaaataaattatttggaattctgcatgggtgagttgtctgctcttccccatttatgtatttatttagttataagtgtggattcatggatatttattttatactttgagttatccaacactattttttgggccattgggagatcttttagttggctcctgtgtccctttgatataccttaatcattgtgggtaattttggttccttttttaagtacttgtttaatttctggcactgtaggatactccaggctcatcttgtatatttcctgccctagtcttagaagaataagccatttattcaaagaaccctgcttccttttattggagaacttgttggtattagagaccaagatctgggtgctaggtactcattgatactggagtactgttgtttctaggtgctctcagccaaaagagcaagaaaacatagatgtgtacactagcctgtgtatatagacatgtttataaatattcctatatgtaaccatctacaaatcaggtgaaacatgagttcatactgatgtctccactttcatcaattaaccacatgggtcattctaacctcctccccttgcatgtctataacttctcactccagcagtaagcagactcccaccacctggcatctatttacttaattgttcaattccactatacacatatagtggtttcggaatcgttaatgcattcctctatgggaaacaactttatcaactatagtaaaatacttatgtacagtacctttgcctttggtcttacagattccactcatttctggagttatttagttcagcatgtttttctatcacctccttctgtgaagttgtttcatataatttttaatgcagttagattctttttagtctgatgactcttgaaaagagataaatgagcaggaagataaagactcagccattagggaactaagttagaaaaagcttgtgaacaattcgttttctatctgctgaatgtttggtggctccatgctgctggatgatgatattgtactattttcccatccccttgcttttattcccatccatttgctatgggctgaatgtgtcctcacaaaattcatattagaggttaaaatcctaactcccaaggttacggtatttgaagatgggatctttgggaggtaattagggttagattaggtcatgaggatggggcccttaaaatgagattattggctttataagaagaggaagagtgagagagattatctgtgtgctcttaccaaggaaaggccgtgtgagaacatagcaagaagacagctacctgcaagccaggaagagagccctcaccaggaactgaattgactggcaccttggtcttggacttcttacctcaagaactgtgagaaatatatttctgttgtttaagccactcagtctgtggtattttgtcatagcagcccaagctgactgatacaccattatatatagaaaaagtatagacatccctgtgctgtggagaggctcttaaaccaaatttcctaattcgttttctacccttaaacaccgaaaggaaccctctttcctcctggcttaggagatcctgggcttaggagatctgttcaggtaatgttcttggtggtgcatttagatgtaagagctccaggttaagggtctgacaagacacttttggctaaaacaagcgttaggattgggagaatgtttctcagtggaaacagtataatcacctaactgaaggaaaaaatggcccctttccccaaatattctgagcctgctttagagcaggagagcccacttttacagcaggaaacaccctgagaaggaagtagagaatggtgacgtcagtggccctggatctgggtcccgtccctgctcttcagtatgcagagctgtcaggcgtcgtgtgctcctgtgtagagtgtcaggggtcgtgtgctcctgtgtggacagggacagcagcagggtcctgcctgagatcatgaatatggatgtgagtgattgttcccaggcctaagtgaaaggctttcttgaggcagatttttctctgggatgctgattgtgagtttttaatgtctcccctttcgttattcagtgttcttggcttctttagattgatcatcatgtcttctgcctacaaatatctgctcatattttacaagcagagaagtgactggagctgtaaccagcctagctgaccaaatgaagtccatgtggggccctgtcatttatatgggtgattaaaacaaaaacaaaaaacccttaaaccctgccagagggtaatttttcatggtctgccttttatgtttcttccttttttctcttcagtttttttctcctttccttgcagttattttttttttttcttttattgcctgtttcatttcacaacctggcactattctggtagaaatgtctgcttcctgccaccctcaggaagtcagagaacagggtaaatttgtccagggcttcaccccatgatttctaatggtgtgactcaaggctcccatgggagagatctacccaggaaaataaattgtgtgttggtttttaatacaagaaccttcataaactgagctcctaggagaaaatgaagacatttaaatactcttctctttttgcagtttgctctgtggtcatcagttaaccacccaaatggaagtgcatgtgttaatgttcaacagtgggttaatgtctggaggatggttttggacagcatagttcggagcaggttaatgtttaatgtaaaagtacttagatgagtacttggtacatagtaagagtgtttaagagttaattacattattattattattgcaaactaaaaattgctcccaggttgcatgttgtgagatagtaaggcgaaggtgaggcacctagtgtcagtattggctttaggtggaagaaaataaactggaattgctattgttgcattactggtgtaagaaaagtggtgatggacatggaaatagatcccagagcagaggtttgggcctgaaaatttggaactaggaagtttgaaagtgactcatctaagggaaggcaggggtgtgttagatggtccccaaaagcctttttgccttgagaatgtgattttatgtaagttcccctccacctggagtagtttgggggtagaaggtaggcatgaatggctatgggggttctgtagaggagagggagaagaagtgactctttttgtctggtttggattctcttatcaatgtttttgccggcattcccaggataaggaggtatttccatatgcttctgcaactggtttttgttaaacacagaccatacctcttcagctgatcgtgtcacacccttaggggctcagctgaactcagacaacaggcaacagccagaggaaggaaaaaagtaatagtccataaaattaggtaatggtcctgctcagaaatatttgagcataaataccaggttatatctttttatttgtacccccaacccccatggctgtaaacacatccctggagagaggaaataaatgtagcagatttcatactgggctgaaggggaagagtgtgggatgggtatctgttttatgagacagccttttttttaacgttaatttctgcatgattaacatcccttgaaagagttatttttcctccattcttttgttagcccattctggtccagcttccatgccttccactctgacatcaaagttcttgctaaggtcatgttccatctgcatcccgtcttgtgcaatgatgctccagtctttgcctgcttaatggtagcctttggcttacctgacccctccttccttcttgcatccccagcttctctgggcttctgggatgccaggctctccagatttcctcgcatccccctggtcgctccttctcagttgtctgtgtctgcttctcctcttttccctgtcttcttagtgttggcctgctagagcatagatcctcattctgaatgtgggaaaagcagatgatgattcattggatctcgggtggaatccacgattctgcatctctcatgtgctgccaggcgatgctgttgctgcggggctgcagagccaccgcagctcggtgctggagctccatcctcgcttctccatctatgtgacttcctagctgagctcctccagtccccggctttaagtcacacctcgaatcttattggtgacttctcgccccacttgggtcaaaacccagagttatattcaggcccacgacaccctgtgggtttggctcctgcccactcctctgcccttagctgctctgccctccgcgtctcccactgggctctggccaagtctgccttcccactgattcttcgatttgtctagcacgtttctccttcctgagctctaaacttgttgttctctctacctggcactcacacggcttagatctcatcttctctttcaaagcaaatattcccttcccagcgagggcttccttaactgtctatctagaatggaccttcactaccaccaccatcacctcgctgtcacctaccccagttcattttcttaccatgctatgtgagtttcttattcatcctcactctccctaccagagtgtgggttctgtgggaaaaaggaccttgtctccccatctaactgctgtagaagagtgactagcatagtaataggatcttggtaagaacttgttagtaattacataaagcattagtatcagcatgtcccagatgagctgatgagcacagatactaccacgccattccagtgtctgtgtttttaatggtttgggtatcgggttatattattgtaagtatcatgaactagtggaaagaaccaagatggacagaacacataaacgatgcccttacaccccatgaagacccaacagttttatggcaaactagagaaatgaaggtttcatagttgtttgaataaaaaaaggtggtagaaaattgaggcatctcattgtacaaggtaggtaacatctgtgcaatgaaatcatgacttgcactattgaagtccctgttcacaccatataaggtgatacagtttcagcaaaatgatcatcctacatattaatgttgtgaattggaattatattggctttgtaattgcatttgtatttaatgtgcagatgttttggtattgatggtaatataagaactataatcgttttatatttgtacattttatgagaaacattaagtgaacactaagaatcgttgagatttttttttctttagaggcatctttacattatacaggcttgtgaaagactaaaataggaactaagcaagattgaaggtgtggctgaggacagggaaaggaaaaagttttaaattccaaaactgcttgtaggaagctatttttaacaaaataagaataataggctgggcgtggtggctcgtgcttatagtcccacctacttgggagcctgaggcaggaggatcccttgagcccaggagttggaggttgcagtgagctatgatctcaccagtgcattcccacctgggtgatggagcaataccctgtctcaaaaataaaaataagaaaaaaataaaaagacgctgagtgggctatcaaattttagcatgctttcaagagagtgaaattttaaaatatctacattcaggccaggtgcactggctcacgccttgtaatctcagcactttgggaggccaaggtgggcggatcacttgaggtcaggagtttgagatcagcctggccaacatggtgaaaccatctctactaaaaatacaaaaattagccaggcatggtggcatgtgcctgtagtcccagctacttgggaggctgaggtgggagaatcgcttgaacctgggagatagagattgcaatgagctgaggctgtgccactgcactctagcctgggtgacagagcaagagcctgtctcaaaaaaaaaaaaaaaaaaatccgcattcatatgaatacacaagttgtactgacaaaccctaaaaggttaaaatatattatcctttttttgtttatataattaaaacttcaattttggattaccagtctaatttctggttattgaaaaatgtaaattgtgaaacttttcttgctggagacatctatatattataaaatatttaaatataaaaataatggagtaatggagtagatggcctttactcaccaattctagggcctggcttaggaaggtatgtaggcagggacccccctcccccgccacaattctaacttgtgccccaggccctcctcctttcttctggctcctggagatcagagaggaagggattctgcacttaagaaatggcgctaagaagaagaagacacattctttttttttttgagacagggtcttgctctgtcacccagactggagtacaggggcatgatctcggctcactgcaacctctgcctcccaggttcaagggattctcctgcctcagcctcctgagtagctgggattacaggtgcacactgctatgcctggctaatttttgtatttttagtagagacagggtttcaccatgttgaacaggctggtcttgaactcctgacctcaagtgatccacctgcctaggcctcccaaagcgctgggattacaggcatgagccaccacaccaggccacattttttttttttttttaaagacaggttctctctctgttgcccaggctggattatagtagtgcaatcatggctcactgcagcctcaacctcccaggctcaggtgatcctcccacctcagcttcctgaatagctgagactacaggcatgtgtctccatgcttggctattttttttttttttttttgtattttttgtagagacaaggttttgccatgttgcccaggctggtcttgaactcctggggtaaagtgatccgcctgcctcagcctcccaaagtgttgggattacagggatgagatacagctactggccaggagacacattcatgctttgaaaggagacatgaatggtccttctccctcacacatttcctttgagtgtatgtgtttgtttctacccagttcatttccacatataatttgaggctaacagagccatctatatagatctgtgatgccagggagcctggggcagaagatgaaggctggaatggggtgagggtgctttaggaaggagagagggagctaagggccacagcactgcttgcagtgtctaaatgaatggccgttctgcaagtacctgaggggctggtgagagcaaggcacagcgtgtttggggtgactttaggatttgggtttgggtagtcccccttcccctgctgcccatctgagagaattctggggaggaaggtcttactggggcatgaggtccctggtgtcatcaactttgcaggtaacagctgtcttgaacaacaacagagaacctgaatttatacatgtagcaagctgctaggtttctaaaaatatttcagaaggtttattttgattttatttttaaacattttgggtgcctacacagtgttatcttccatgtttttaatagccacactatacaatacagagtaggtttctgtggacaaatacaggtgcctatcatttatagcacagtctctctgggacccgtgcaaacaactgactcatgcgtttatgagactgggttggtttgtgaatcgatgacgcccagggagctgggaaggctgcatggcatggacgcttccccagtggctctggattttgcaatcatttggctaaatttgctcatgatgcacattccctcacccctttccctgatgaggacaaagatggctaattttccctgattggatctgttgttttgagtgaccgagaagaaagagatactttgctgaaagcacaacatattccgagggagaatactgagctttggaattcactttgcagacatctgcgaggatgttccgggagccaggcttgttatagctggcattgctggaattccacacccccccatgcctcccttaagagatacttgataaccccagggcctaatttctacttttggaacatacataccttgtgaagtggaggctggaggtgggaaggaaagcccccttgaggctgtggatctggttctcatgttttaaacagttttaaatattggggctggagatgcctgaaggatgggtatttgttatggaaaaccttgacttttttttttttcttttacattgttcacattttaaaacaaagttcagagagctgtgtacattgagcatgctttattagttcattcatttatgtgtgaaacactgttctggatgccagaaatgtggcaaggaggaaggcctggccgaggagtgacacttccactgagctctgacagatgagagcttgtcttggtggcacaccagtgccgcgggacatggtgacatgctgtggtccacagccctccagtgaccatgtgagcataattaaatacaaactgtgggaggcagaaaagtgaaaatgtggtctctgctcaagaaagagtgcaggtcttagagacaaagtctgggtctaaatcttggtgctgcccctggcccaggtgtaaggcctcagaggaaattacctgccagagtttacacatctctaaagtggagagaagaggtgctgtgaggatctcatcagacaagatggtacaaagaaatcaccggggctggcctcgtggagggatgatgtgtgtgtctgactcagaatcagtagaaaaagcttaaaatgtggttgctgggacaaaactaatctaccagagaagccgtggctggagagcctgtgttgagctgtgtggtgctggtctgtgctggaatgccaaggaagaggcaggagctgcctccagtaggtgagcctcgaagaaagaacaggattttcataggtgaagggagacagatttttactggaggaaaaaaaaatgtctaaagtaaaggtcataaaaacagactgtgggccgggcgtagtggctcatgcctgtattcccagcacttttggaggccgaggtgggtggatcatgaggtcaggagatcgagaccatcctggccaacatggtgaaaccctgtctgtactaaaaatacaaaaattagctgggtgtggcgacatgtgcctgtaatcccagctactccggaggctgaggcaggagaattgcttgaacccaggaggcagaggttgcagtgagccgagattgcgccactgcactccagcctggcgacagaactaggctccatctcaaaacaacaacagcaataaaaaaaaaaaaagtgcagctgcacagtttaagaacagaagcttcttttgttgggtacttgcaaaaatattcccttcctcttggtagcgtggtctaatggtattaatgccaacagtgtgaacctgagcataaggtatgccctgagtttgagtagcttttcagtgctgagttgactacacaattaccagtgacaacactgagaaatctaagaagactccacttgacttggggggtgggtaatttatttcttggacattttggcttcagtgtaggtttaggtaagtatcatatgtcagggatggcaagtgcattttattttgtgtctgcactaaccaaccaattggtagtgactgcaggggtgcagtgatgaggaggattctgaagccagatttgcgcttagagagaaaacgataataaccctttattgatataatttggacttaggcttcgtagaggaaactgtagcacaaacggtgtggatctgttatctctggttgggaggttttctatgtacatgacagtatgaagatgttcatttattcacccaacaaatatttattaaatctccgctatggacatagcattgtactttagattcttagccctctggcttcttcattagttaataaattatttcaggatattggtggttaatgctgcttggttaattagtgggggtttttagtctttttctcataagtgtttcaaaacattttatgaacaaagccagctttcttgtgcccataaatgctacattgaaatctttctcagatccctcttattttttgagacagggtctctcagtctatcacccaggctggcatggggtggcatgatcatagctccctgcagccttgacctctctgggctcagctgatcctcctatctcagccgcctgagtagctgggactacaggtgcgcaccaccacactcagctaatttttgtatttttcatagagatggggtctccctgtgttgcccaggctggtctgagactcttgggctcaagtgacccacctgcctcagcctcccaaagtgctggggtgactggcgtgagccactgcccggctgatcttcgtcatttcatttagcatacaatatgtgattttcctaattactttatgaagtcatcactgacagtctgactttagagacaggaaaacagagaaattaaagaacttctccagagccaatattggacttgagccgcatgtcagaaatatttcctgcttctgcatctcggagtcaggtgccattacttgtcttcagaaccttaaactttcgtagcttagctctgccctggtaggagaaactttcagaaatcattttaagcctcaagaggtgaaaaggatgaatgacttatctaacactttttttgggacatgaattctgtatttttttcagtaaccatgaagaatataaaatacgaaccactgaatttattaaagtaatacaaattaaaaagtaaaagttaaattgataacatatggacaccgtaaattaagtggtgatatatgtgctaatcagttaagagaagtgggcaagggaagtgggacccatccacagggaaacgaggcgggtagacttccagggggaagtgggggcttcttgggggagagccacttggtgcccatgctctcagggccaggccatgtggatcagatgagttgagtcccagtgactccacattttcttttttgagatggagtctcactctgttgcccaggctggagtgcagtggtgcaatcttggctcactgcaacctccacccccagggttcaagtgattctccctgcctcagcctcccaagtagctgggattataggtgaccgccaccatggccggctcatgttttatatttttagtaaagatgggattttgctatgttggccaggctggtatcgaattcctggccgcaggtgatcaacctgcctcagcctcccaaagtgctgggattacaggcgtgagccagtgcgcctggccaactccagattttcagactcctggttgattctcctaggtctccaaccctagtaaaaggagcctttttacaggcttttcttttttgccatcttcctttttgtacaaggtgggtttagggggaagctgtagcactcaatgttataagtttattttttccccccaaatagaaaagttttagttgtcaggttcatttgaagacattcgaaccatcctgaactgtgtgaaacagagagcaactctgctttcatttccaaacctcaagtttatttttgaaattgttttcccagggagttctgaagggttgactgtatacaaagacacttcctttaaaatctgaagagtttggtcagtttcctacatttgcactacaaaacacgtagagagaaaacataaagctcagtttaggtaaggctgcctctttctgtcatgttagggaatacattgaaactaatatgtgttttgctaatcttggctttccacaccctgatctttcaatttcatctggttgaggttctagtgtgaatatccccatacaaaattctgtcttcccactagttccacagacacatcctttaggagtaaatgtgttaaccactgtttagcaagcttgtccaacctgcggcccgtgggctgcctgtggcccaggatggctttgaatgcgcccaaagcaaattcgtaaacattcttaaaacattttgagttttttttgtaattttttttttaaacctcatcagctatcattagtgttagtgcattttatgtgtggcccaagacaattggtcttcttccaatgtggcccagggaagccaaaagattggccaccccggatttagaggttttagctcatgtttatcatcagcctggtagtatcttctctttaaatgaggcagtcacaggatcccactcaggggaaattactttttggttggtgggtcaattcttatttcctagaattaagctcaagactgcactgagactcatcacctctctacccactgtattagatgctcttttaagtgatttgtatggtaaaatagaattacttgttcaaagcaaacatacctagagtctctgccccatgctaggtactatgccgattgcttgggccagcctggcttgactgatggggactcttgtccttggaggcaagggccagccacagcataaaggtgaaggtttcagattgcctggttgcatttcctccgtagccacagggcccctggaatggctggtgaatatgcatgcaggtcctggaggtgccactgagaattagagttgtggggcggggatgtgtggaccagcattacgtgactaatctccatgctcagctgataacatgtgatggcccagagagaggaaatgtttctatctggcatatgttcatagttcttccaagagctaagccctttgttcttacaaacacactcgctgatctcgctaactaaagcaattatcatcatttagcagtcttttcataaagtattatttccactccaaaacaccacttttatttgccaagtgccacaatgttgcatcctggcgattgatcagcgtttactgccaaattatgtaagcctttggttaggcttagtccccgacggcgcaagcgtgtctgtggtgtgcattaggattgtaaacgtggcccagtgcctggaagtggagaacagctgtccctaaattcattaattaattcagtgtttacactttgattgggaaggaaatccacatttgcttaagacaccagtgcccagctgagaaatgttgttccatgaaattattggattgaggtttgttgtcaaggaaatgtaaattgtggatgtttcatgaaatttaaatatgtggattaattgaccaacagggagctaagattgtaataagccaaggtggctttattcaaagattgaaatgtaattagtgttgactgtagtaggaatagctatttgaatggaccataaatcctgcacaagaattttactaataaaagaggaaatattttcattgaaaagtcagtgtcagcataagaactgatttttcttacaacacttattggtgagtagaataaccccatttagtaaataccacacacaaaaaatttcttctgtttaaaaagattattagaaactttaacaaatatgaagacttctagagatgcagaataaaatatgccaatgctgctcagaaaaaaggggttaagacacacctggttattttggtgtcagccctcacgcatcacttcattagtctaaggcaagctcgctgtacttgtccttagtattgagttgttttatgatattagtagccttgtcaaaccagataagtttagaagttcttctccttttcaaaattccactcaaatggtagtaaggggagaaaaaatgtttaaacctgcaagaggcaaaaaatggcagtggaggctttggtggcaactcctgcaatgatgcaggggtgatccccgggctggctgagggttagacccctccacccaaagtgcccacattgctgaaatgaggtgctttgcctgcagaaccacagagaggctcagaagtgggaaggcattgttaccatagtaggccagagagattggccaaatatagggagttattaaaaccagcataattagaccctacaccctgtccctgtctcccttccccaccccagcagcagcctggaggtctgttctctggagaaatggaactggaatggtgttggggtgttggtgggggtgactaaaaagagagactgatgacagctgggagcttggtcactcttctgctctgtccatgatggcagcagccaggcgtgtgcagccccagcaatgaagtggaagactttccttgagaaattgaacaactccagaaaaaaatgcccccagataactgaaatgtatgggttcttcagtggaatacttttttctttcacattaattgacactcaccaactaatagtcttctccacacttgcagagccaccaatctgctttggtccttcattcttaaataggatcaggcagtcagggttcatcaggtgtattaccaaagccttcaatatgaaaagtaggggccaaaacaggaaaagaacaaccttgcagaagatggtgttgttgcagaaagcagagaaaacgtgtttttagaagaaagttacagttttccttgcagagagaagttatttcatatccaaaataataataacatttatgaaagaggagcaattagagaacaagaaagagctattgagtattacaaattaaatactggaatttaaaaaatgttgaagttgtatctctgaaaagtagagtaaaaaagatggagttaaaaagcaggagagaaaagaaatatgaaaaattaaaatgtgatctaaaaaattcaacattgctattatagtagatgcagaaaccaagaacaaaataaaatagtaatctgaacattatcacagaaagaatgcaaaaatattttatagaactaaagacatgaatttccaaattgaaagaatatatatattatgtgctcatgttttataaaagagtccactttccccaattttataaaacccacccctgggtatgccattatgaaatttcagaataccagtgataaaaggtcctaaaagctttaaggggaacgtaaacaggtcacacacaaaggaaagggtacaatgagcttcagaattcttaaaaacatccttggaagctagaagataatgaagtttgcaaagctttaaaaaatacgatggaaattatttctaacctggcttctatgtccagctagaccaccaatcaaaagtaagcatagaataaagacatttttcaaaatacaaggagtcaaattttttttccataggactttttcttagaaaactactggaagtgtcttctatcagaccaattgggtaaactaacaaagaggaagacatgaaacccagaaaataatataacacaaaaggaagagagcaatgagaccctaatatagggtaggaggagggaagactgtaaaaaagaggtcaccaaattacctgatattttgatcatttggaaattaataccgataagcatctcacagatgtaatgtagttgagggaaagatttaaggataggtgtatagaaaagacaagtaaaacagtaatcgatcattaacgctagaaaagtaaaaattttataagaaaagttctgtaagaccatagtatataattttttagtgaatatttatattgtcataataatgtaaatagttgactcttgattttattattggtaggttagccaagtgagagacttgtatgtatggtgtggtatccaccctatgtagaaccaataagttaaggaatcacagtcaggaatattgtttagcaaaagggaggtaagtattagaagaaatagctgaaatttgcaggtttttttgtttttttttttttcctcctgggcagtgtgttcaggatcagggaagggaagctgaagaatgtaggttttcacttattttactttgattaaaaaataaattatttaaaaatactagtataactgaaaatgaaagttgacaatgaaatatttggaattggtgagataatgataaatattacagatgaatgtacctctctgagttgttcctatctttaaagtggtaaatgatagtagctaaaatgtttgagatttaaaagaattatcaccaagcaaaactgacaacactatgctactggtaggaaactgaatatattcagaaagccccaagacagaacagagagacaaaacaagtaaagatgtgctagagccaaacaacataattattaaggttgtacagatggatagattttgaatgttatcccttaaaatggagactacacctagtacctgtgaagcattgacaaacattatccgtatatttgctcacagagggaagctcaatatatttaaaaaggaagaaatggtagagacttcattttctgaccacaatacaggtagagattagcaacatttacaaataaagaccctccaaacaaaaacagcacagcaacaaaatactacatatgcaacaactttctcagaatcaaatcttgggtcaaagcagaaatcaaaaccccaaagagaaactatctagaaaatagtaatagaaacattactgtggtggaaactgtttactgcctttctaaagtccattctcctctctctttttactaacagaacattgattttgttgcatgttgatgaccagcttaagtaccctattttccagtctcccttgcggctgggggtggccatatgattaagttctcactaataagatataagggattattgttaggtggggattccaggaaagctatttaaaaagaaggttgagtcacttggcctaagcttttgggctatgtgatgctggatcagctatcttgtaatcataatcataagctatctttaatcacatgttaaagacagatgagtggaaagatagaaggggtgctccttatcccagggtctctttcagtcctagacttcctatctctggggaaaagttcctgtcttaagctgctatgtggggagtctattagtaggaactgacataatttttaagtgacatagttacaaaccacaatttatgtgattaaagaatgaaaataaacaagtaaagcgtccaagtcaaggagtcagaaatagaacaacaaaataaaacaaaggaaagtggaaggaaataataaaaatcaaactagaactcagtaaagttgaaaattaaagaaaaaaatgcttgataaatccaggagctagttctttagggaaacaatttaaaaaaatacatacacatatatattctaccagtgtaatcaagaaatagaagaaaacacaacattagataataaatgatttatcctacccaaattctgcaaataaatttgaaaattggatggaatagatgattttcttggaaaatgtgctagtagattgactctagaatagaaagaaaactcaaaaagtctctcaaaagtggaaaaaaaaaaagacaactgttatttgtgaccagttgctactgttcttcctggagtccctttgccattgctgttttgcaaagtgttagaagtgaatttctggtgaggaacctcggagtgtgaggcagggtgagcatcctgcttggtgagctctctgcagtcatctggcaaggttggccacacaccagaaaggcaacggcaactattcttggcatcaggacccatcacaaaacacagagccctgagtgttcttcattttttaaataatattttccagatcaatatgctattgaacttttttgctaagaagaaaagattgaaaatgatttataatcatttaatttcactgtcagtctcacaaacaactgattccttatggtaaaagtgttggaaacattatattcaaatagtagtgttaaagattttgcagcaagattgtgggtaaaaaaggctgaaagtgttttgagaggaaaatgaactgcagagtaacaaagaaaaatggtgagcgtcagaattccttagctcttaattattttcatggaaaagtacctagttctcaaatgctggtaactggaacatcctattggttaaaaataaacagcataaagtttcaggaaaccaactaaacagcaaaaaaaaaaaaaaaaaaaaaaaaaaaaaaggcaaccagaacagcccaaaacagaataacaaagtcagaataatgaagctacgccaaaagtgtcaggtcattacacgggttgtctgccctcaggccagggttcaaacccagtggtgacaaactcagtggccacgtgggctgaagggcatccagaaagtcctgctgggtcaccagagggctgcccttcagcacttggttctgaggtgtctttgctgtttaaaatgtcttgttttctttgaactttgaagtttccccttcctaattatttcagtcttcatttaaacagatgtaattctaacctaatgtcctctttttaccccatctctccctggtagctggaacagtgaaccatggagctgtatttcggtgaatatcaacatgtgcagcaggaatatggggtccatctgagactcgcaagtgatgatacccaaaaatcaaggagttcccagaactccaaggcaggctcctacggtgtcagtattcgggtccagggaattgatggtcacccctatattgtcctgaataacacagaacggtgcctagcaggcacatcgttttctgaaaatgggccaccctttccacctccagtgataaataacctgcctctacattccagcaatggttctgtgccaaaggagaacagtgaagaacttcagcttccagaaaacccatacgcccagcctagcccaataagaaacctgaaacagcccctgctccatgagggcaagaatggagttctagatcgcaaagacgggtctgtgaagccatctcacctgctgaactttcagaggcatccagagcttttgcaaccctatgaccctgaaaagaatgagttgaatttacaaaatcaccagccttctgagagtaattggctaaaaacgttgacagaagaaggcatcaacaataagaagccttggacttgctttcccaaacctagcaattcccagcctaccagtccctccttggaagacccggccaaatctggtgtgacagctattcgtttatgcagctccgtggtcatagaggaccccaaaaagcagacctcagtgtgtgtaaacgttcagagctgcaccaaggagagggtgggagaggaggcccttttcactagcgggaggcccctgactgcccacagcccacatgcccaccctgaaaccaagaaaaccaggccagatgttcttcccttccggcgacaggattcagcgggacccgtcctggatggagctcggtcccggaggtcctcctcgtcatccacaactcccacgtcagccaactctttgtacaggtttttactggatgatcaggaatgtgccatccatgccgacaacgtcaatcgtcatgaaaacagaaggtatattcccttcctgccaggaactggacgggatattgatacaggatcaattcctggtgtggatcagttaattgaaaaatttgatcaaaaacctgggcttcagagaagaggaaggtctgggaagcgaaacagaattaatacagatgacaggaaaagatccagaagcgtggatagcgcctttccttttggcctccaagggaactcggagtacctgattgaattcagtaggaacttgggcaagtcaagcgaacacctcctccggccttcccaggtgtgcccgcagcggccactgtctcaggagcgccgtgggaaacagagcgtgggccgcacctttgcaaagctgcagggagcagcgcacggggcttcatgtgcccactccaggcctccccagccgaacatagatgggaaagttctggaaaccgaaggtagtcaggaaagtacagtgatccgtgcgccctcccttggtgcacagagtaaaaaggaggaggaggtgaaaacagccaccgctacgctgatgttacagaaccgggcaacagcaacttcgcctgattctggtgccaagaaaatttccgtgaagacatttccttcggcctcaaatactcaggtaacactagtgcgattcctgtttggttttttttctcttccttctaaataatgtaatgatgtacttatgctgcaggaggccataggaattacacatcctcaatcttgtatcaggaatcacacagctgatctgtttcaggatccagttgtgtcctactgacgatgtcctactgccaattgtatagttttctgggttctttgaagttcagctggattcccattgtgatctctctgtaaagtaacttggcagacgctacagagaggctcaattgttctgtttgtgtatgcatgaaatctgaaagtatgcagaatttgtttctacacagaggctgaatagttaggtttgtgtaggtatattaattttcctcataaaattgagtgactgggttaatttctagcctgaaaaattaggttaattttcatttaggttaattgtcaagtgagaatctaagtggcacatttagtgttttgatagtaacaataaaaaataatgatattgataaaatggtaaaaaaaaaaaaaaagtagctaagtgctaggcactgtttgttatatattacaggattgcaccaaccctgtgcaggtagtacctattaacctcaatttacaggtgagaaaattgaggcgaggagaagttaagtaacttccccaagattatgaagctggtaaatgttgtaactggctctaagaaggatgctcactggaggaattgtttggtgtttggaagcctctgggaacttcatcctcatggtctaacaacaggccttatgttccaggccacaccggatctcttaaagggccagcaagagctcactcagcaaaccaatgaggagacagctaagcagattctctacaattacctcaaagaagggttagtgattttccctctgaaagagcaaagtattgttgtttctggtgggactcttaatttccttttccgaggctttaatggttaccttcctttcttgccctgtgccagccgttggagggttaaaactcaatggctggggttttcgtgacggcatttgtcttgtgtggtatggggtgggggctttgggaggggtgtgtaggaaaggacaccatactttaaaaattaaaatgaatacatttttaaagtgaccctttactatttcaaaagcaaattcaaagataggaggagtttctactcttcaggtttgaatggagtccgccatcaccttgagttcttccgtgcaatgtggtagtcctttagaagttacaaataaaaacacctcccctccccagagttaacattggccaagagcccctgcttccattatttttaaagcatgtgtgagtcatttaaaagcagtgctttccatgcttatcttggtggttgaggtggaataatcagggtttcagcccttacttagatactaactgtgctggaacttgagcaaggaatttgaggtttctgtttcagttctctcaacagatgtgattaagaggaaggacaaaaaaaaaaaaaaaagctttacagcctacatgactgaaaaccagccacttggcaaatcctcattggtatcaaaatactgtatatttttgtattgtgccttacaattatttgtcagttttagagctaacaacatagtaaggctcaaaatataaaacaggggatcttttgaaagggggaaaaaaaaagtaacctgaaagattaatctagctaagaactggttattagtatctccctgtggaagactttaccatgttaagattaaggtagaagaaatcttgacttttaaaattcattattttttttttattttttgggacagagtctcactctgtcatccaggctggaatgcggtggcatgatcttggctcactgcaacccccacctcccaggttcaagagattctcctgcctcagccacctgagtagctgggattataggtgtgcgccaccatgtctggctaatttttgtatttttagtagagacacagtttcatcatattggcaaggataatctcaaactcctgacctcaagtgatccaccagcatctgcctcccaaagtgctgagatgacagacgtgagccaccgcacctggccaaaattcattaaattcttttatgtatgtattttttggcacatgatttattgagacattggtaagacagactttagtgggaggtgcctgttgaaggaagtttattttaaatctttttcttctaattgctgacggtgtggtagaagttaataaaacttagtatctccgtgttacctgtgaaagcccagacaaagggctgccatgctgataatcttggcttaggggttttatttttttaaacataggttaaacaaattaagatcattgtagatcattcttagtgtaagattcagatgtacagcatgtttgtgtgtgtgagagagatatacacatacgcacttcaaagaaaaggagaattctttttggaatggacatgagcatttgaatcaaacaacaaattactaaatgttcactgggtgtcttctccaagcttactgaggatgtgtttatgtgcctctcacatatttgcaagtgggaaccctgtcccaaattgagtggtaacacatcatttatttgaaaaaaaaaaaaaaaaaaaaagacaccatccatcctactctcacactgattttgtctgaggctttaattaattcacagctcctgcaaattatctccttaaaggacctgttgggtgtgtgtcatgacatataaattgttctgagaccagtggttgtgtccctcattgttttctctgctgtccctttttcagaagcactgataatgacgatgctactaaaaggaaagtcaacttggtctttgagaaaatccagaccttaaagtctcgagcagctgggagcgcccaaggaaataaccaagtaaatggaagttttgtattttgtagagtgcatttagcatggaatgtggtaaacaacttgctgtttcttcagtctgtatgtttgtttatagcagtaagtgggaagttgcctgagtagtgaggagtactcttcatgttttacatgttgcagcaacattttattgagacagagtctctgtcaccctggctggagtgtagtggtatgatcttggctcactgcaacctctgcctcctgagctcaagccatcctcctacctcagcctcccaagcagctggaactacaggcatgtgccaccacacccggctaatttttgtgtttttagtagggtgagggtttcaccatgttgctcaggctggtctcgaacgtctgggctcaagcaatccactcacgttggcctcccaaagtgctaggattacaggcgtaagccaccatgcttggcctttcccagccttttttccagaaaagtttaaagatattttatttaaaaatacatagactataacaggatgatacaaacagatggcgagatttagaagaggaaaataagaataggaagactagcattgtcataggcaaacatggaaggtaagtgtgaacaggcttggacccaagctctggagcttcaggtgtgaaagagaatgggactagagactggtgacactgatcagctgtggtgcaggggacaggaaagagcccagtggtgccaagttagtttttaaataactgcctgtctgattgattgtgctgaatttgagtggggacatagagatttttttggttaaggaaggagccctctcacatttgataaacaactactctatgtcagacacacctggtgccctggaaggaagccactcgtaagagagtacggctaaacactcgttcctcaatcttccaccgccttgtgtggaactcatttcttgcttgtccatcttcctttcccctcccaggggagttctgcatgggaaggaaagaggaagacacctggaggcaggtaacaggaaacttgtctgtagcttctttctaacttgggaagcgtacatacaggggataattttaggcgtcaacctaccatctttactacttgttattcccccagcactcagctaacccatgactgctgctgtggcctcaaatagaacaatgccgtacacacacatacgcaattcccactggggaatctttacaccatagtccttgcgtattacaccatagtccttgcatatacatagccttgaggagctctacatagttcttaaagtcagtccagtatttgtttgctaaaactctgaagtccaaattatcaacacgattcttgtttttttgtatacctgcatacaggctatgcagggagtgcgggttggaatctcaccggctgttacagagcaatataaagggtcttgaacacaggggctttgggtataacttagctaacagatgagtcttcaacaaatatcctttttatattgttttattggggtataacttatataaagtaaattacacaaattgtatctgtacagttcattgaatttttaacatagttttgcatccatgcaaatctcaaccagatcaagatgcagaacactcccatcacccaggtttcctgggtttcttcccccatcagttacaccccattcttctggaggtaatcatatcctgacttctatcacctagagtcgttttgcctttcttgacttttatataaattttcacaatatgtattcttgtgtgtgtagctgcatttcctcaacattatatcatcaagattcattagtgttgcatgtactcgtagttttttttggtatcgaaatgtaattttccattgtatctgtataacatagtgtgtattcttggtgtacatttctggtttggggctattaggaataaagctactgtgaacattattgtacttgtttggggaggggagtaaacacattcactcatttctcttgagaatatacctagaagtaaaattgctgagttgtgagttaggcatgtgtttaactcgtaaattatacctgtttgttcttagagtgagcgcagtctttggccttgatgttgagattgtccttgtgggtcacagactaggggtgaacagcctgaactgggtaagtcagggtagcccttctagggacagtgacactaatggtgccccaagagatcatagaattatttgtgagaagaagggaagctggggtgttctaagttaagtgactagcacagacaaatataaagaggcatgggttgccatgttagagggaatttagtgtagtgggaacacagagccaggatgggctgaggaagagcctggtagcaaggacattggaagttggaagttatgtaagaagtttccatttcgggctgggaaggggatgggttaccattgttggattttaaacagatgtgaataccattgtgtttgtgaaagtttattccttttgtggcttttggaaagaggtaagattagaggaagagagaccaatgaaaagctaatgcctgtctaggtgtggtccctcacacctgtaaccccggcactttgggaggctgtggagggagggtttcttgaggccaagagtttgagaccagcctgggcaatgtagtgagaccctgtctctagaaaaattaaaaaattagccaggcgaggtggcacatgcctgtagccccagctactcaggaagctgaggcagaagtcacttgagaccaggaggtggaggctgcagtgagctatgattgtgccactgtactccagcctgggtgacagaatgagtcattgtctcttaaaaacaacaacaaaagaagctgccaaatcaagagatgatgagaaaatgaaccaagacttttagacttcaggttcctattacagctccatgactgtttaattgccacgttttcctactcctcttccctccctcttaggtttggaatctgattacttgctggcaaaggttttagagttttatctttgcggtgtcacttaagtgattaggagagaatgtaagaaccctctcccttagggacggagaccatactggaaaacagcaaagcaggtagagattttgtatgggaaagaacaatgtataatttccctcactgggttggatttctgtttctaaaatggattgttattttgcctaagaaaattggaagttgtgtgtttgtgtttctaatcatcttcacaggagtaggtagggaagtacctcattccaagtttatcacacacaacttgcacctggattcagggatgtgtgagccaagatgccgccgtttctagctttgattcctacttttatttcttcccctcagctatttgtagttttctaaccactttactgtaggattttagccaaatccttttgagagaatcatcatgttattttcatggaagaagaagaagaaaaaaagatccattaatattcatactcagatcagagagataatattttgtaatagactctcttcaatcagatccctcttcattatggaaatgtaacatctaaaaggagaaagccaatttagctaacatacacttatttactacttgcatacaggctatgcagagagggatggaatctcactggcggtgactcagcaataatctctagtgtaatgtagattacactgtaacaaatatatgtataaagggtcttgggaacacagaggcaggggctttgggtataacttagcaaacagataagtcttcaacaaatatctgtttttatattgttttattggggtataacttatataaagtaaattacacaaattccatctatacagttcattgaatttttaacataggtttgcttccatgcaaataccatctagatcaagatatagaacactcccatcacccaggtttcctgggtttcctgtgttccttccccataaattgtcccccttccttctgggggtgatcatatcgtgacttctatcacctagagtagttttgcctttcttgaattttacatacataaaattttacaatatgtattataataagtattctcgtgtgtccggcttcatttcctcaacattatatcagcaggattcattaatgttgcatatactggtagctattttgtattgaaatgtagttttctgttgtaatcagtcaacatagtgtatactcttagtggtcatttctggtatttagctgctaggtgtaatgccaaactgaacattactttttttttttttttttttgtaaacacactcactcatttctcttgagaatatatctgagagtataatttgtgggttgtaaattaggtgtacttttaactgttaaatgttcccaaatgattttacacagtgattgaaacaatttacactcctggtagtgcagcatgccagttccagtggctatatatcctctgtaatacttagactcttttccattactttggtctacttgtctctccttacactactatcgtacggtttaaatactgccactttagtaagccttcagatctggtagctttattcttctccgagattatcttagctattctaggtcttttgcctttccatataaacttttatcagcttgtcagcttccaccaagaaaagcctctaggaattttgattgggattataccaaatgcatagataaatttggtggaactgacgtcttaatattattggtgttcttatttgtgaacatgaactttgtccccacttatttatgtcttagcatctctcagcagcgttccgtcatttttgttagagaggtctcgcacatctttcatttagatgtagtccctttccagtgctgttcattcctttctgtacttctgtgtttccatctcggactggtttccttcagcctggagaactattttttgaatatcctctagtacttttcgtgggcattgtttgagaatagctgtcattcactctcagttttcaggaactctagtgtggcaagtattgttttgcttcatgaatttaaagacgttattcgtcttttgacctcagttggctccattggaaagccagccatcattcttagtgttattctcttgaaagtgatgtgtcttttccctctgggtgcttttaataatttatctttattgtcaattgttagattttgactatgacgtgcctaagagtggtttttcttttatttatttttcttggggttcaatgagctctcgacttgataggttcatcagatttgaaaaattcttggctattatttatttgaatattgcttctttcacattcggtctctcccagctcttctcagactccaattacatgtatcttagaaattttgatggtgttcctcatatctcttgtgctctattctctctcttttcgtgtgtgtgtgtgtgtgtgtgtgtgtgtgtgtgtgtgtgtatgttgtatgtttggggcatcagatattctggatattttctattgacctttcaaattcattagtcttgttttctggctacgtcaatcttactttaagactttctcttttaagatgtctttaaaagaatgtttttcttcatccttcatttaaaggatggttcttttaagaacttttctttggccaggtgcagtggttcatgcctgtaatcctgggagtttgggaggccgaggtgggaggattgtttgaggccaggagtttgagaccagcctgagcaacatagtgagatcccatctctacaaaaaccatatttaaaaattgccaggcatggtggctcatgcttgtagtcataactgctcaggaggctgaggtaggaggatcacttgagcttagaagtttgagattacagtgagctgtgatccagtgagttcttaactttcagatattgtgtactgctgttttagagtgtctacttggttatatttttatagaatctatctctggaacttgattaaaaaaaaagggccaggcatggtggttcatgcctgtaatcccagaactttgggaggccaaggtgggtggatcacctgagatcgggagttccagatcatcctggtcaacatggtgaaaccctgtctctactaaaaatacaaaattaaccaggtgtgatggtgcgcacctgtaaccccagctatttgggaggctgaggcaggagaattgtttgaacccagaagatagaggttgcagtgagccaagatctggccaatgcactccagcctggatgacagagcaagactctgtctcaaaagaaaaaaaaaacaaaaaccctttgtccataattgtttctattttaaaaatattagttatagttaatttgtagtccttatctgttaactttaacatctgggtcatctctatgtctgttgtttattttatttagttactggttagttcttcctacttctttgcatgtctaaggatttttttttttaattgtatgctagaccgagtgggtgatgagttatagatgttctggaatgtgttatctccccctgaagaatgttaagttttgttttgacagacagttaaattacttacagattaccttgattctatatggttggttgttctaggcattattagggagtgtctatttaagtttttgcccttactcttaagacatgacccatgttcctttcttggatttcaaatgaatgccagaatgtccaccaaggtttctctattttggttgagttggaaccctagtgtctccctagcattgggcaacctgtgaagtttctgttgggttctttgcctcctaataggtcttctctgcagtcctcttgaactcttgctctgctcatatacagcttaggatatcatccaagaatccagggagtatttattgtaggttcttggaacttcttctgtggacctctctcctctctcataccctgaccttgaaatccctgttgcttactatctctaaactctaatctctatttctttcatcagtgagttgccactctggacacttttctcacttaaattaacaaaccttatttttcagaatagttttaggttctcagtgaaattgagtggaaagtgcagacagttcccgtttactgtcctgtccccacatacgccctccaccactgttagcatcctatagcatggagcgcacctctcacaatcaggggacctacactggcacatcattatcactcaaagacgtccatagtttacgttagtgttcactcttggtgttgcacattctacaggcttctgacaaatgaacaatgacatgtatctatcatttagtatcataaagaatagtttcactgccctaaaaatcctgtgtgttctgcctgtttgttcctttctctcccctaacctctggcaacccgtaatctttttatggtttccaaggttttattttttctggagtgttctgtagttggaatcacacagtatatcaccttttcagtttggctcatttcccttagtagtgtgcattttttcccatgcgttttgatggattggtagttcatttcattttagtattgagtattaatattccattgtctgatataccacaatttatacattcaccttttaagggcatcttgattgcttccaagttttgttagttatgaataaggctgctttaaacgttcacgtacaggtttttgtgtggacatgagacttcaactaatttgggtaaacacccagagggcagcttctgggttgtatggtaagagcatgtttagttttgtaggaaacaaccataccattttctaaattatctgtatcatgttgcattcccacaagcaaagaatgagtttctgttactccacatccttgccaccatttggtgttgccagtgttttgaattttggccatcctaattcgtatatattggtatctcgttggtttgtctgtttgttttttgagatggagtcttgccctgtcacccagtctggagtgcagtagcatgatcttggctcactgcaacctccacttcgtgggttcaagcgattcttctgcctcagcctcctgagtagctgggactacagacgtgtgccactacgcccggctaatttttgtatttttagcagagatggggtttcaccacgttggccaggctggtctcagactcctgacctcaggtgatcgttctgcctcggcctcccaaagtactgggattactgcatgagccgccccacccagcctcattgttgttttaatttgcaatttcctaatgacattgtctgtgcttataaaattttattgtgctgtggtttggaaatggagtcatggagaacccagggtgaatgtggggctacctcctgtcttttcctttgtaaggatcataactctgtgttgcttgcttttcagtgcctgtcaacaattgttttatatatttttgtctagctttcatagtttttgctgggagggtaaatctgatatttgctactctatcatggcaaaaccagaattctaacaatcatttactgagatttgattaaatttatgagatacattgggttctgtagatacagaggtgcataaaacctggtccctgccccataaaagttcataatctcctgatgtagtaattctcaaaccactcttaagaaacactaaagctaaactgtattctgccattaaaatagaaaaaatgactgtctttacttacaaaaagattttgttgctgattttttgctaaccattgatttccatgctctggaatatagaatttattatggagaggctttttaagttttattatcctaaatttaatgcattgctattttataatattctacagaatacattacggacttctaacaaatatgccatgtatgcaagttttagtcatattggactagtgttgatatacctgatgaaacaatacctgtgattggtaaatgctgtagaataaagttcactggagtcccaaggcaggcagtaacattaactctgcccaccaagtcagggaaggttccctgaaggggttgatgtttgaattgggtcttaaaatgtttagtgttatgcctcatctgttactgcactgattatatttggagggggaagataattaaaataaagcaccctgaacatttaaattagtatatctttgcaattaattataggcttgtaattccacatctgaagtcaaagatctattggaacagaaaagcaagttgaccatagaagtggctgaacttcagagacagcttcaactggaagtcaaggtatctggtttttcctttatgttattttttccatttctgtcttggttgataaagaatattttacatgcattgggataaccagagtgaaagccaattttttttcccccaaaagaaacattcctctaatcactgaataaattcctgtgtatttggctgctgctgtccaaagaatttttttttttaatgtaaccaaagcctatagagactgtttgcttagacagagtaaaagaaaccctgttggatttaggcaggccaatgggaaactaaatgtatataaaacatctgaactaaatcatagaaatagcagaatgaggtttggctgtgtttgtgttttcttttacaagtattacagttcattaaatataaatgtttgatgttctttctagttaagaactcctgtgccttaattatatagtttgattaagttgtttaataatgtaagtgcaaagatatggagtctgcttgttgagaagtaggcttctgtggggttacgttaatgtacagtggaggctctttaaaatcacactgattcctgttagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagtaagttctgggctgagagcctgttgcccttcccaggttctctatgacatgtagctagaaactttctgtccatttaatactacccagccttccaaatatttataaaggcagctggcttttccttttcttcctcttatctttgtaaaattatgaagctggcgacacatgtagactgataaacaaaaaggttagtaattcttaacattctttgtgcaccttgaagtatacgttacaaagtttcagtccttaaagtggacctcctagcaggtaagtgggaagcagggagcactgagcgctgatactgaaagacagagttcaaggagcctgggcccagcttctaaaaagcatgtgttacgtggcccccgtgagctctcagcctgtgcattttatcctcgatggtgctggtgtttgtgatgggtgcttatacctcctctgagtctacagagaaggaaagttaggtccaagatgcccctgccattgtgttgtattaaaagctgtggcaaaggaatcgaaaaccaaggtctaagaataaacagtgctatgacgttctgtggacacgacagaagccttaagtggaaagtcaagtgggaatgaaatctagggggaagttcaagaaaaagaggacattatataataaaagcatttgattgtccttgcagttttgatggtggtgttttgcgtttaaaacaatcatagatgctaattgcagaaaagagtttagtaagaaaaaaatcagaaaatatagggtatagtaaaagttttacaaaataaaaaggtatagtagttgtgagtttggttcaggacagagttttgtaaacttttttttcatcaggtggtgattattttagggtttgtgggtcatatagtctgttgcacatactcagctctgccattgtgtcgtgaaatgaaatggctgctcataaatgaatgagcatgaccatgttccagtaaaactttacactaacaggcagtgggctgaactggcccacagaccataatttgccaactctcctggtctagaacactgggatagtagacagtggaaggatggggtggctttagtgggaaatttttctgtttcatttctttatcttctgcatccaaattctagtaccctaccatctccttttggggagaaaatgtctccgtataaccatacccactttgttggtttgagttctcatttatcctcttgtaagcaattagaccatagcctaagttcttctcagccaccttttcaggttggtgatcccttgctcagtgcagaacagagaatggggaggctccttggggctttagagacttgtgtaaccctctgaagatcagaaatcagactggatggaaataagcagagcccagaagagcctgtctaatgggcttccttccctgccaggctattccaggtgaagatggaacgggagcagcatcagactgagatcagggatctccaggaccagctctcagaaatgcacgatgaactggacagtgcaaagcgatcggaggacagggagaagggagctctgattgaggtaagcagggctgtggggtcaggtgataagacaggccccacctgcctggaaagatggagtggctagggtttgtggactgcaagccactttctgatgtgcacacctgctccacctgtgctcttatgatctgtgagtcagtggatgcgcttgattctctcctctcagcttggcatttgctaattattatgggtttttattatgtattctctcttctctagattattatcttgttgaggtattagattcacatgtatgaaattattagcaagaatgttggttttcaatatgtacatttttgggagagggaataagtataattgagggtcagaaaaagacaggacttttatctctgcacccatttaggtgtttgatgtttgctgtaacattatcatcacctgtattctagcatagttttggaacctacttctttataagtgtggtttgtaggaatagcccaacaaagagatgataaacaatttagaacaaagccaaaaaaattaaaagtcaaaacataaaggtactgtgttaatatttaattttctacttcctccctctttgggcttaggtgttttctctctcccttacttggggctagaagcttctggctctgaagtccctggaacactctttaagtctcagttgtctactgttctgtcactcctttcctcctccagttttgaaataattcctcaggagagattttaggtcctactttttagaacttagcctttcttcacccgatgacctggcaggagctcagagatgagtgactctggtcacccagcccaggagttctcatgaatccatttttcacattggcagaggagggtgattgcctcttctccatatatgaccatctctctttccctattcagaccttttctcctgagaagccctcagcattgttccttaccaactgggattcctctttttatcaaatgattccttaaaaaccaccacattcttggtataatactgcttctcatggtgctgttttctctcagggctcagagttacaaagacaagaagatatatgtatttatcactgaaataatattaaaacaacataaaacgaaaattgaaaaaagggggagggggggacgtacacatactttcctaatacctgagcagccatttttatttctataatctctgtttgcctccctatctattgatagctttcatctacccatgtatatataatataaggacaatcataatgtccctacagttttgatacctgcttttaaaagttaagatatcaaaaatgttctttcttattatactttatgctctttgtatttaatttttaagaagataaaccacaatatatttaaccattctcctacattttttttcccttttttgtaattttgaaacaaagattgtggggaacattttttacatttatacttttactactttaaaaattgtttctaagaataagtttccagaaatgatgtcaatgaacaatttatggctttcaataaaagtgtagcttcatgaacaaatttaaatagaagataaaacattgtcatattcttgattccttgtgtgaacattttattggttctaaaagggaaagatgttatcttagctcttgggaagtctctgaagttgctgattttccgcagtaactgacagctgtcactgtgagttgccccctgatatcccctgtccttttagtttctctattttaactcacttgacgttgcacatattttgtatctttcttctgctagccagctaattcaagagcaatcacttttgcttctttccgcatttcacatctagcacagtgccaagcaacagagcaaatgaataaataatttttcgtatttaaattacttttaaaatgtcaccattttttaaaaaagggaataattctgaaatgaactgcatacttcttttcctctttaaacatgccatactgcatatctattaactgaacatcattagtttattgatttatttatactgatgatgggataacgatatgagactgttttggtgatgtgttcaggcagaggctgataatgcgagatacaggagtgggcaatagcacatattttcttaaacctgttcgtgatgttgctggcttacaggtagtttgtctctttcccacaacaggaactgtatcatttactgctgcctttctgcaagatgagttagagtgtaattagtctccctaggccaaagtgggtttctcttgctccagaaaatcaccctctgtttttatcagtttcctttgacttgtcagcaacacttaaactatgatctacggtttctacgtcactagtaaaatagaccctgtctccttgtcactttcaatttattcttcatatcttaataaaaagtggcctgggggaatttgataacagagtatagttgtggccaagtttcccatggcagttagcttggaacaaactcttaacacaatgagcattaaacacttatgcttttgaatgtttgaaaaaggttgaaggcccaagttttgcaagtcctgcataatggaccagattttgcatgaaatatcttttaatatgtcactttttgttaaataacatcagacccctgtatgcagtcagtaaagtaacattaagaaggaataggctgctctgtctatggagcagccattcttttgtttcttctctaataaactggctttcacttaaaaaaaaaaataaataaaacagtttaaaaaaaaaaagaagggagaaatagtagaaaacactttcttagagtaaaccataaaattgaccaacaaagggttgactttgttattcttagttaaatagatgattctgaaattttttttttttcagctcaagttacaaaaatgattatagaacaggtttccaccacttctctgtcaggaatgcattaccttccattccaagggtgacaggtcaacgtgagacagctcgctaagtgccacgatggtggggttttctaattatcaaatgtctgctttgatgggagcctgcggtgctgagagatgggcctcactccagcagagtcttgtggtgttttatccctggcatttgccaagatacaggtacttcagtctcattaaaatagtctggttataaaattgtagtggtttgaggagagattgtgttcagaaattatgtctctaaaacttcttttgtaatgatattattgaacattctacaaatttttataaaaaaggcagccaaaaataccatgattctcaccagccgtgtgatgcttccttggccatcctggaacaaaaaaatgacagaattctttgtcagctaccgttgctataaaaccttttatttatgctttcagtgagcatgggccagagatagggaccctgtggaacttctgggaagcacttatgcaaaagagggtctagactggtgtcttcctcattttgatgtggcacgctcatgcacaggtggtgtgtgaagtagagctttttgtgagcaaatacattgccgttctcgacatcctggtgcctgtttctcagtgcgcatggtcgtggggtggccacttgctgctgctgcagaacagctggtctcatagtgtgttcctttttctctcagatctccttctacctgtctcttcaggctctggttgcttttctttgctttagtttaagaaggtggacctccttaaagggccttccagccaaacacagtgctctgttttgttggcatctgtactaggctgttttcatgctgctgataaagacatacctgagactgggcaacttacacaagaaagggatttaatgtactcacagttccatgtggccagggaggcctcataatcgtggcagagggtgaaaggcacctctcacatggtggcaaacaagaggcgtgagagccaagtgacaggggtttccgcttataaaatcatcagatctcctgagacttactcactaccacaagaacagtatgggggaagccacccccatggttccattatctcccactgggctcctccctcaacatgagggaattatgggagctacatacaattcaagatgagatttgggtggggacgcagccaaaccataatagcatctagtggatgaactccagtgtgactgcttgcttctcagccttcttgagtatgtggttttgtggtcaggtctgtactgaccatagtgaagggaaagggcattaggacccatctgggtcccattcttgactctactgcttataaggctgtgtggtcttaggcatgttagaatctcagagcttcgttcgtttatgaagaatagtaatcttcatctccttgagtatccatctctctggattgttagaaatgctcagcacagttcttatgatgtataaggaccagacacagtcaacttttctagctctcgccactcccagacagccagttttctcttgttttctttaactggattccatagagaggcaagttgacctctaatggatgtatacttacattttgaagtttatgtatttttctctcccttctttgattgaaataattaagccccgaggtgatggagtgaagtttatgaaacatcgtgtaccttttagtctctactctggaaaacttcaagtgctactaagtgatatggcgaggtgtaatctgattggatttgtgctgcacagtccacttaagcaacagataacagcatgtcgttgcagaatggaccataaaaacctcagtcttgacatgcattggcggcagcacacaaaaggcaacacaaaacatagagatatgctggaaaacataagtgtggggagaggaactgtcttatcatccaaacaattgagaaacgtgtgagagtaaaagcaggaaacaggggtcagaatcacagggcctgcactaaagatgctggcaggaggttccaggaagccctggggggtagccggaagcaacagtaattcaggagagactctgatcttccttaagaaggggctgggcagcggcagcagggcgtcctctttgataaatacgaggacagggtataatttcataagatctctgtgtttggtgctttgaaagagccagagccggcctcgttacctgcatgggtctcttgacatttcttctgagcttgtcaatgcctgctagttagattcttgatgggcaaaatcttagtctgtgcaatgcagccccaccctgggattgtagcggttcccctggttcaatggaggtgcatgtcctagagaaaatgaaagagatctcgttgtcggttatacttaaatcaataaaatgtttcttccctcatcagagacacaattctggaatggaaagtagcttatcatctctgaagccttgggtcccccggtggcaaccatgcctctgattacccaggggttccaagaaaacaggtcgtgttcttatgcagaagccacaagtgaaataactgatgagttcagaattctgacatctccagacacctgctgtactgcacttgtttatttatatctgaacagataagtgctcccaatattaatctatgcatcaaaaatataataaatcagatctgtatccttctttcaacaaggataagtaggcgagtcaaatgcagatgagaaaaatgattaaaatatatagaatgtaaaataaaaagtgttaagtactgtgagaagaacagctagagtgagatgggtattcaagagggatattcaaggaagacctcttggaggaggtcttaccgtatctgggtcttcaaagattttctgaaaggcagggagagatgggcctgagaagggagaagggcactccggactgaagatgctgcgtggattgccatagaggctgtaggtgagagcctggatgcggggagcagctgagtggttatcgtaaaccacctgcacaggaggtgaggagggctttacccagggaggtgacagaaaggattgaagatgttgcagaactaactttttggttatgagagactaggacgagagaaagtcaaagtcctgccaagtttctgagcttgagtgctgagggggcaggtggtgcttttcacaagagcaaagaacaaaggaagaaggaaggaaggagcatgatgaattctcttgaaattgtaatcttactgaatctgaggtgccacaggacatccagatgggttcatctagcaggtctttgaatgtgttagtgcaggtttgaactcagagaagggtaagaggtaaaggtttaggagtcatttacatagaattaatagttggaaaaacaaaaatgagcttgctaaaagagaataaagaatgcaaagttgcaatcttggagatcatcatagattttgggaagagggagtgaaaagccagaaaagattatcaaagaagaaacagcctgagggaagaaaacaggagtctgtgttatcttggcactacaagaaagaagggcatcttagagagacaggaagggaggatgaaagaggggtaaagaaaattgacaactgggaaaaggccatcggatatgagtaaaggtcacaatgaccttgcaggggactgtcttggtagagcagggacaaaaatcatatagcaagagattaaggagtgaatgggcagttgtgaagtagaggcagtgaacagaaattatgctttcagacattttggtggtgaagtttggcaggtagccaagattcaagagtatgggtaggaacaaaatggcagaaagaaaagacaactgtattagtccattctcacactgatgtaaagatactacctgagactgggtaatttataaacaaaggaggtttaattgactcacagttccgcatggctggggaggcctcaggaaacttcatggcagaaggggaagcaggcaccttcttcacaaggcaacaggagagagagtgagcaaagtggggaaagccccttataaaaccatcatatctcatgagaactcactatcacaagagcaacatggggaaaactatccacgtgatccaatcatctcccacagtgtcccccccttgacaagtgggaattatgggaattataactcaagatgagatttgggtgaggacatagagccaaaccatgtcaataactgatggagtgaagactgggagcaggctggcaggggacagtgcgttctctgtggagggactctgggtggaagaaggcctggagtgcagagaggggttgaggtggagagggagccaagatgcccacatctctctggctgagggaagagcaaaggtgtctgtgagggcgagtcctgagctggaaaactgagaaggtctgggacaaaaatgctggagggaaaggaatgccgagcctttggcaggacacactgggctcaggtaatgtgatttatagtggagcctgttgccccagctttgtgaccttcctcattaatacctggcagttaagaaggggaaaatatgaatattgtgctctgctcagatgggcaaatgagatagaagaaaaacaggcaaagttgtcctgagtacgaggaatgtggatgaagggtttgaccacactcagggtcccaggggatatgaagcaaggtaggcaagctggcgtgcccccgtgaagcaacagcacacacagggcaagagcaagggcaacagatcactgcacagaagtgaaatgagatggaagatacagacgtgttccccaaagcagtgaaatttacattagtttcccctttctccctcaaattcaatcaaatctccaagaagcagaggcagaggaatccaagggaatgatggcctctgagaaatgcagggggagaggaagaaatggtctaaacaggtgtgcgggatgtggaaggagagagtggcaaggccaggtgagatggctgtgcacatggggactgaactggaggggagatacagggcctctcaacaagatgtttcattgtcaccttctcccttcgtgtttcctctctctaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaaggtgagggatggggcaggagaatctggcttgtgaacagatgaaagggtaagaccctctctcccacaccactgcaaatccccttcattccttttaattagagagtgaatctcaattcatcagatcatggacacagagcttattaacaaagaataagctcaatggtcctgctattgaccttttaaagtctataaactgaaacgttggtagggacattggttaaatcctgttgcagagggggagatgaagaagctgcatatgaacacttgaggttctgcagccccttgcagagtggagggatgtactctcccaggcgttcctaacggtcagaggccgagggcattgtgtgaccaagttaatgggcagaagtgcagacgggacccagattcctggaatccttcatcccccaccctagtctgttccttttgattttgtgtagccttttgttggacaattcaggttcttttctcagcacagttacaagagggttaattggctgaattgccgaaacccttccaagataatttttctcttaattgaattcttggctcctacaaatagattcaaaattatgctgaagtcttttggggcagacgtcatactggctgttgaagaagagaaaaacagtattttgaaggggaaaatggtttgaaatgtcatgccatctttagggaaagaggggaattacagattataaaattttcagagactctgcaatatataggttaaaaatgatgaagaaagaattcttgatattgtttattctgtgatgattacagtgacagctcagagttagtaggccctctctcccctaagccctatggtgattcactgattttcaattatggcacagtaattgcaaatgacaagaaatgaaagatgggtttgtttgttataacaataaaaagtctgggaaatagactgtttggggttattacaacttggagaccgtttttaaaagcctcttgttgatttccctgtcttatttttttttagatttgactgaatttgagggagaaaagcgaaaccgatttaatttttattgctttgaggggacatgcctgttatttgcatctcatttcatttctgtgcaccagcctggtatccttgtgatctatctttatgtgctattgcttcatcaggtacatgccaataggctactgagttaaaatttttctcctttggacccatatctttatcacccttaaatcttgcctcaaaacttgacttaatgtggtgtattctgggtggctcctttaagggcagttgagaatagtgttgggggatatgtttgtagtgatttaagtataaggaaaatcaaacttgtgcctcacatggggtgggggctatttattggaagcttccaggttctctactgtcagagatatgtaagtgaggaaaggatacatggtaggtgaaaggatatctttgttgtatggaattgagatcatcagtagagacttatgttactgcattttgtcctgttcaaatgtctgcattatatattaactcatagtattttcattatgccatttcaagagcgacaactacattgacccatatcagtctgtaaaaacgaaacaggcgaagtagtcaagacgtgtatcactggcagagaatggacagtttccaggcaccgggaagctaacacaaaggggttcgccttagtacccactggggtgtgggccagcaagggctgtttgttccaggttgttttctatactgctgccagcaactttccttacaaaaccaaatctgatcgtgtcagcctttgcttaagtaacttgcttgactccccattgccccagatttaagctgaaaattgttagcatggtagggaagaagtcccttctctgcctaacccatctccagaaaactctgtgtctttcagacctctcacctcttcatacgtgtagagtgacttgctcctgctttgccatctgaacaggctgttgtcctcctgcaagaattcccccaaatgtcctctcttttatgaacatgccctagatacctatactccctttggtggagttagttgcaccttccttcaccttccttagggtttctgcggaaccctggccattcttctactgtagtttgtatcataccctattataatttctcatcttgtctgcttcctccattagactctgcacttcttaggcatagggggcacttttgtcctttttttttttcctgagagggagtgacaaactctagtacctctggggccagacagggagcataaatgagtaaagcactgagtctgttattgggatgataggagggtatggtggggactgtgacaagctggctggagggcatgtcctttgctggagcggtcagtggcttctctgctccagcttagagttgccagtgagagaatgctgggcccatgttgctagatctttcatttttttcaagaagccagatatctggatgtttctgtgagatctcccaacttttaagcatatcttcaaattacaaaataaataaagaaataaataaaataacatagaccaatacaccccatatgcaagtcaagagcctgtgctcttagcctcttgagctcagcatggtgcctgggacatagtcacatccgtgcggtgtctggcaagtgaaagttagtttaggacaaatttcctttctgactgggttttcagtccctgccatgtagttcctgttgaattttttcagtggtgatgtgggaggtctttttgggaactctagtattattctttgaatttctgtgccttgcttttgaatttctctgcggtttcttttcctttcctttcctttcctttcctttcctttcctttcctttcctttcctttcctttccttctttctttctttctctttccttcttttttttttttgagatggagtcttgctctgtcaccctggttggagtacaatggcacagtcttggctcactgcagcctacacctcccaggttcaagcagttctcctgcctcagcctcccaagtagctgggattacaggcatgtgccaccacgcctggctagtttttttgtatttttagtagagatgggctttcgtcgtgttgaccaggctggtctcgaacacctggcctcaagtgatctgcccacctcggcctcccaaagtgctgggattacagatgtgagccactgtgcgcggcttccttgcagtttcttaaagaggatcctgattgtgttttttcaccatattagcttttgcttctgaaggtggctgcttaacaaatgtgatagagtcatattttatgggggacaaatgtgtcaatttagtagatggatgctgtttttggttatattatttatgtcttggtattatagaatagaacattaagattattaaatatttggaggagagtgaattaaatataatttttaaatctggtaaataatgtttcttaaatatgtgctcttacacttagatttttcctgccccagggggagaacccacccaccaaccactatggctaaaaactgactttttttttttttttttttttttttaagatggagtctcactctgttgcccaggctggagtgaagtaaaatgatctcgtctcattgcaacctccacctcctgggttcaagtgattctcctgccccagcttcctgagtagctgggattacaggcatgcgccaccacacctgactaatttttgtatttttagtagagaccgggtttcaccatgttggccaagctggtctcaaacccctgacctcaggggatccgtcagcttcaacctccccaaaaaaaaaggacatttctttaagaaattttattgcattaaaaagtttattacttcaataggtcttatgaagcagcccaaccttctgtcatcagtttttcttattcttaccactgccccagtgtcaaaaccccctaaagtgctattttatcgttgtaaaataaccagcactttatcctagcttgagcactaaaggttttacgttactagaacatttggtgaaaaatgtcaaattatatttcgaatgttgtacaggtattccaaacagataactctgtaatagtgtattttgtaaacccatcagccatatcttttaaagaacagtttgattgctcagtggatggaattcatgaatgcctatgttatgtggggtttcctcacccagcagaatgaattgcatctcactggcagagcggtggaggtttgggttataatgtgcactatttaagttctcttcttatagagaaatggatcttcgtagtctgttaggagagtatatctaccaaacattcttttaaaggactaagcccttaagcaacttatttcataacatgcttttttctctgtttctggtcattttacactttttttagttttaaaaaggaaatgtcttcttcttccttgggttcgtggccatggctggaaccctttagaggaaatgggcgctcaatagggatgtgaatgactgccatctgggagtaaaattaaccttgttcacagccgttggcttattttttccaaacctaacccttcctatctgcaactcttgtgcaaaatagaagtacagacagtatagtttcttgaagtttctcagaaagtaggttcagctcaaattccagctcttccaggaacttccctcgctgccttttggaccttacagtttctagagacctggtattgttggcaattttgctccgggttttatcttccctgccgtactaggtactgtcatcatcttctacttggtaacaccattgtgcttggtacttaatagatgtttagtaaatgtttgtgggttagatgaatgaatagacaaaaagggagatgtctttagagtcctcaacaatctgaagaccaaccattagactgttttggcttttaatttataaattcaaattacttctcatgaaaatgaacaaatcttgtttgttaggagcagtatcatgatgttaatgttaatcttcgaaggagtaattttgcatctaagagttgcaagtattttgatgctgataaaacagccacttttatttttgtgccagataatatgacttttgggccattaggcactttcagagtgtccaacatacagcagttatgcaacaaatatctcccaagggaatggatgagggagaagaggagggaggttgaagacatgtgagatactcttgccatccttcatttctccgtttgcattatttttaaatacagcaccttacaaactgatttactgagcaactgccaagtacagggcatcgtgctaagttcgtgaggactatacatataaatcaggtggaatttacccttccaggagattgaaggggagatatgtaactctcaagctgattatagacaagagtaaatgacccaggtgaagtggagataaaatcatataggaatccctataggagaccccatggctgtgcttaggaggaggactgctggcaatcacgaaagattttagggaggggacagtatttgagttggattttgagtgatgtttgggcatgcgggctgaggacattttgggtactgagtacagcatgagcaataccttgtaggtgggaaagtgagatgtctgggctgggctttgtggagaaaatgaagttaaggtggctacagattcagagacttaaggggcgggtgcagagatccaatgagtggaccgtgctcggatcccaactgaaacaaactgactgtaaaaaacaaaaatagctaaaatcattgggaacgttttaacactctatattaatgatattaagaaactaaacaatttttaaggggtgataatagtgctattgtttttaagagtctctgtcttttttttttttttttttttgagatggagtctgactcttgttgcccaggctggagtgcaatggtgtgatcttgactcactgcaacctctgcctcctgggttcaaatgattcttgtgcctcatcctcctgagtagctgggattacaggcgcctgccaccacaccccgctgatttttacgtttttagtagagatggggtttcaccatgttggccaggctagtctagaactcctgacctcagataattcacccgccttggcctggcgaagtactgggattacaggcatgagccaccatggccggctaagtctctgagttttaaagaaacatactgaggtttttataggctgtctgaaatttgcttcaaaataatccactttgttgggggaagtcagtggggtatggatgaaacaagatcagccatgcattggtgtgtgttaaagctgggtaatgggtaggtgagagttaattacctatcctctctacttgttgcaaatgtgtgaagttttttcttcctttttttctttctttttcttttcttttctttttcttttttttttttttttttttttttgagacagagtctggctctgtcacctaggctggagtgcagtggcacgatctcagctcacttcaacctccgcctcctgggttcaagccatcctcccacctcagcctcccaaggaactaggactacagctgcacgccaccacacctggctagtttttgtaaagacagggttttaccacgttgctcaggctggtcttgaactcctgagctcaggccatctgctcacgtcagcctcccaaaatgttggggttataggtgtgacccactgcacccagcattgaagttttctttggtaaaaagtttgcgtgtgtgtgtgtgtgtgtgtgtgtgtgtgtgttaaagaataaacaaaaagagttaaaataggaaaggtggggtggggtgagattatggagactatttttagttggtagtcagtgagggagcaatgatgtttcttttattagggactgatatgatttggctatgtccccacctaaatctcgtcttgaattgtactctcataattcccacatgttgtgggagggactggtgggagataactgaatcatgggggtggtttcccccatactgttctcatggtagtgaataagtcccacgaaatctgatggttttatcagggatttccgcttttgcgccttcctcattctctctttgcctgctgccatccaagacgggacttttcctcctcgccttccaccatgattgtgaggcttccctagccacgtggaactgtaagtccaattaaacccctttcttttgtaaattgcccagtcttgggtatgtctttatcagcagtgtgaaaatggactaatacagagacctaatgtggggacattacttggtggtggtgtgacctgaggctgcagctggaatggttagaagtagagagtggggaggaatgagcaggtagtaggggctgactgaggagaccccgcagggagcatgaattggggtgaggaggaagaagagagacagctgacctgagcaggcatcgtctctgggtgcctggaagggggctgtactgggaatggaaaggctaatgagttcatcttgaggtcctgggagccctctgtgtgaacaatgagtgaggagcagggctgccctatccatctgggagtcgttggacggagtgtgagcgagtgacagagagagaaagaagcgaagggggccgagggcctgaggaggaagagaagacacagacacagagacctgaagagaagcagccacatccagtgacaggaaagccaggggaagggcagttcatttgacttagttaacagtctattgggggagtttctaaaagaaggctatttttgcattagacatgtccatactgagtttctgtacttttgtcttgtctgttcctcatactgtaaattctttctgcccatattttatattgtctaacccttataagaattttattcaaattcaataatgttgaaacttttctcccccttcaccaccaccctccaattttggctgtgtgtgtgtattttacccagcaatttggaaatgtcactgagtcttacagaaatgaatatatgttttggtaccgtgttcccacgtcatttctagttttgtcccttccctctttcctgccaatgtctgaagaggttcttccaaagcataaggtcagcagagggtcaaatggtaaaaccagtgctaatctcaggatcagtggaatcgcttcccttaagacatggctaattcagtgtaaaatctcatttctgtcttctccaagggagccaggttagctagggaaacagcaaaaattcctcatttcctctgcattttaacttcaaataatcaacttaccctgaatgacggctactgagagctggagaagtggtggggtttgcaatcaggtgcccaggaaaaggaaaatatctcttttccacagactcaagcctgcctagagtgacatggaactttccataggcaaaagtgaaatgggaagattcaaggctaaaaaaagatctctttttttttgtctctctttttttttttttttgcctgccccagaaatggctcttttaatagttgtataactcttctgcatcttgtattgattaaaaagtatataaataagaggtctagagtggtgtcctgggatgttccttttgaacccatcacaggcccagtgccccattctgtggctgtgatcccaggtgcctcccatgtcctgagagtcagtggctgtcatgaaaaaactctggggggctgggtaatggacagatctcttagcgggcctccatgagggataaacagagcatctctgcaagtcactcctggtgttttacctgagctgcctagagtcacttgctgtgggttaggctgtagaagacaaagatatgctggtttatctttagatatgcggattcatttgccatcaaatgcctgagtgtgttttctgtgccagcgcggtgctagtcaccaagaatataaaggcaagcaagctgtggtctctagctttgaggatcttatgtggtcttgtgggcagaaagatgtgcaagtaaaatgacaaagttatggttgctgtggttgaggtatgtgcagagtaggagattaggagaggtttattgctttaggtggcaaaattcaggtgagaaatagcatgtcagttctgtgagttgacaccctaagtgctttttatgtaccaaatacttaagaattagaaagaaagaaacgttcctcttcgaagaacctctctaggagctttgggacgttggtgtacctcgaacttgctgactttgtacccaacttcttttagtgaaactcaagagttaacaattagaattgctaggaagacaaagaaaaaatattgatttggctggtgagttaaaatacatttcacttattcagtaaatcagcttccagttacagttcagatttccagagcgtaggagctcataaactatttctgaggagagcctctacctttcctggctaggatgacagaataaagggcttctctttccaggtctaccattagggcttttggcgagtagatttagcagctgctattctgtagagaggattttggctttagcctcacagtgcaggaagaactgatggagaattccattaggaggatccctcacatggagaggtaggacactgggtaatttttaatgaccctaccttggtgcttcatgaacatgtttaagcaggctggcattttctagcagttccaataaggagcagaaggtagggctgatacccagggcacctcgatgactcaaaatcacagcaaattcacaggcagcgtgcggagaaagtgacaagacttagttgggtagagaaggaggtaatgcgctggaagcacagctgaggagcttggtcgcgtggtcaggctgcctatgcctagccttctgggggggcctcctgctcaccgatggagtgaggagggcccttgcctgtttcccacctgcgatgaacagtgatgaggaaaataggctcaaaccactcagatttcgtgttcaatagtcagtgtcaatgtctaactgttgggaatggattgttgatacagtttttggaatatccatccaataaatagttcatttatggtcattaattaagcaaatatctaaggagcattttatttatgtcaggcactgcgctgggttgtaggaataacatggagaaaaggggtgagaaggacgttattcagataatcacatggataaatgtgtgattttctgggtgtggttgtgcaccctgtagtcctagctaccagggtgtgtgaggcaggaagatcacttgcgcccaggagtttgagtccagttgggtaagagagcaagacccccatctcagaaaaaagaaaaaaatatatacatgtgtaattcagatgtgataaatgctttgaagttcagggagggagaaaaagtttccttgaggaaaacgatgatggaaatctgaaggatgaatgggaattaactagatttttaaaaatccagagactggtccaagcagaggaaatagcatgtgcaagggggcttgcagcagaaaggagtgtggtttgttcaagctgttaaaccatggcaagtgaggctgggctgtgaagggtggttgaaagtctggtatgagaggaagtagaagcagatagggaacagctcatgcagcctgtatggagcatccgaaggacagatttttagagagagagacagacagacaagcaggtgtgtgtgtagtgtttttgtgggggagtgtgaatgtttgacacagacagattacttccatggaaaagtgcctgctctgggcttgaccagtgaggtgggaggccctgggatgattcgttcatgctgacacttaggatggaggcacgggatctttgaggtctcttccacaatttcattctatttttaaagggattattacctgtccctgtctctcctgactcctgtggagaaagggatgggaataggattatgtagggccccattttccttatgagtttttgctccttgctaagtgccagtctgctgaatttataacatgtgtctttgggcaggtggatgagagatgatagggcttatagctgaaggcagaagtttggtatgctgacggagaaggtttgtaggaggaaagtttttatttgtttcttgcctaataaggcttttataatgggtcagcggtgggaatacatttaaacacttacagaagcagagaaagtaacgtagtggggtgcttgcctatctccccatgtggagtggatgttctgaaatctctgagccatccatggacactgcccagagtctggaagtgtgagtaacaaaggagctatggctactcactgatggccctacaccagatgcatttccagatgtggatatggtcaagccacaagaattgggtggtgcagtgagtggggctattataaatagcctgggacagtcacagccaccataatattgcaaacagttgaatccttaacatctaaaggaaaaaagctttattattggaaatcctattcaatctatgttatactctctctgaccctctaaattctgcctgatggatatttttctaaagacttgccaagatcattaagtagatttttacttggtggaaaaatttggcgttatgatttgatcactttaagcagaaaatggaatatgtcataaactctaaattcattagacaagaaccagtatggaaacaggaatacctacagtggcaaagttaatcagagtgcataaggcatttacagtagcccgttggcccccagtgacctgagccttctgggcctcttgctccattatagtcccttcccatgtcgaaaaggtctgatttgtgtaactaataggatattatggaaatgatggagtgtgacttccgttgcttgatcataaaggacatgtggcttcctccttgctttctcatggatctcttgctgtggaggaagccagctgccatgttgtaagtgcacttaagcagcctgcgaaaaaccccatgtggcaaaggactgaagccacctgtcaacagccatgtgagtgtgccatcttggaagtagatcctctggccccagtcaagccttcagatgactataaccttgactaacatcttgactgcagcctcatcagaaaccctgagccagaactgcctgattgagtcacttcttcttcttcttcttcttcttcttttttttttttttttttttttttttctgagacagagtctcactctgttgcccaggctggagtgcagtggtgtgatcttggctcagttgcaacctctccctcccgggttcaagcgattctcctgcctcagcctcctgcgtagctgggactacaggtgtgtgccaccacgcctggctaatttttgtatttttggtagagacggggtttcaccatattggccaggctggtctcgaactcttaacctcaggtgattcacccaccttggtctcccaaagttctgggattacaggtgtaagccaccgtgcccagcctttgagtcactgcttgattccttaccctcagaaactttgtgaggtaatgtttgtcactttaggctgctaagttttgggacaatttgttatgcgggaataaacaactgatagaacattttgacaaaccatctctttgaagctgcattttctgatagccactggctctagcagaacccacagcatcctgccatgcccttggtttagtccttgttatgctggactatatctcttaggtgatatgtcatgctcctcatcttgaaggaggggtgtcttgtccttcatatcgtcagtactttgcagaatgccctgtatttgctgtatgagtgaatcagaatgtgtagaggtaaataaaggacacccgcatagtttaaggacaggtcagggttttaaacccagctttgtcattgacttcatagaattctcctagtctttctctgtttttatttcctctcttgtaaagggatactatttgtgttataaaaaacatacataatatattgctatacatgcatatgtgcttgtgcacatatggattatttcaagagggagataactagtcaatagtggttacttctggggatatgtagggggatggagtaagaggaaaactttcaaaaaacagtgtgtaaacctttcatatcttttgaatttattccatgtacagtgaaataagagtattgatctgcacctctcctaaggcaggtcaagaagaagtcctaagtttagtgaagtatttttaattttttgtcactgggggcccctgcctctgccttgaccttgaccttcaccttctgtctgctacccaggtctgtggcttccacatccacagcagctcagttccatcctctgacctcctttctcacagttgctgccctggttcaggcctcagcagccatctccctatttccccaactgtgttgcccccttctgaccacaccacctgccgcaggttggccaccctcacaagtccctggtggcttcccttcagttacagagtcctgcctggtctccaaggcctgcactccaccacctggctcccacctgcctttgcaaccctggccctcactgttgtccctggtgagcttggtgccagccacactaaaggattccctgtcacctccacagaagagtgtgccctgttactccgtattagccacctctgggactttgctttgcaatcctgacctgcaagaaaggacagtccccacaacagagacatatctgacccaaaatgtcaatcatgtcactctgagaaactgggatctatgtatatacaagtgtggtgtgtgtgtgtgtgtgtgtgtgtgtgtgtgtgtgtgtgtgtgttttcttttcttctctttttacataaatgcctgctgtgcaaccccaagcctagttaatgagcaatagatggagtgactgaatacttttgacacaccacatctctgatcccaaagaatcttcttcttgcagtggggaaaataatcctcccagggctgtacgtattccagcctcagactgtcttttctgacctgctgtcctgtgctctctcactggattctctgcgtgtgccctagtggtctccctgcttgctttcttctttcccccggctcatattagcctgtctgtccccaacatccttcaccagcccccgagctatggtctccgccatttaaaatcgtgccatccttcatggctcaggtcagatgacatctccttcttgggtccacccagcagctgctgttctttctctttgaaatccccagggtcttttgtccctcgggtggcatttattgtgttttgctttgcctgtagtttttgtttgtttactcaacacatcaagcatcatgcgaaatctggggtgcagagatggacaaggtggcctctgctctcaactcttccccagcctagtagagacagacaagaaagctgacagccagttcggtgtggggcatgagaagctggcatatggcacggaaagcagaagttcggaaaagggtgactttgctccgtgtaggcaggccagggcgggttcctaagagggagtgaggcttgggtgagtcttgggggcagtgggaattagcaaggtgacttatgggtgggcaaggacattctagacgcagggaacttcttgaaccaaagtatgtcttgttctcctctgagacttgaacacctctttaggggtaaccattttccttattcatttttatgccttttatagttttaccttagacagctaatagttttgtttgcattcatgtatttattcattcaacaaatattcttgagtgcttatttacttgaggtactggatagatgtaaatggatttaggcaaatagttggtgacagaagaattcagtagaaaccatcagagtagtaggcggcctctgaagtgattagatgtggtttagtgagttttagctacagagtaagtcatgtgttcacggtgaccacacgttagaattctggaaatgtgggccagaacaagtccaagttagatgcaatggaaaaatccctctgtccgagtcatctctagggaacagaacttgtttgaaccagcattattagtttagtttcatgaaagacaaaataaagggcaaggtgtttgctccacagggtgactgcagcagttttcacagtaatgaataaagtaatgctgttttgtcagcagtgagtaggagttggggactgggagaagcttgttccattcctcaggaaattccaaagtcatgcacgggccttatccttggggaacttacagatgaaggagagaatatggccaagcacacatatttctccttttaacacttcccttctttttctttctttttgttttatttgttaaatttctgcacatgtttctcaagtgtgtggtctagtgggaaggaatactggcagtctctgggtttagggaaacattgagtccccttacagttagaaataaaaggctggacgtgcttcaaagactttttgaaataaggctggggacaaagaagtcaagcaaataaatgatagagtccagagaaggtggcattagagatagatctgaaagcattcagggagacgtggtgcaggaggatgggaaaatcttgttttttccatccctgaattgtccaagagcccaaagacatctactctgcaaagtgtttgctggatgacagtgcaacgaagacttagatgctagcaaacttcgttggaaaacactgggttcttcatgtatttggagcaagaaccaaggcattagtaaactttggaaaataggcagtgaggttgtccgatagagtccatctggggaagtattttgagccagttgggtttataactatgaccctaaacttgagtccagcatatgccaagtccaaaggaaaggtatgttctttggacccctcatgctctctgatttacagggacctctttctgcctggtcaaggcatttcatgactctaagcctatgactttttgtgagaagaagccttccatggctcctttgctgcttggttttggggttttggaggcaccaggatgccaggctcctaccctgtgtgcagtgcttccttctccccgtcccattgtgaactgtttcccttgcaggttcaactcattgccacttcctgtagctgtcttagtgacccttcaggccagaagcagatgcctgtgctgtgtaccatgcccctcctgctgctgaactggagagaaaacgtggctggcaggtggtgaactctctggctgattcaggcccagtggagaaggagggttaataatttactttgcccctgtgtagccactggtgttgaccttgtcaaaacactagtagaaattaattagagtctggcctgtcatttaactaacaggatagtaaggccccaaaataacttcttgttttgaggttaatcctgtctctgagtttacggctgacattcctgtacatccggccctgtttgcatccagcagccaggaccgtgggctcatggtgttcatggggctcacaaagagggcacacaaggtcaggggcctgtctctccatgggagccgctcattgtggtaggaggacaaaggccacagtgatcaagatgctctgtaggagaggcggcagaacaacatgtgggcctggtagatattgcaggtgaagagcctccccatcccccaagcttctttcattttaaattcacagcttttgtttcttgagaagttccgaatcttttgcatctggtgctgcgagaaggttcacctggttaaacatcctcaagtcaacagcacagctccttctggaaggcactttaactggatgggatcctctcactgtagacattgctacctccctttcctgaaataaagcctgctccagagcagtgattgtcttgtggtgtgttgtggaaagctgttaatagcttaaaaggtctcattagctgctagataggcctagactgtgaaaggatacatggtgacccaagggtagattctttttttgagagtctcgcactgtcacccaggctgtagtgcagtggcataatcatggctcgctgctgcctcgacctcccaggctcaagtcatccttccagctcagcctacagagtagctgggactacaagtgagtgtcactacctctggctactttttgtattttttttagagatggggttttgccgtgttgctcatgttggtatcgaactcctgggctcaagtggttctcccacctctgcctcccaaagtgctgggatagcaggtgtgagctacagctcctggcccagattcttaccttattagggagtatctaaattaatctgtttattgatctcttaagtagaatctgattaattgtccatcaatagctagctgcaaagcactgcagaagcccacttgccactctccttcccccagctctccaggaaggtgcaaggagttgtttgagatggttctgacatccagcttttgggtccctggtttattgccttttccagtacattggctggcacctttatccagccaacaaatacacgctctgtaaacatgcatgtacttttggagaaggcagttggaccaaggtgagggtgtggaggatgggagtgaaaaacagagtaagccagaaaaaggggtcatgggaaaggaagggcaggagctagagggaagaggcctggggactgactagtgcccagcaatagaaacaatcagcattagaaatgggcaaaggggctgggcatggtggctcatgcctataatcctagcactttgggaggccaaggcgggcagatctcctgaggtcaggggctcaagaccagcctggccaacactgtgaaaccctgtctctactaaaaatacaaaaattagctgggcatggtggtgcatgcttgtaatcctagctagttgggaggctgaggcaggagaatcgcttaaacgcagtaggtggaggttgcagtgagccgagattgtgccactgcacttcagcctgggtgatggaatgagactccttctcaagaaacaaaaaacaaaacaaaatgaaacaggcagagcagtttgaagaaacttctcaagaaacaaaaaacaaaacaaaacaggcagagcagtttgaagtatgatgggaatgaggtacaggggaggcaggaaggagaaaagtgcaaagggatagtgagaagatgggaggtggtgtggagaggaagcagggaagctggtagcaccaagaagtgaaagaggagtttgagctaaatatctagaggataaagggggaaaagatgagtctgaaaggtatgagagggtgacagcaaaggacagaggagaagccgtgagctacatattatgccaggtgagatttctgctccaggaattttggctcacggttatcccaaagagctgtggcagcaagtgttggttttattgcagtattagcagtatgtggttactaaataagtgacttttgaaataaagtgtgaactgtgagactctagaagaggataaatgaaacttttatcacctgagatgggtaatttttatacctcttatttctagggtctctctatccacagcattgagcatgggtatgaaaatatgcattgaggccaggagctcacgcctgtaatcttagcactttgggaggtcgaggtgggtggatcacctgaggtcaggagtttgagacccgcctggccaacatagtaaaaccctgtctctacttaaaatacaaagaaatttgttgggtgtggtggtgtacatttgtaatcccagctacttgggatggtgaggcaggagaattgcttgaactcaggaggcggaggttgcagtgagctgagatcctgccattgcactccagcctggacaacagagtgagactctgtctcaaaaaaagaaaaaaagaaagaaaatatgcattgaatgtaatactttaaaaagttacaaccatcatttgtctgtgggggaaaataccatagtccagttagttgtacctgtctctagtggtctttgggcaggagtttgaagagatcattggaaagacatcagaagaatttaaatgacccatatcccgtctttcagaatgaaactaatattcattaaaaaaaattgtatgctctggctgagaatttatacagccttctaaagaggagacaggtatgcttttggtttccagtgatcagtctgtgaacttggggcattactcagtggatctggaaccttcttactctcaccagttggtttaggccatcccccttcctcttgaaaccaactttgtttgatatgtcattgtagattttctattatttcccccaaatcattccttaatgaacagtacaccttaaatgccttctctttgtatccagaaattatcagctcaaccaataaatagtatgtttgttagtcaagccagtgatccaggaaagacctggggttttttttttttttttttttttaaagatgggcaaagtttaaaaaagaatttttaaaaaatcaaacgttttgagatagttataaatttatatgcaattgtaaaaaaaaatacagctagatgccatataccctttatcctgtttcccccaaatgtaatgtattgcaaactatagtacaatagcatgaccaggatactgacattgatacagctgagatatagaacatttacatcactccccgcattcttcatgttgtccttttatagccatgccatctcgctttccctcccatccctccttgacccaactagtgtacttctctctggtttttaaattttatcatttccaggatggtatatagatggaatcatacagaatgtaaccttttggaattggcttttttctctcagcattgttctctggagattcctccaagctgctgcatgtatcaacaggttctttcctttttattgctcagtggtattctatagtatagatgcaccacagtttgttcaaccattcactcattgaaggacttatgggatgtttcttgttttgtactattataataaagcttctatgaacacagctttttgtgtgaatatgttttaatttttttctgggataaataggagtgtgaatatgttttaatttttttcttggataaatatctaggagtgtgaatgtgatttaatttttttctgagataaatatctaggagtgcaattgctaggatgaatggtaattacatgtttagcttttaaagaacctgcaaaactactctccagaatggctgcaccattttgcattcccaacagcaatgtatgagtgacccagtttctctgaattgttcccagcatttggcattgtcaatatgttgtattttagccattctgataggtatatgtgatattatattgtggttttacgcagttttctaatggccaatcatgttgaatgtcatttcatgtgctcttttgccacgtatatcctctttggtgaaatatctattcatgtcttttgcccatttcctaattggattgtttggggtttgttttttttttaaactgttgagttttcaaaattttttatgtattctagatatgagcactttgtcaaatatgtggtttgtaaagacattcttccaatctctagtaaaacaaaacaaaacaaaacaaaacaaaaaacctttttaacaaggtctttgaaaggtacaagtctttagttttgatgaagtccaatttagtttttccttctatggattgtgcttttggtgtcaagtctaagaattattttcctaccttagatcccagagattttcttctgtgtttttgttttctaaaggtttcttagttttgcattttacatttaagctcacagtccattttgagttaaattttgtgtaaggtggaagtttagtttgaggtttatttattttgcctgtgaatatccagttgctccagcgccatttgttgagagggttattcttcctgcaataattgcttttgaacctctgtaaaagtgggttgggcatttttgtgttaatttctgggctctctattctgtttcattgacctgtgtgtctatccctctaccagtatcacatagttttgatgactgtggctatattatgtcttaaaatctggtagactgaatcttccactttattcttttttaaaattgttttagctattctagttactttaccttttcttttcttttctctcttttttttttttgagatggagtttcactcttgttgcccagactggagtgcaatggcatgatctctgctcactgcaacctctgccttccggattcaagcaattcttctgcctcaacctcccaagtagctgggattacaggcagccgccacctcgcctggctaatttttttgtatttttaatagagacagggcttcaccacattgcccaggctgatcttgaactcctgacctcaggtggtccgcccaccgcggcctcctaaagtgctgggattataggagtgagccactgcgcctggcctaccttttcatataaatgttagaattaccttgtctgtatctatacaaattttgctgaagttttgataggttgagtatgactatgttgagtattccagtccatgaacatggtctaagtaaatctccatttatttagatgttcactgctttcatcatttgattttgtattttcaagcatacaagtcctgtatgtgttgtgctaaacttatacctaagggtttaatgtttttgagtgattataaatggtatatttttacattttagtatccttctgttcattgctagtatacagaaatgcagttgtatgtttttatttatgtttattttatatcaggacctttatttctttaccttgctgaaatcacatattctacaaagttttctttttttttttttttttgtgacagggaggtggtagattccttgggattttttatatagacaatcatgtcatctgcaaacagggacagttttatttcttgctttctgatgctttctgatctatataccttttgctacttatttcctgccttattacgcaggctagaagctccaatactatgttgaatcagagtggtgggagcaggtatcccagccttagtctcagtcttagggggaggtattcagtttcttactattaaatataatgttaattatagatcttttgtgaattggatgctctttagttgagaatgttcctctctattcataatttgtttggagcttaaagaaagtttaaatcatgaatggattttgagttttgttaaatgctttctctgcatttattgatatgatcatgtgatttttccctcctgattttaaactatcaaaccagcctagcattcctggaataaacttcacttgatcctactgtataattcttttaaaaattgctgacttttatttgcttgtattttgttaaggattcttgtgtctatattaatgaaatatattggcttatagtccttttttcatgttttcctttcttttaggatactatttggattttgatattgaataatactgacatcattaaatgagctgagaaggatttcttcctcttctattttctggaagagattgtgtagaattgatgtttattcttttttgaacactaggtagaattctccactgaaaccagttagacctggacatttcttttgggggagttttaaaatatgaattcagtttccttaatagttatgaggctattcaaattattatatttaatatcgcataagttgtggtagtttgtactttttaaggaattggtctatttcatctaagttgtcagatgtgtgttgagttgtttatagatgtctgcagggtctgtggtaatatatcttgtttaatttctgatattggtaatttgtattttatcctttttttctttgtcagtcttaccagaagtttgtcaatcttactgattttttttgttaacatttgattagtggtttttagattttttattttttattttactttaagttctgggatacatgtgctgaatgtgcaggtttgttacataggtatacatgtgccatggtggtttgctgcacctatcaaaccatcatctaggttttaagccccgcatgcattaggtatttcttctaatgagcttcctccccttaccccccaatccactgacaggccccggtgtgtgatgttcccctccctgtgttctcattgttcaactcccacttatgagtgagaacatgcagtgtttggttttctgttcctgtgttagtttgctgaggatgatagtttccagcttcatccatgtccctgcaaaggatatgaactcattcttttaaaagaatcagtttctcgtttcattgggtttttttttttctattttttttatgttttcagtttcattgatttctgttctttattatttctttccttctgcttgctttgggtttatattgctcttccttttccagattcttgaggtaggagcttcgattattgaattcagacttccttttttctagtatcaacatttaatgccatatattttattttaatttccattcaggtcagtgtgtgtttaaaacaaaattttcttgaggcttgctctttgacccatggattacttagaagtgtgttgtttaatttctaagtgcttgggtgtttgcctgttgtctagttcgagtccattttggttagaaaaccagtctgtatgatttcagtccttttacatttgttgaggtttgttttatggctcaggatatggtttatcttggtatatattcttgaaaagattgtatattttgctagaaagagatttcaaaaatagtaaatatgaatcaacctgaaggataaaaataaatgatttttctttcctttggcaatagaaatattgttactagttggacaagttatctttattcacagcctgagttatacaaaaaataggaatacatcctttttggtggtttacaaatctaattatattttcatgttaaaagtaagtggtggaggatatgtgaagtgtcatagtatttgccacagaggctttttcccattcaaattgtaattgtgtggaattttttattttgtagttgctttagtaaaaacaaatgatagaaaaagcttgctttaaattaaattgaacaatgcataagagtatagagtagaagaaaatatattttggatcatacttttgacaccacctttttcctctctcacaatacatttggaggatcttttcagatagacgtacatagaatgtcctgtatgccattctttgatggcagcagcacagctctccagatgctgatttaaaaggagtttagccacgtgccatttctttcttctggtgcccagtctcactaacctctcctaatagtctagcattggcccctagagaaattcaaaggtctgccaaggtaagtcagcaaaccagtcaagggccaggaagtcaggaatgtgtgagtagctgagtcaggggtctggaatcagaagtgagggtgagtcaggagcagggcccgggctgactcaggcaggctgaggtggtgacctgtggaatcagctgccttactggtgctccagggcaggggcaggctcaccatgctgaggcctgaaacttcacttctttcagggatcagctaatagatgtggtcaaggaatttggtcccagtcaaccttccctgcttcttctgtgttaggtcatctgtcagaaaatgttaaccaaactttagggccacatgactttgtttctctttgtggaaatgggaatgatatcactgcaaagagtcagggaagaggtcgtggggggaaaggaagagggggtcaaataaatcagcgagaaagagagaaacagttggaaagccagacagatactgggcgcttctgcaagagttataaactgttcttatcaccaaatctggtccattctgtcactcacatgagtccgtccagtcttcctctctcttattcccaaaattttagccttttaactgaagtccctcctcacagctgtggattgattggagagaatgagtgagaacagcttgtcaagggtgaccttcagcttttacgttaggtgactggtgaatattggaggcattgagaaggaacagaggaggtccatgtcttggagtggtaagtgggatgaggacttccattttgtgcatgttgaatctgaccgtgttgagtttgaggcatctgtgggacacccaaagaggggtatctggcacaagagaaaggctaggctgaagctactgattttggttgggcccaacagctgcttgcaatagttgcatgctcctgagggggaggctgtttgcattctgtccttgttttacatttccattgggagtggtgttttagaacttcttacagatgtcacaataattgtagacctggccctaccagccatgcttgaggtattatgtagattatctacttctttgctgctagttttcccagcccagttcaactatttcctgatgcaaatgaagcttctaagtgtacaaacttaaaatacctttattaccagtgcaaccacactaaactctaattgcccagcaactagaaagactaggagtagacagtttattgtatgtgtgcattttgatggagggaagagatgaatatttgcaaattcatattatgaagaacaagagtacttctccttgggagatgggtttttccaagatggtaaatgagttgcaaagaacaactttttctttcttttcttgagcttattcaactttttttttaaagcttattttgacttcag
